United States Patent 8,343,764 (GENES ENCODING GLUTAMINE SYNTHETASE AND USES FOR PLANT IMPROVEMENT) - sequence listing, part 6

SEQ ID NO: 24231 - protein, 503 aa, Wolbachia endosymbiont of Drosophila melanogaster
MKIKRALISVYDKTNIIDLASFLTQQQIEILSTGNTYKLLSSAGIKTQEVSDYTQFPEILGGRVKTLHPKIHGGILCNREKHKTEIQNLGIEPIELLITNLYPFWETVSSGSNEEQIIEQIDIGGVALIRAAAKNFRFTSVISSIQDYEALKAEMIENNNKTTLEYRKHLATKAFALTAHYDSNIHSWFLSQSKNNELPEFFALYGHKVQELRYGENPHQKAAFYSNQFTEYPLEKLHGKELSYNNIVDIESALNITSEFEEPAAVIIKHNNPCGAAIGNNALEAYEKALSCDEVSSFGGIVALNREIDLKLAEKLNEIFLEVVIAPSVNNEALKILQRKKNLRVIIHKSFQQNVKYQTKNVVGGFLVQENNDHTIKAEQVTECTATDKEKKDLIFAWKICKHVKSNAIVIAKDGCAIGIGAGQTSRIDSVNIAVKKAGEKCKGAVLASDAFFPFPDSIVESAKHEITAIIQPGGSLKDQDVIKAANENKIAMFFTGVRSFFH

SEQ ID NO: 24232 - protein, 506 aa, Wolbachia endosymbiont of Drosophila melanogaster
MNIKSVVLCILDGWGNGIENNKYNAISNANPPCWQYISSNYPKCSLSACGADVGLPGGQIGNSEVGHMNIGSGRVVIQSLQRINQEIGTIENNVNLQSFINDLKSKNGVCHIMGLVSDGGVHSHQKHISTLANKISQHGIKVVIHAFLDGRDTLPNSGKKCIQEFTKSIKGNDTRIATVSGRYYAMDRDNRWKRTIEAYEAIAFAKAPCHDNAVSLIENNYQNNITDEFIRPAVIGDYQGIKPEDGVLLANFRADRMIQLASILLGKTDYAKVAKFSSILSMMKYKEDLKIPYIFPPTSFADTLGQTIEDNKLRQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLNAVKKSSNTALIVTADHGNVECMFDEENNTPHTAHTLNKVPFIVSCDNLKLRDGRLSDIAPTILQLLGIKKPNEMTGSSLISCITLCHSS

SEQ ID NO: 24233 - protein, 450 aa, Wolbachia endosymbiont of Drosophila melanogaster
MALMKTVYVCQSCGHSTGRWVGKCIACDNWDTIVEEIAVKTGKRSISAPILIKTLSGSEIITPSRFLTGIEELDRVFGGGIVQGASILIGGEPGIGKSTLLLRIAANVVQLSSFECLYVSGEESLEQVSLRAKRLKINEPKIKLLSTVSLTDVVATIKENKSIKFLVIDSIQTMYDSRITSAPGTVTQVRICAHELTILAKQYGVSLLIVGHITKDGQIAGPKTLEHMVDTVLYFEGENSNQYRILRTIKNRFGPANEIGVFEMSEAGLVPVDNPSSLFLMAHDREVVGSAVFAGIEGSRPILMEVQALIAGTNMATPRRAVVGWDINRLAMIIAVLNARCKMFLHDKEVYLNIAGGLKIQEPSADLAVAASLISSIVNLPLPTSSIICGEVALSGEIRNISHADLRLKEAQKLGFKKAIMPKNGNYSSHDIEIIKLGHVRELREVFNYN

SEQ ID NO: 24234 - protein, 403 aa, Wolbachia endosymbiont of Drosophila melanogaster
MKEESILVKAGRKFNDYKGSMNPPVYHSSTILFPTYKDYLNAANGESIYDVINDGVARDYSYSNVGTPTVHYLSNALAEIEGSGQALIYPSGLFALTFAILTFAKAGSHVLIQDNSYYRLRRFAENELPKRGTEVTFYDPTQDITDLIQSNTSLIMIETPGSVTFEISNIEHIVKVAKEHKIVTVCDNSWATPLLFKPLDYGVDVALYAVTKYLAGHSDLVMGAIIAEGEIFKLLYESYKNYGVTIQSHDCYLAHRGLRTLYTRMKRHQNTAMEVAKWLEKHSKIKKVLYPALPFHPQHELWKSYFKGASGTFSIALDREYSCEELSCMVDHMKIFGIGASWGGCDSLILPIDRRSMSRSVMNSDYGGSFIRIFCGLEDPEDLISDLNAALARLPCLNTKTGR

SEQ ID NO: 24235 - protein, 325 aa, Wolbachia endosymbiont of Drosophila melanogaster
MVRAIQIKKTGGPEVLEFVDKSIGEPKGEEVLVRHTTIGLNRYDLEHRKGTRKIKNLPSVLGVEAVGVIEKLGKKISDGLKVGDRVGYCTAPPGAYCEKRIIHQKYLIKIPDDISDEVAAAVLFKGMTAHYLVNQSYKVRPGAFVLVHGANGGLGQIICQWAKDKKGVVIGSVSSDEKMKIALQSGCTYAINYNDKDFVSKVMEITQNRRVGAVYDPIGYATSKLSFESLGRFGIYVSYGQISGNAPISFSLLSSRSLFATGTSIYHYKHDRFTLVLTTMEIFEMIRKKLLTVRINKKYKFDEIIQAHRDMENRKASGLNIIKIS

SEQ ID NO: 24236 - protein, 233 aa, Wolbachia endosymbiont of Drosophila melanogaster
MRNPIISILNLSLSFDDRTVLKDLNFDILKGESLVILGGSGSGKSVLTKTIIGLLAPDSGSVKINSKSKNKFGVLFQNSALFDYVTVWENISFNYKKRFNISKKEAKQLAIEKLNDVGLEESIADMFPIELSGGMKKRVALARAIAHNPEIIILDEPTSGLDPIMSDIVNEIIIKLSRDLNPTIITITHDIHSAFKIADKIAVLYEGEIISHGTVQEIQNTNNEYIKKFIHYI

SEQ ID NO: 24237 - protein, 397 aa, Wolbachia endosymbiont of Drosophila melanogaster
MSDLAKRMSLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 24238 - protein, 162 aa, Wolbachia endosymbiont of Drosophila melanogaster
MVEQKDKYRPCVGIMLFNRQGHAFIGKRFESDSYWQMPQGGVDDGEELEQAALRELLEEVGTNKVKVITKSKDWIYYNLPEEVIPICWNGKYSGQKQRWFLMKFCGEDEDIDINYTGHPEFKEWRWQGIDSLVASAISFKKEVYKTVIEEFSSIIKASTISS

SEQ ID NO: 24239 - protein, 508 aa, Wolbachia endosymbiont of Drosophila melanogaster
MQDFKILENLKTKALEAEKGGGSDRITKQHEKGKLTARERLSILLDESSFAEYDKFVKHHANDFGMQNANFLGDGVVIGRGTIYGRKVFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHTSKTGVADFAFNNDVEMLLKMREFFTFLPANNQESPKSAPICNDVDDIDESLNTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPFFAASYGYIDDIIVPSKTRYHFCKALELLKNKKVERIWKKHDNLPL

SEQ ID NO: 24240 - protein, 398 aa, Wolbachia endosymbiont of Drosophila melanogaster
MNIPSIENCDLHNKTVLLRVDFNVPIKDGEIRDVTRILRALPTIQYLVNASAKIIIISHFGRPKARDNNLSLKNVIDTLSQLLNKKVKFIDDCFGEKVQRAVSVMDAGDIILLENLRFYKEEEQSDSNFAKQLASLADIYVNDAFSCSHRAHASISRITEFLPSYAGFCLQDELKYLEKAVSFKAKPITAIVGGAKISTKIKVLMKLTEKVNYLVLGGAIANNFLSFSKVNIGKSFFQNGVDDLLHNILETANKNNCKIVVPEDVLVAVNSDYSTSISRRTESILDGDIILDIGPQTLSTISSIIASSKTLLWNGPIGVFEHSAFASGTIGVMKIVSDLTHKGKLTSIIGGGDSLSAISAAGLADKDFTYVSTGGGAFLDWLSGDEMPGVAALQKRLD

SEQ ID NO: 24241 - protein, 193 aa, Wolbachia endosymbiont of Drosophila melanogaster
MRPVILCGGSGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFRGCPETSKRL

SEQ ID NO: 24242 - protein, 257 aa, Wolbachia endosymbiont of Drosophila melanogaster
MNLLVSGQPLKAKRYIDEIKKSAPNLYNLCFKYFTPQERFLYLKQRDFAGIEGISIDYLVMEKAKNVAMIEANFDWLDVGTWNSVLELSEKFSKEPASFQHVIREKEPVSTTESNKNLLSGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSTSFPLEIVEFQIGEHLSDNDIVRLDDVYGRIW

SEQ ID NO: 24243 - protein, 391 aa, Wolbachia endosymbiont of Drosophila melanogaster
MTISPILPVYSPVNINFSHGKGIYLYDVDGERYVDFHSGIAVSSLGHTNSRLISALKLQGEKLWHISNTYNIPAANNFAEKLINNSFADTVFFSNSGSEAVECGLKIARIYQNGKGNKNRHRILTFHGAFHGRTFLTCATNDKQKFSELLNPYIDWCDNIEPNIESVKKAISSGIGVILIEPIQGQGGIKVMNEVFMKELRRLCDENDILLFFDCVQCGAGRTGKLFAYEHIGVEPDICALAKGIGGGFPLGACLATENAAKYMAVGMHGSTFGGNPLATSVGNAVLEELLSPGFLKNVEIRGKYLKNKLEDLASKFPIIEEVRGKGLMLGIKVKADNQKFAEELSHRGLLTVGVTSDNVVRILPPLIITEKEIDEGIEILTQYLSEKSSD

SEQ ID NO: 24244 - protein, 245 aa, Wolbachia endosymbiont of Drosophila melanogaster
MIILSNLSCYAVFGIELEFYIEGIEKEYLFLNSIKNKIASLEFSCEKENSTHQYEIKSGCYTNSYNLIKHFELAKQSLTETAQKLGGNVSFKAKPYLDRAGSALNVHVNLVNSNNGNLFYINEQKYSDYLIHSIGGLCAMMKKHMLFFAPNDDSYLRFQYPDIHTPTTISWGVNNRTAAIRIPYFGNDSKRCRLEHRVPGTDCNLEKVLTAIIEGIVFGIENKIAPPNRVYGIASDPQYKMESLI

SEQ ID NO: 24245 - protein, 444 aa, Glycine max
MATIVSINARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVFLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 24246 - protein, 172 aa, Bdellovibrio bacteriovorus HD100
MAQLKDQMVSFLTSDEIKELVENLASQIEADYEGKEIVFICPLRGSIHFTADLMRKVDLPQQVDFVHVQAVERGGAIKIVKDISVNIAGKHVIVVEEIIDTGRTLSFLRSRLFASAPASLKIVTLLDKPARRELPIKADYIGKTIEDRYVVGYGMDSEELGRNYPDIYALKN

SEQ ID NO: 24247 - protein, 505 aa, Bdellovibrio bacteriovorus HD100
MSTTIFPIKYKGDFINGRFVPVSKGDGEFKDISPADLSDLVMTVPFKNDHIDEACVAAKKAYMGWAMLSVDERRGYLMRLKELFDSHAEQMAQVISRDTGKPTWEALTEAKALGAKIDITLNQSLNLVAEERIPNALPQVEGVIRYRSRGVMAVVGPFNFPAHLPNGHIIPALIAGNTVVFKPSEQTPAVGQFMAEIYEKAQFPPGVFNLVQGAGAAGGRLVANEHVDGILFTGSYEVGLKIKQETLNHYWKILALEMGGKNATVVWDDADMDKAIYESLVGSYMTAGQRCSCTSRIILHPKIADEFTERFYQAAKKLSIGHWTENTFMGPLINEAAVEKYIRFQEIANRENCESLMRGKALDLKHKGYYVTPSIHLVNKFDPNSVYQKSEIFGPNVAIYQSDNFDEAMNIVNSSGYGLVMALFSKNKELYEQALLKARVGLLNWNRTTNGSSSRLPFGGMGKSGNDRPSAHFAIQYCTVPVASLEDATPFDPTKILPGMNLDMK

SEQ ID NO: 24248 - protein, 470 aa, Bdellovibrio bacteriovorus HD100
MTGKDVLKFANEKGAKMVDLKFCDMLGTWQHLTVPLHQLTAEAFEEGYGFDGSSIRGWKGIEESDMIIMPDPSTAMMDPFMQVPTLSLICDVCLPETLQAYNRDPRQVVKKAIAYMQSTGIADTAYFGPEAEFFIFDDIRYEQTNNSAFYMIDSDEAVWNTGRDEGGKNLGYKIRPKEGYFPALPTDSQQDLRTEICLELERCGMQVERHHHEVASSQGEINFRFDTALNMGDKMMWFKYIVKNVAKRYGKTVTFMPKPIFGDNGSGMHIHMSLWKDGKNLFAGNKYAGLSEMALHYIGGVLKHAPALCGIINPTTNSYKRLVPGFEAPTKLAYSFKNRSAAMRIPNSGPNPKAKRIEFRTPDPSANIYLAEAAILMAGLDGIINKINPGDPLDKDIYGLPPQEAAAIPSVPGTLEESLNHLMKNCSFLKKGDVFTDDLIETWVQYKIDKEVRPVQQRPVPYEFHLYYDC

SEQ ID NO: 24249 - protein, 326 aa, Bdellovibrio bacteriovorus HD100
MRAVEITQPGGPEVLKITERTKPEPAIGEVLIEIHASGVNRPDCAQRQGTYPPPPGASDIPGLEIAGKIVAVGAGVSKWKVGDMVCALVSGGGYAEYVAAPEGQCLPVPTGMSVVEAAALPETFFTVWTNLFESGRLQKGESVLIHGGAGGIGTTAIQMASAMGVRVFTTVGKKESVSICQELGAERVILYKEEDFVSVVKSLTADKGVDVILDMVGGDYFARNIEALAVQGRLVQIATMQGAKVELDLRKVMFKRLTLTGSTLRARPVAEKSRIATALLQNIWPLLNKNQMRPVIYKVLKLEQAAEAHAMMEASQHTGKIVLTTR

SEQ ID NO: 24250 - protein, 182 aa, Bdellovibrio bacteriovorus HD100
MSTLNHIEFNTADGKKATLADYSGKVLLVVNVASECGLTPQYEGLEKIHQKYESQGLRVLAFPANEFGAQEPGSNEQIQEFCRTQFGVKFPVFAKMVVKGEGQHPLYQQLTTLQPAAQQVPGGKLKSVLEEHGLLSGGPSDIMWNFEKFLIGKSGNVVARFAPDMTPEDPTIVKAIEAELAR

SEQ ID NO: 24251 - protein, 351 aa, Bdellovibrio bacteriovorus HD100
MSEKTVKFDPTTTISAEFGIFGIPMTEEESKVVLVPVPWEVTTSYGEGASRGPQIIRQASEQIDLFDIEVGKAYEVGYHMRDFPQDLCNMNDKFKAVAQELIGMRTNMSEDEAKMNKLASQVNEACEEMTQWVYDQCSDVLKKGKLLGLVGGDHSTPLGAIRAVSDKFKGEFGVLHIDAHADLRTAYQGFKQSHASIMYNVMTDAKKPQKLVQVGIRDFCEEEYDFSNSREDIKTFYDLELKRRMLKGETWEQVCKDIIKELPQNVYISFDIDGLDPAFCPHTGTPVPGGLSVDQVFFLFREVHASGRKIVAFDLNEVSTGGLPEGEVEWDGNVGARILYKMCGWLVKSNA

SEQ ID NO: 24252 - protein, 186 aa, Bdellovibrio bacteriovorus HD100
MIRCPLLSQNEISSHTHAAPLRRFPMKKHLYDFTVKAANGQPVSLDQYRDKVVLVVNVASKCGYTPQYKGLEELYQQNKDNGLVILGFPCNQFGAQEPGSNEEIQQFCELNYGVSFPVMGKVDVNGGNADPLYQWLKEEAPGLLGTEMIKWNFTKFLVGKDGAVLKRFAPKDEPKDIADDIKKALA

SEQ ID NO: 24253 - protein, 400 aa, Bdellovibrio bacteriovorus HD100
MIQLSKRAQNLKPSPTLFLVAKAKELAAQGHDVISLTVGEPDWPTFKGASDAGIEAIQKGITKYTPANGTVELRKSISEKLKSELGFEYSPKEITVASGAKYIIFSALQMICSPGDEVVIATPYWVSYPAMVELADGVPHIVECGEMENFKITPEKLEAAINAKTKGFLFCSPSNPTGLQYSADELKALAEVLRKHPQVVIISDDIYNRLVFDGTKVAPHILTVAPDLKDRTVLVNGGSKAYSMTGWRIGWASGPERLITAMADYQSQSTGSPSSISQHALLAAIKTSEADIKGVVDKLVARKNSGLKELETVPGFKTAEPQGAFYFWVDIRAHLGKSYQDRVIRTSKDFCDVLLEKFFVATVPGAECGTEGFMRLSFAVSEETMKRGVARMKDLVSQLV

SEQ ID NO: 24254 - protein, 282 aa, Bdellovibrio bacteriovorus HD100
MEKANDPVRILKKSTARKLLPAVSAHDNKATRGRSLLLAGSAQYPGAGILAARGALRMGSGYVMLAPQGVTVSSLENPDFLVLDLKKDSWQQQKFDALLCGPGFGVTPFTAEVIRELKARKVERVVLDADALTVCAEQDLFPLPATWIVTPHTGELARCLGVEAEEIAANRYGFVRVAQEMMGCVVLLKGPQTLVAGPNRVYGISTGNAALAKSGTGDVLAGIITALRAQKVPALRAALLGAYVHGATANLWKSRKRDLLSMTASDVVESLPQVLYNLREGF

SEQ ID NO: 24255 - protein, 408 aa, Bdellovibrio bacteriovorus HD100
MHVMLEISHSFHKIDESVLVKCQESLKLFLQRKEIGFPQVMERVSLWQQSYKVGTELAEKFKKIVIVGLGGSSLGTRVIAEVFCARNMFFVDNVDALEFETLIEELGDLKEVAWVFISKSGTTIESLCALELVDQIYTEEKLNLPKHSVVISETKDSSLMAWARKHSIPTCEIPLDVGGRFSVLSPVGMMPAAFLGLDLEKFRVGAMRALNDTAVVTQTMAQVAQSYQREEWITLLWIYNSRMKSFGAWYQQLWAESLGKPETRAGKPAPRVSTPMSAVGASDQHSILQQVMEGTKDKFVVFQRVEESEAGSLRIKKAQFKETQDLEGRTMGELLRAEGLATQEALNQSGVSTMTLKTKVLDEHSLGYMFMFWQLVVAGLGDYLEIDAFNQPGVELGKRLAKEKLKKA

SEQ ID NO: 24256 - protein, 473 aa, Bdellovibrio bacteriovorus HD100
MQNFDVVVIGAGPGGYVAAIRSAQLGFKTAVIEREFLGGVCLNVGCIPSKAMITATHLLHKAQHNFKEMGLNIKGGIDVDMKQLVKWKQSVSDKMSGGVNQLLKGYGVTIIKGDAEFKSSKEISVKSSAGTESVQAKYFVVATGSRPIEIPGFKFDEKDICSSTGALAFDTIPKRVAVIGGGYIGLEISSYLRKLGTEVTVIEAQSALLAGVVDPDCAQIVTRKLTKAGVNVLYGAKAKGQKKVKDGYEVTVEINGKDEVVKCDKILVTVGRRPNGDQANLKAAGIQVDERGFVKVDAQRRTNVSNIFAIGDIAGQPMLAHKASHEGVLVAEVIAGHNRVYDAKTVPAVVFTDPEIAAAGMTEAEAKAKGHTDLLISKFPFAANGRAVSMMETDGFVKMIADKKTHVLLGVHIVGPEASNLISEAVLAIEMGARIEDLALSIHPHPTLGETMMEAAEATLGHAIHIIQKPLKA

SEQ ID NO: 24257 - protein, 422 aa, Bdellovibrio bacteriovorus HD100
MSEIISVISREILDSRGNPTVEVEVTTADGNMGRAAVPSGASTGAHEACELRDGDKNRFLGKGVYKAVDNVREKIAPEIVGLQATEQVYIDKILRDIDGTENKSNLGANAILGVSLAVAKAAAKDCRLPLYRYVGGSQASRLPVPLMNVLNGGAHANNGLDIQEFMIVPTVNNSYAESLRAGTEIFHTLKKILAKKGLSTAVGDEGGFAPKLGSNQEALDLLMNAIVDAGYDPGQNVFLALDVAATEMFKEGKYEWQGGHISPTELLGIYKSWAEKYPLVSIEDGFAEDDWDSWVQSTAQMGSTMQLIGDDLFVTNPKRLRMGLEKKAGNALLVKVNQIGTLTETYEAVNLAQRNKFRTIMSHRSGETEDVTIADLAVGLNCHQIKTGSLCRGERTAKYNQLLRIEEDLGGMGLYWDKAAFR

SEQ ID NO: 24258 - protein, 247 aa, Bdellovibrio bacteriovorus HD100
MIQIQALDKFFGSRQVLKNVSCEIKDNEVVCVIGPSGSGKSTFLRCINALEIAQAGTIKVDGFEVTNPQTDLNKLRAHVGMVFQRFNLFPHKTALQNIMLAPRKVKHLSKEAAEAKARELLARVGLAEKADSYPHELSGGQQQRVAIARALAMEPQVMLFDEPTSALDPEMVGEVLDVIKSLAHSGKTMVIVTHEMGFARQVSDRILFMDEGQVVEQGPPEKIFSRAESERTRTFLGKVLRFHETPS

SEQ ID NO: 24259 - protein, 369 aa, Bdellovibrio bacteriovorus HD100
MKIKAAVAWKAGAPLSIEEVDLEGPKKGEVLIRVVATGVCHTDAFTLSGADPEGLFPVILGHEGGGIVEEVGEGVTTLKKGDHVIPLYTPECKECKFCLSGKTNLCVRIRATQGKGLMPDGTSRFSKDGKMIHHYMGCSTFAEYTVVPEIALAKVNPAAPLDKVCLLGCGVTTGIGAVLNTAKVEKGATVAVFGLGGIGLSVIQGAKMAGASRIIAIDINDAKWEMAQKFGATDFVNPKKHDKPIQQVIVEMTEWGVDYSFECVGNTQLMRAALECAHRGWGQSIVIGVAGAGQEISTRPFQLVTGRVWKGSAFGGVKGRTELPGYVEQYMSGEINIDDMVTFTMPLEDINKAFDYMHEGKSIRSVIKM

SEQ ID NO: 24260 - protein, 348 aa, Bdellovibrio bacteriovorus HD100
MIQAKGMAAPTSKAPLKPYTFERRDPKDHDVVIDIKYCGICHSDIHMVRDEWGPGHFPMVPGHEIAGVVRAVGPKVTKYKVGDHVGVGCLVDSCAECAHCKQDLEQYCMEGQTLTYGSMERDGSGITQGGYSNVIVVKESFVVRIPDSLPLDKAAPLLCAGITLYSPLAHWKAGPGKKVAIMGLGGLGHMGVKLAKAMGAEVTVLSHSESKRDDALKLGADRFVLTKNADAFKDNAMYFDLIINTVSSADLEMARYFSLLKLDGTLVSVGAPDKPLSVNVFPLILMRRNFAGSAIGGLKETQEMLDFCAKHNITPEIELITPDQVNVAYERVLKSDVRYRFVLDMGKI

SEQ ID NO: 24261 - protein, 252 aa, Bdellovibrio bacteriovorus HD100
MDHPAIKLDHVTIELGGEVVLSDVSLEVQHGETLVIVGPSGAGKTVLLKTMAGIYKPLKGHVYCEGEDWQDLQSEEKIRLARKIGMQFQKSALFDSMSSFENVAFPLREHTTMNEQEIESRVRECLAEVGLSQAQNMMPHELSGGMKQRLGIARSLALHPEIIFYDDPTAGLDPINTDILLDLILNLKKEHASTIIMVTHSLLCAYKMADRIVLVGNKQVIVAGTAEEAQHSSHPLVRQFVEGIMEGPLKWD

SEQ ID NO: 24262 - protein, 401 aa, Bdellovibrio bacteriovorus HD100
MANGLKGIKTVRDFELAGKVVFLRLDLNVPMENGKITDENRITASLPTIKYCMEQGAKLVMASHLGRPKTKDDTEFSLEPVAKRLQDLLNAEVILVEEPDSDAPKHLLPSLKPHQLILLENVRFEEGETKDSVEFAQKIANYSDIYINDAFGASHRAHATIHALPSVMKDKGIGFLIEKEITMLDSLLQNPKRPYIAVMGGAKVSDKIAVIERLMDVVDGFIVGGAMAYTFLKAQGLPVGKSLVENDKLKYAKEMIERIEARNKTILLPVDHVATKGITDTAHAHVTNDVAIAEDELGVDIGPKSIKNFSAALREAGTIFWNGPMGIFENPAFAKGTFGVAQAIADSEAIKIVGGGDSAAAAEASGFAGKMTHISTGGGASLEYLQGDKLPGLEILRTRIR

SEQ ID NO: 24263 - protein, 241 aa, Bdellovibrio bacteriovorus HD100
MKKIFAANWKLFKSPKETREFFGQFKELAGKATGEVVFFPSAISLEAASESLKGTSIKFGAQNCYFQAQGAFTGENSAQVVKDLGGSYVLIGHSERRAIFGEGDALVADKVAFVQGLGLTPMLCIGETLQERESAKTFRVLETQLNLGLAKADKTKPVVVAYEPVWAIGTGKVATPEQVAETHTDVFNILKALGFETAPILYGGSVKPDNAAGLIKQPHVNGFLVGGASLEAKSFSEIASV

SEQ ID NO: 24264 - protein, 347 aa, Bdellovibrio bacteriovorus HD100
MAKIQFSNIKKSFGSADVLKGIDLDIAPGEFLVLVGPSGCGKSTLLRTLAGLESADSGTISIDGKKINDIEPQNRDIAMVFQSYALYPHMTVAENMGFGLKLKNLAAAEITKRVNEISELLQIKHLLDRKPKELSGGQRQRVALGRALSRQTPVILFDEPLSNLDAHLRSQMRLEIKRLHHNSKSTMIYVTHDQMEATTLGDRIAVLKDGVIEQIGTPSEIYHRPKNTFIATFIGSPEMNFLEGAVLEKIPWPEARKADQILGIRPDAFALNQGPLGTQEVALGDFQIDISENLGGQQMLHGTLAGNNVRILVDSMDNFSMKQTLPLKIDLTKAHLFDKKTGLNQRL

SEQ ID NO: 24265 - protein, 405 aa, Bdellovibrio bacteriovorus HD100
MKNVFKKLIPLAAAVTFADPAWARILGDPSERTRVLLEEQQFLCSQNETLVINGDVEITRKNEDLRNAPLNVDLICKRIEFKNGGRILTQSNLQIVADSVEGFMNVESIRGVKGQQGEFASAVLEIANTGSAGARGGNGRGGSLTDSPEDGGRGQHGYNGMDGRDGNNGAPGEPGVHASDIVVKINRIQGTVGFRIRAVGGEGGTGGKGGRGQQGGNGGVGGDGGRGGNQKYAIWNRSGDGGDGGDGGHGGNGGNGGAGGDGGRGGNGGKIALYVAEVFNTLELTGDEFDNRGGPGGQPGMGGEGGVGGKGGEGGKGGSSGTALVTSSCDVPPCEGDNGRHGKKGLDGKPGLAGPQGRLGQDGLAGVKILDPKFKFVKSVPDDYFDKLPELGTEKNLKILRMKLP

SEQ ID NO: 24266 - protein, 2828 aa, Bdellovibrio bacteriovorus HD100
MNCTFLNTIYLTQQAKRLLLSFSLMVLAGCSLELQIAAENSTPTTLKWSSDSLGQQGLLKAEWILPEKADIKEQQVLYFRGDSCATPILPVANVGPAETSHLPTFTPEDGVEYTFKVFVLSKDGSVASSSCSNPITYFGAFSIESLSQSIINEGNVTAAPFKGTCLLGSSIEFSAAATPLLTFTCSDRQWTQNLDFSSLPNLYSGDLIATVTAPGGTPKEYRLAITKDVVPPTITLNALSTITSVNQNAYTVSGTCSETGHNVSVTAGAVSAEVVCSGGTYSTSMNLSSLSGTSVVVSATHTDPVANTRTATSTVSRDVTGPAVNSLALNNGDAATNTLSATLNSSVTDAAEMYLSSVAACTGGSWVAYNAAAPWTLTNSNATNTVYAKFRDSLGNESPCVSDDILHDNVAPTLAFTLPVSGTIINSDNVNAFTVSGTCSENNRSVNFSGPGGFTGTTICTGSAFSAILDLSALPQGTFQLTASLNDVAGNSNTANSPTYNKDTQAPTGTLSINSGSATTNDLAVSLGLTSADAAEMYVTNTAGCATGGTWESFATGKSWTLPTADALNTVSVKFRDAAGNSSVCYDDSITHNSTVPSLSLASPADGSFVNLANVSAFVISGACSEDGRPVEISVTGQSATTATCSSGAWTKTLDLSTSAQGDLTFTLNHSRASGATAPTVTKVFAKDTVVPTVDSFVINNNDAYATSLSATLASTTTDGVQMYATNTALCLNGGTWETYNASKSWTLPTANNTNTIYFKVRDVAGNESDCAFDSIIHDSVSPTVTLTSPVAGTFINSLNQTALNLSGACSENGRLVNLTVTGHAGVTGSATCTTGSWTASLDFSSLADTSGTPFTVVASHSRVSGNNATASSTYPKDTQSPGAATITGAPTGTNSTSTLNITVGGTDITHYRYFIVVPGGTEVCTNSTAYTGSDIPVATKITDTLTEQGAYKLCVFGRDTAGNWSTATSQATWTRDTQGPVILTVDATTADGVYGPGQSVQVRVTFDENVTVTGTPQLTLETGTTDRVVNYSSGSGTTQLLFTYVVQTGDETPDLDYTSTTALALNGGTMRDALSNNATLTLPAPGTANSLAGTKNIAVEAYSSPLAKAILSNTPMGADSSDTLNITVSGLDVVSYKYKLGLSGSVDCSTYTDYSAEIPVATPITDTISAHPKYSFLKICVLGKDSTGKWQKAFAVTQAQWHYVENLPSFNLCGTVKSSTAPKGRLYDSGGPTANYSDNETIANCYFSINTGAAISATVSYDTENNISYDFLRLRETGAAGSVILGPVAGTVTNTAVNSTSGTLYAEFKSDGSVVGAGVILVWGGAPNLTPTMTLTNVTNATVNTVYSRVAAAYGLSTATVISVSGYDSEIRNVTTSSDFSSSVLVNPGDAVEVRMTSPNATDQYRLAHVRAGDASYYWMVATPLLPTTVTHVTATNPDGTYKPGDNIDIQVVFTKPVTVLGTNPVMTLAAGSGVTATYLSGSGSTELIFRYTVAYEHSAADLDYSSTTLTNAASIKDAMGSNATATLPAIGSANSLAGRKNLVIEGYPFVVATASNVPASNNSTTTLDATVGGTNVVSYKYKLGTSATTDCTVATGYGSETAISSNITADLSAFANERLKLCILGKHTNGTWQALWHPTEYQWDRFNVQNFSSMCSATATTATTGFIYDSGGASGQYQNNENCQFEINTGAPISLTFMAFNTEASWDKLSVYDGTTAGTLLLNQVSGTNIPATQTANSGKMTIKFTSDGSAIRDGWVAYWGNPGPILTTPPTFAKIHNAALNTRYATANTTISSLNQTAIATVTGADAQIRNITTGSYWGGSVAVSSGQVIQLRMTSPAANAQTNTATVTIGNAVSTWEISTPYPPPTPTLTGYPVGTSTTSTLNVTVSGFRVTQYKKAIITSGTCAAATYSAAYNTSTNITDNISALPNGPVTLCVLGGDATNLFQAAADAVSVTWTKDSISAVNITSTRMNRVQEGSGPRTINVSLTPAKSYDVTTYYKVTGDAVNPDHHDLSSGFITFPAGSTTATITVNFPDNSLVEGEKLLNLHFTHTDSPLATMGDNYQTQYFIADDEKNLKASQLSMARGHQCAIMEDSSLRCWGTNMYRQIDGSVSDFKASPFVINIAGVTGYRSVSTGEFHTCTVTLDNRLFCWGNSSDGQAGGGTTGNQWSPLHVDNTTTYLSVTSGDYHSCAITTANKLKCWGKNDYGQLGVNDTTLRTSPTDVDNANSYKFVHAGSRSTCAIRSDDKLFCWGSNVNYQLGDGSATARGVPTAIDAAESYKSVAIGSKHACGITLTNNLKCWGTNNYGQVGDNGVTTRTTPVSVSGSEVYKTVSVNDDGNIATARGFTCAITSNDVLQCWGVNSLIQLGNGTSNMQYVPATSDAGTTYAAIQTSGSRACGITLTGALKCWGNLLGDTSPQSSYSYGSGNARHQYAEKMTKASEWTFDTLSVFGADAIDDHYSGTCGISSNKLYCWGSMKATEGPFGDGSQTDARRPAPVMIDPSTNYSYIHTRRSHDFCAITSAGQMKCWGINNYGELGEASAVSATVHTPTVADSTTTYTKVVSFNHATCGITTTGVLKCAGNNDNGRLGLGDTTARTGFTVVDSGVSYSDVEMGMSHTCGRTTAGVLKCWGSNTQGQIAKASGTSAYYLPDVVDSGVTYTKIATGSFNSCGITSANKLKCWGANFLGQLGDGTSASRYTPTAIDASADYSDISMASGHTCGITAGQIKCWGNATYSGLAAPQYTGGHTVYMSPMVVDGANTYTKVWAANSSTCAKATSGEVRCVGRAYGGNFGYVDSAVLMTIGSGITKIIYTPTFIHKWQGY

SEQ ID NO: 24267 - protein, 329 aa, Bdellovibrio bacteriovorus HD100
MRIYSDITKTIGQTPLIEMQRIGKGLPGRLLLKLEFFNPLGSVKDRIGLAMIEDAERSGQLKPGMKIIEPTSGNTGIALAFVAAAKGYDITLTMPETMSQERRTLLLMLGAKIILTPGPLGMKGAIAKAMELLEQTPNAWMPRQFDNPANPAIHKETTALEIWNDTDGKVDMVVSGVGTSGTITGVGTVLKAKNKNIKIIAVEPAESPVLSGGKPGPHKIQGLGAGFVPSVMDRSVVDGVEQVSSEESIKVAREVIKKEGIPVGISSGAAISAGLRQAAKEENRGKNIVVIIPSTTERYLSTLLAEQERAEALSLPVATVDENYLSKVK

SEQ ID NO: 24268 - protein, 273 aa, Bdellovibrio bacteriovorus HD100
MNHFEKYESYIPFDLLVPQNFLLATLALTSVVLIRYLALTTCFYVAFYRKSWPWAKSRQIYPTLPDKKIQLFEIKWSVISSGIFGLGGVLLGILWQTGWARFYLPLDEYGWGYLLLSGFLLSLLHDFYFYVTHRALHIPWLYRRFHAVHHASLQPSPWASFSFHPVESIIEALPLPLILLFLPLHPLVLLVYLTLMTLSAIVNHLGFELLPRGSARHPLGKWLISGTHHSGHHRYYKYNFGLFYTIWDHLLGTQHPAYEAQFMKNTGETDQST

SEQ ID NO: 24269 - protein, 329 aa, Bdellovibrio bacteriovorus HD100
MQAGSVSDVVGHTPLIKLQSLSKITGCEIFAKAEYLNPGGSVKDRTALGIIQSAEKQGLLKPGDTIVEGTAGNTGIGLATLAAQRGYHCVIVMPDNQSKEKYHALEALGVELVKVAPCPFANPNHFYHTARALAESRPNSFWANQFENTANFEIHYKTTGPEIWEQMGQRVDAFVSSVGTGGTLAGVSAYLKEQDPKVFTLLADPMGSGLYSFVKSGKFEAQGSSITEGIGIMRLTENFKKARVDEAVQIHDEQMLSMLYYLAQHEGLLVGTSAALNIFASYQYALQNQGKGLRIATVMGDSALRYQSKVFNPQFLNEKNLKIMPLIHS

SEQ ID NO: 24270 - protein, 346 aa, Bdellovibrio bacteriovorus HD100
MFNWKDIKNRGKGLTFDDVLIIPARSDVRSRRDPRLTSKVTKNFTIETPIVSANMDMVTEYDMAFAMNQLGGMGILHRFLDIEEQAAQARRLKENGVKVISGSVGVGEEFKTRAKALVEAGVNIITIDIAHGHSVQMMETMKWLKDQYPQVDLIAGNLATPDAARDLIEAGADAIKVGIGPGSMCTTRIITGCGVPQLTAIGLCAEIGESYGVPVIADGGIRTSGDMVKAFAAGASTVMLGSMLSGTIETPGEIKNGKKQYRGMASRSAQDSWRGGVPEGMAPEGESTQVTVKGHVKDVILEVTGGIRSGMSYINATSIAEIKDKALFMEMSSNGIAESRAHGVKN

SEQ ID NO: 24271 - protein, 115 aa, Bdellovibrio bacteriovorus HD100
MTSELPEVKITDTVIGTGQTASKGALVFCHYEGFLEDGTKFDSSYDHGRPFEFVVGSKKVIAGWSLGFLGMKEGGKRTIYVPAHLAYGERQIGKFIKPHSNLIFHVELIEARPRE

SEQ ID NO: 24272 - protein, 218 aa, Bdellovibrio bacteriovorus HD100
MIKSKVRTASKGFPRAFSCDLPPPPLEYAHQGETMRIFTLIALILCTSFAWAKDTPSSFFDLSANSLSGKKVNFSTYRGKVVLVVNTASQCGFTPQLKELEEMYKKYADRGFVVLGFPSNDFKQEKGTNDEVQTFAAKEFGVTFPLFDKAPVSGKDIQPVYQFLTTQKPGLIFKDVAWNFEKFLINRKGQVVERWSSITKPSSDSITKSVEKALNEPL

SEQ ID NO: 24273 - protein, 487 aa, Bdellovibrio bacteriovorus HD100
MDREVPYALTFDDILLLPQYSEITPTDVVPRSVFARGKYLNTPIISAAMDTVTENRVARVMAQHGGLGIIHKNMDIDKQALEVEKVKKYESGMIMDPITLGPDHLVEEAVALMEKYSISGVPVTVNGELVGILTNRDLRFEENFNQPIRNLMTKENLVTAKMGTTLDEAKKILQKHRIEKLPVVDSKGKLKGLITIKDIEKAKNYPQATKDEHGRLFVGAAVGVGPDSRDRVEALVAADVDVLCVDTAHGHSKNVIEMVKYISQKHKDVIVVAGNVVTADGTQALLDAGAEVVKVGVGPGSICTTRVVAGVGMPQISAVMECAKVARSRGKTIIADGGIKFSGDITKALALGANSVMIGNLLAGAEESPGETILFQGRTYKVYRGMGSLGAMSKGSKDRYGQMDVEENDKLVPEGIEGKVAYKGSASGVIHQLIGGLKSGMGYVGARNIDELQSKAKFVQISAMGLRESHVHDVSITKEAPNYRIES

SEQ ID NO: 24274 - protein, 495 aa, Bdellovibrio bacteriovorus HD100
MLADRRAKIVATIGPATRDEKNLEKAIKAGMNVARLNFSHGSHEDHLKVVHSLRKLSKELQAPVAILQDLQGPKIRVGKFENGSIEIKPGEKLVVTTAKVLGKPGLVPSDFQELPLACVPGTRILLDDGLMEVKVLQVRGEEIDVEVVYGGILKDRKGMNLPGVNLPVDCMTPKDLEDLQFGIANKVDYIALSFVRHARDIRKLRELIEAGNSNAKIVAKIEMVEAIENLEEICRLSDAVMVARGDLAVEVGQSRLPGYQKRIISVCNQLGKPVITATQMLDSMVENPRPTRAEITDVANAVLDGTDALMLSAESASGKYPFKCIRTMHEIITEVERNEEEYYKISLENEFLSTPASIAASASLSALKLNATAIICLTTSGKTANIISAFRPKARIISVTQHLDVLNGMELGWGIQTHAIKPYKTMEDILREVDLLLVSHGLGKTGDRVILTLGQPIACGAKTNSIYVHTVGGENVAKLPNDKLPLRCQEEPVVE

SEQ ID NO: 24275 - protein, 467 aa, Bdellovibrio bacteriovorus HD100
MLERIFLHQKQFALKLRGESLDVRIEALEALEKSIELHKQDIIDALKKDFQKPEAETLLSEIYPVLKEITYAKKNLSRWAKGRRVPTPLTLFGSKSYIVPEARGVCLLIAPWNYPFQLAFSPLVSAIASGNCAIMKPSEQTRHTSSIIKKITTEAFHPDHVFVAEGGPETTQELLSFAFDHIFFTGSTRVGKIVMTAAAKNLASVTLELGGKSPTIVDATANLAEAAEKIAWAKFINAGQTCVAPDYLFVHESVQHNFKKHLIAALEKFYGKSAEQRKQSPDFARMISFNHSQRLKDLIDEAVSKNAKVFFGGESQPEEHYCGPTLIEGVDPHSLIMQEEIFGPILPVMTFKEISEVIHFINERPKPLALYCYTHSQMNMEKIEKETSSGGLVYNDSVIHFANPHLPFGGVNHSGMGSYHGKHGFLEFSHQKAVLKQSFLGKLLRVMYPPYTEFKMTALKNLIRFSL

SEQ ID NO: 24276 - protein, 404 aa, Bdellovibrio bacteriovorus HD100
MALGASAFAGSVFIVFLIFGLGMLAPVTALFARMQGQENYPYGGVLLRHSIIVALAISAFIIGLLYALLPNLKVFGQTNEVLEMGAAFFEITIWSVLPSLLYQSYKQFTDGIGKTKVAMYVMIFGVVLNITGNWVLIHGLYGLPKLGLNGAAWATLIARCLMALIMVTYVHIHPHFKKYLVERWVHRFDHHLLKNIIRLGLPNGFTYLFEVGAFSAAAVMMGWFGATPLAAHQITISLASTSFLITLGIGIAASIRVGYELGRGDYSLARFAGFTAIKLGAAYMSLCALGFFFLREWFPTFYVTDQDVIAWAAKFFIVVAIFEIFDGIQAVAIGALRGMSDTQWPSIIAFFAYWVMGLPGGYLLAFHLGVGPVGIWIGLLLGLIFASILLTWRFHILSKRFLKN

SEQ ID NO: 24277 - protein, 231 aa, Bdellovibrio bacteriovorus HD100
MNKLVLGGLVVAAMAFTTACQKKVKLDTDMKKASYAIGQQIGGNLKQQNIDFDADALAMALKDAAAGKNEMSKEDMQAAMMKLQEMAMKKQQEQAEGNAKAGKDFLEKNKSAAGVKTTASGLQYIVEKEGTGASPKKEDVVKVHYKGTLTNGEQFDSSYDRGQPAEFPVGGVIPGWTEALQLMKVGGKAKLFIPPELAYGPSGRPGIPPNSVLVFEVELIDIVKQDTKKKK

SEQ ID NO: 24278 - protein, 356 aa, Bdellovibrio bacteriovorus HD100
MNNHALFQPFQFKGLTLKNRIVMAPMTRQKSPDGVPTEDVAKYYQRRAEGEVGLILSEGTVINRPASSNEKDVPHFHGEKSLHQWQAVIQAVHSAGGKMAPQIWHMGKMKPSSSGWLPKAAFEGPAEMTLEDIQNTINAYAQAALDAKNLGFDTVELHGAHGYLIDQFFWPGMNTRTDRFGGNTIAARNTFAVEVVKAVRAKVGADFPVILRLSQWKQQDYNAKVATTPKEMEEWLLPLSEAGVDIFHCSQRRFWEPEFADSDLNFAGWAKKITGKPTITVGSIGLSGGDFLNSFRGQGAEVGGLEELTRRLDRGDFDLVAVGRALLTDPQWVKKVKEARTNELKGFNPADLAVLT

SEQ ID NO: 24279 - protein, 463 aa, Bdellovibrio bacteriovorus HD100
MAKSKTKTIYTCQNCGAQRPRWEGKCSDCGAWNSYVEELQMPEVKTRGWSTGSGERESTGSKPVALDQRLEEVKLDRFDTSFEELNRVLGGGLAKGSFVLLGGSPGIGKSTLLLQMAGGLANNKHKVLYISGEESVSQTGSRAHRLGIRSPLIEVGCESNLTAVMEMARFKKPDVLVVDSIQTMFLPDLQAAPGSVSQVRECAGHLMGLAKHDGITVILIGHVTKDGNIAGPKVLEHMVDCVLSFDGDISYNFRLLRSLKNRFGAAHELGVFQMNSKGLEEVSNPSELFLEERGDQLIGSAVFASMEGTRPLLCEVQALTLSSPMAMPRRTALGIDINRLHLLTAVLDRHLDVRLAHNDIFINVVGGLKLVEPASDLAVAAAILSTEHRRDLDAKTCYFGEIGLTGEVRGVSFVEQRIKEADKLGFKHFVIPFSNKRHLEDVKLSKDKKISFVKNVHDLNKII

SEQ ID NO: 24280 - protein, 248 aa, Bdellovibrio bacteriovorus HD100
MYKLVLIRHGESVWNQENRFTGWQDVDLSEKGRAEALKGGKALREKGFSFDVAYTSVLKRAIKTLNFVLDEVDQVWLPVHKDWRLNERHYGALQGLNKAETAARHGEEQVKIWRRSYDTPPPPMEVSDPRHPSHDPRYKNVDAQLLPSNESLKDTVARFLPLWDGTIAPAVKSGKNVLIVAHGNSLRALMQHLEGMTPDEIMGVNMPTGIPMMYELDANLKVLKKEFIGDPDEVKAAIEAVANQGKAK

SEQ ID NO: 24281 - protein, 469 aa, Bdellovibrio bacteriovorus HD100
MADTQFDLIIIGSGPGGYVGAIRAAQLGLKTAVIEKDKTYGGTCLNVGCIPSKALLESSEHYQAAQHDLAAHGVKVSKVDLDLPTMQARKDKVVKTNTEGIAFLFKKNKITPFNGMGKIVAAGKVEVKGADGNTQILTAKNIVIATGSVPVELPFLKYDEKRIVSNTGALALDQVPKSMIVVGGGVIGLELGSVWQRLGAKVTVIEYANRLGGTMDQDCMNVLKKSMEKEGMSFLLSTKVTGSKVGNDGVEVTYESLTDGKASSMKADVVLVSTGRKAFSAGVGCEEMGIQKDPQGRIIVDKHYQTNVPGIYAIGDVIAGPMLAHKAEEEGVALAEILAGGAGHVNYDTVPGVIYTHPEIASVGITEEFAKEKGLEINVGKFPFMANGRARAKGYTEGFVKIIADKKTDKILGAHMVGPSVSELIHEVIVCMEFGGSSEDLARSFHAHPTLSEVVREAALAVEKRQRQM

SEQ ID NO: 24282 - protein, 210 aa, Bdellovibrio bacteriovorus HD100
MVAPSILSADFANLEKEIKAVAQAGADWIHVDVMDGRFVPNITIGIPVVKALKKVSPLPLDVHLMIEEPERYVEEFVKAGSDYLTIHVESTKDAAGTLKRIRELGAKPGITLRPRTAVEEVLPLLPLCDLVLVMTVEPGFGGQSFMNDQVAKITRLRQEISSENLSCLIEVDGGINAETAKICHEADVFVAGSYVFGKEYGSAIASLKGS

SEQ ID NO: 24283 - protein, 464 aa, Bdellovibrio bacteriovorus HD100
MIPVILSGGSGTRLWPVSRQQMPKQFCDIFGEPLQTLTLKRCLRMGSPWIVTSKALQTLTELNLKANQGDGANQGEAVKVVYEPVGKNTAPAVAALCKLLLDQGKGDEIVGVFPSDHLITKEDAFLKVVEFASAVAKENRVVTLGITPSYPETGYGYIQTKTTSLKDQAGLKAYSVVKFHEKPDLKKAEEFISQGGFSWNAGIFVFKVSHMASLFEKHQPTLWNQISALKADASNLGDIYAQVQSISIDYAIMEKLSEAELACVPADFGWSDVGSWDAVAALQKGQDIINVKGKDNFVFGEPTKNYSMIGLEDVIVVDTKDALMLVKKGQSQDVRHVVETLTQAKSPLVKEHVYEYRPWGYFEILKDTENFKSKIIRVNPHSQLSYQSHAKREEHWTITQGSGEVVLNDQVIPVKAGSHVHIPLGAKHRMRNNSSEMLEFVEVQLGTYFGEDDIVRYQDDYSRN

SEQ ID NO: 24284 - protein, 211 aa, Bdellovibrio bacteriovorus HD100
MNLILFGAPGAGKGTQSELLIKRQGMTQISTGDLFRAAIKGQTDLGKKAQEFMDKGQLVPDSIVIGMVEEVLQKGVQNFILDGFPRTVAQAQALDELLVKMNLSIGKAIFLEVPMRILMDRLTGRRVCKNCGAVYHIVSKPSKVEGKCDLCGGEVIQRNDDKAEVIETRLKTYEEFTSPLKEFYKKSGKYTEVDGNRDTEEVYKEIEKIIK

SEQ ID NO: 24285 - protein, 507 aa, Bdellovibrio bacteriovorus HD100
MNPIRRALLSVSDKTGLLELAKNLAAQNVELIASGGTAKALTEAGLKVTAVETLSGKGEAFNGRMKTISFEIASSLLFRRQDENDVRQAAELGIEPIDLVVVNLYPFHATLQKQAGFEECIENIDIGGPTLLRAGAKNFHSVTVLCDPSQYSEFLKEFNGNNGSTTWEFRQKCAAAVYTMTAFYDMAIAGFLTQNSGAALRYGENPHQKAVVLKDPFADGLAHAKSLQGKEMSYNNYLDADFALKTLQDVHRWQGEKALPAAVVVKHNTPCGMAVAETPLRALEKAWKGDEKSSFGGIIALNVPVTEDIAAFFAEKFVEVILAPSFTEGAREKLKKNCRVMEVSLKPNPSMQVRSIEGGLLLQDADGFDLSHMKTVTQKQVSPEQQRLAAFAMLAVKNLKSNAIALCRQDGPEFELLTMGSGQTNRIDCIEKLITSRLADKGITDLTGVVLASDAFFPFADSIQVSAKLGVQTIIQPGGSVKDPEVIAEADRLGVSMIFTGRRHFLH

SEQ ID NO: 24286 - protein, 254 aa, Bdellovibrio bacteriovorus HD100
MANESAISLRDVKKSFDGGHEFVLKGINLEIPKGSLTAIIGFSGTGKSVMLKHLLGLFKPTSGTIEVLGTDLSTLNPDQLTKFRCNFGVLFQSAALFDDMTVLENVCFPLFEHRRELKPAQVLRIAEEKLHQVGLESKHYHKLPSQISGGMQKRTGLARALALDPEILIYDEPTTGLDPILTEMVDNLILSTHKLKQGVTSIMVSHDLSAAFRIADHIAMLDSGRVLLFGTPEDFFNTDIELVKKFVNKGMKHQ

SEQ ID NO: 24287 - protein, 178 aa, Bdellovibrio bacteriovorus HD100
MTMTNLSLKPYITEEQIQQKVKELGATLSKKYKNEKVVAICVLKGSFMFYSDLVRNIEADITCEFFGVASYHGGTSSSGEVKVTLDLAGPVENCHVILVEDIVDTGLTMNYLKNAIQSRKPKSLTTVALLEKPDALKVKCDIDHVGFKIANDFVVGYGLDYQGYYRNLPYIAQVQNFQ

SEQ ID NO: 24288 - protein, 1077 aa, Bdellovibrio bacteriovorus HD100
MTRTFFCLVFGLLLLSSCTTKNDLSLFFSSENTPQVTLKLNSGINYTGQSTIPVEIITSQELTEMSLSVSAMCSDVFETYVQQKTVNLPNVEGEHTISVRVKNKDGFTSDCTKAKIVFDKTAPVVSETMTLVNTRSLPDVSPKLNTPVTTDTLSGVAKYELKLVKTAGNTVIKDWTTKDKEALYFDGLTLPDSEVDTYFYMIRATDKVGNVSAEKQSPNFIVGPVVTITGALIYDQDSPMGSATIQLSRASPVSTTVAVKSVSRSAIAGLDFLYPDIIPTEVVIAAGATSADTYFSIMTSTLPGPDKAFDLQVTSTTNAITGSPSSFTVDLVNTNTAITAQAANGYRAVRGAKGHMCGLRTDNKMDCWGAISYANGSTSEQLTAKEVVGATNIVSVAEGYGDHTCYIDSLGDLYCFGNSGYKNLGHNSYTSSTTPIKVPSSNIKKAAVGIYFTCFIDSSDQVQCFGKNDDAELGQPISFSNGIPTVYASITKALDIAAGNKIACAIDEVSGTRSVKCWGKTESASSHVPVTITGLPSDIQSISVNGSITADVRHGCGLSEQGLVYCWGSNFRSRRGLASGAVTWTTANYVGLPVKAVKVQAGTDTSCALGEDKKLYCWGSGLPNATNSHQYQESYVPVQLDNFGDTITDFQLTELASCAVTTSSNIKCWGINSLGEMGNGQTASAMQGTALNVAGSFDKYKQLATGVFTTCALKSNNTVTCWGNNDYGQLGNGSHSTYSRPHYTLPISNVKKVVGQNIHFCALTTGGSVYCWGSNWSGRIGNNATALPTDVVLTPYLIPNTYPNSTAGLPSGIKDISVGYNHSCAVTSEGGVTCWGNNSAGELGHPSIGSAFSYPQMIPSLSTGVDSVALGINATCAVKNNATTKQVYCWGWNRNRVLGPSAVALNASTEVPQLIDTITTTKEVKVFISFETACYIHDGTTKCWGYRSTFKGMPANVPDGTYITTPTAIPELAGATDLHLNPYSGCALMSTGKAKCWGADYSRIFSTGISWIGTPVEPPALQNSQVTAIALGTTYSSAGPIHACAITSLGDLKCWGVSTYGEGHDRFFHQTPQLVLK

SEQ ID NO: 24289 - protein, 248 aa, Bdellovibrio bacteriovorus HD100
MSETRQGVIEVVDFKKSFGSKKVHQGVNFYVRKGECLGLIGGSGAGKSVILRSLVGLEKPDSGQILINGVDITPMKETELIEIRKKVAYAFQGGALFDSMSVYENLAYPLREHFNFSEEEISRQIKETLQEFGLPGSEHLLPGNLSGGMQKRVGLARAMMMHPEVVLYDEPTAGLDPYNTKRIQESILSLKAKGVTSILVTHDMPTVYAVCDKVALLLNGKIGEQYTIEKLKQEPPGAMSQFINGESA

SEQ ID NO: 24290 - protein, 315 aa, Bdellovibrio bacteriovorus HD100
MRSTMEYKPLSGREFPRFSAIKTFFRLPYVTIEADYEVGIFGIPYDGGVSYRPGGRFAPAKVREVSSLGRGFHMTRMENFFENLKVADIGDCPTVPIDQKQTYEKIEKFVGEVLSHNKRFLAVGGDHSTTLPVLRALRKKYGKPLAFIHFDAHLDTYPAAWGQEYHHGAFARHAVEEGLVDPKKMVQIGIRGPLAGGDDLNFVNKHGIRVITVDEIRNQPITEFLKTLPTFDETPTYISYDIDNLDPSCAPGTGTPVPGGLTTYEVQRIFRALKIPNLVGGDVVEISPPFDHADITALAGMDALFEMLHLFPTKK

SEQ ID NO: 24291 - protein, 426 aa, Bdellovibrio bacteriovorus HD100
MHKVTSEELFQRALKVAPGGVHSPVRSFKGLDRAPVFFKKAEGAYLTSVEDKKYIDFCQSFGPLILGHLDAEVKEEVHRMVDTAWTFGATEIYSLELAEWITSTLPFMEKLRFVSSGTEAVMSALRVARAATGRTKILKFEGCYHGHVDNLLVKAGSGLAGTAASSSAGIPAEVAAHTVVAPLDDEAKLAEVFAAQGKDIAAVIIEPLPANYGLLVQRPEFLKKVAELCEKNGSLLIFDEVISGFRVGLGGMVEKTGIRPDLVTYGKIIGGGFPVGCYGGKAELMNMVAPSGDVYQAGTLSANPIGMRAGLTTLKKMQRVDGWNVLEQRTKKFTDAIKAGFVKKGVNLEISQVASLFWIHGPTASPIRSIDHIPANQGGNFKNLFLKALDKGVYLAPNAYEVGFVSLAHSDELLEQAAQIIVDAAE

SEQ ID NO: 24292 - protein, 236 aa, Bdellovibrio bacteriovorus HD100
MKKIAVVTGANRGLGLALSEALAQRGFKVLMAMRNPDKAQKTLNGLTMKGLDVVPMKLDLSQEKSITDFVEVVKREYGFVDVLINNAGILIDSEDGGNSSLFKTKASTLQKTFVTNTLGPFLLTQKIFPLMKQEGYGRIVNVSSGMAQLSEKQTASASYRISKTGLNMVTNLFASEVDGEDICVNSVSPGWVRTDMGGPHADRSVEQGIKGLLWAATLPKGGPNGGFFQDGEAINW

SEQ ID NO: 24293 - protein, 428 aa, Bdellovibrio bacteriovorus HD100
MKALGRHILVEFSGCNAEVLNDVSIIERSMVEAAQIAGATVINSTFHHFSPWGVSGVVVIQESHLAIHTWPEYRYAAVDLFTCGDSVDPWVSFEHLKKAFQANYSALEMNRGSLHVIQKSDFQPKIMREKPSFDLSKGHQIDRNVWFTDKDENQALSLRYTGDVLFDETNPFQRVRVLDSYSHGKFLAINNMVMCTERDEYHYHEMITHPVMQTHGNAKNVLVIGGGDGGTIRELFKYNVDNVTMVEIDEAVVRASKEHLPKIACEFNNPKLNLIIGDGIQFVKDAPANSYDVIIVDGSDPVGPAKGLFTAEFYNNCKNALKDGGLVITQGESPMFHEGTFVELNHCLKGIFGKQSVHTMLFHATTYPSGMWSLQVAVKGSKHPAKDFNKDQAAKFAQDKGLKYYNEDLHTAAFSLPTFVKTMLGDNA

SEQ ID NO: 24294 - protein, 348 aa, Bdellovibrio bacteriovorus HD100
MSHIYDSILETIGNTPIVRLKNVTKGSKHQFFAKIEYFNPGGSIKDRVAVAMIEEAEKRGDLKAGGTIVEATSGNTGVGLALAAAVKGYKCIFVMPEKMSEEKRAILRAYGAKVVITPMVDPEHPLSHYSVSQKIAKETPGAFLTNQYHNPDNPQRHYQTTGPEIWKQMDGKVDVVVGGAGTGGTLSGVAKYLKEMNPNIKAICADPIGSILYDLYYHKKIVDPPGSYKVEGVGEDMLPDNVHLNIYDGFERVSDPEAFTMTRRLVAEEGLLVGPSSALALVGAMKAAEKIEKPSNIVVVFPDSGRAYLSKAFNDTWMIENALLKPEEAKNVFNRVVNAADFLAELNK

SEQ ID NO: 24295 - protein, 243 aa, Bdellovibrio bacteriovorus HD100
MIEFKNLVKRFGTRTVLNGLNLKIREGEIIFILGTSGTGKSVLLKNIVGLLTPDEGEIWIDEEEVSKFSEEQYLPIRKKCGMVFQHPALFDSLTIYENVAFGLRRHYQLSEEVIQAKVSKALRLVNLHGVEQKRPGQISYGMQKRVSLARTVALEPRILLFDEPTTGLDPVTTTAVNQLILDLSRELKTTSLVVSHDMNCALSIADRIVVLDKGNIVALGTPDELKKSDQPLVKDFLAEVLEA

SEQ ID NO: 24296 - protein, 252 aa, Bdellovibrio bacteriovorus HD100
MSIISLKDVTVAFEDLVVLKSINLEIQAGESFVIVGPSGQGKTTLLKTMSGLVSPRNGKVFVEQKDWSTLSSKERLPLLKKVGILFQKNALFDSLTCVQNISFPLRETTALSDWEITKKAEYFLDAVGIPHARDLYPDEISGGMQKRLGIARALALDPEIIFYDDPTAGLDPITSRKIIDLIMTLKKEKGSTVVAITNDMNRAFQMADRIGMVVDQELLITGTPDETKNHTDPRVHQFIRGLLAGPLTTANV

SEQ ID NO: 24297 - protein, 494 aa, Treponema denticola ATCC 35405
METLKYVKKEPYQLFIDGKYIPSENGSIVDVINPVNNLPFAKAYRGTKTDCEKAIAAARKAFDEGPYRKMSAKDRSKLLLKAAQILERRAEELAVIETLECGKNYSACRYWEVPMAIDSFEFFAGKARCLDGKVVPSEYGTLNYVTWNPCGVVGEILPWNGPFLMGCQKVNAILAAGNTVVIKPPSWGVLSMILMASIYEEAGFPSGVVNVVTGSGAEVGNCLVESELVDMVSMTGGVETGREIIAHSAKLVKDIALELGGKSPNIFFEDVDIEQAARFAVYGFTNHAGQICVSGTRILVQRRIYEPFIKAMVETAYKLKPGDGFDPSTTINTLISREHANTVWEYIEKGKKQNARLVCGGNPYSEPLLKKGNFIPPTIFADVTPEMEIFQNEIFGPVACITPFDTEEEAISLANATKYGLAGGVFTKDIKRAIRVADRINSGQIYINNYFSKGMIESPGTGWKESGIGIAGIHKYMISKTVFVETVDNVLLPI

SEQ ID NO: 24298 - protein, 444 aa, Treponema denticola ATCC 35405
MSKIVVVGANHAGTSAINFLTELSKENEVVVFDRNTNISFLGCGMALWIGNQIRGSEGLFYSNKEKLEAKGAKVTMEADITRIDFDKKIVYGTVKGSQPIEESYDKLILATGSIPIMPKIKGMDLENVQQVKIFQNAQEVIDKLKNPDIKKIAVVGAGYIGVELAEAFKRHNKEVVLIDAMPSSLSNYYDKPFTDLMDKNLNDHGIKLAYNQLVQEIKGTTKVEAVVTDKGEYPADMVVVCIGFRPNTDLGKDKLETFKNGAYSVNLKQETSIKDVYAIGDCATVFDNSLGEKSYIALATNAVRSGIIAAHNAAGIPLEGIGVQGSNGINIYDLKMVSSGLTVERAKKLGLDVEFTDFEDLQRPEFMEHDNPPVKLRIVYNKKTRVIIGAQMASTYDMSMGIHMFSLAIQEKLTIDKLKLLDIFFLPHFNKPYNYITMAALGAK

SEQ ID NO: 24299 - protein, 478 aa, Treponema denticola ATCC 35405
MIDNALFSDFYELTMAQGFWKKGNNTKTVFEMFFRSNPFKGGYSVFAGLEPLLKTIQNFHFEKSDIDWLKSLGIFEKDFLEYIAGFKFSGNIWAMKEGSLVFPNEPLIRIEADTVEALLLEGLILNMINFQTLIATKTARIWLASKKGSIMEFGLRRAQGNDGAMSATRAAYIGGAFGTSNSLAAKELGIPALGTMAHSWIMSFKSEEDAFQAYADMYPDNSIFLIDTYDTLRSGIVNAIKVGKRLQEKGKNFGVRLDSGDIYYLSKDVRKRLDEAGCTKAKISVSNELTEEIVESLVQNNAPIDSWGVGTHMVTGGNEASLTGVYKMAARKSLGEAEWTPVMKFSDNPAKMTNPACKQVWRLYNPDGTFKADVLTLEDEKIEEGVEQTFYHPANDYQNFTFTPTKIEALLEKRIENGKAVGKAPSLKEIKAYAEKQLDSLDYTSKRLLNPHIYKVSLSEKMRDLKQQLIKNKPVFKN

SEQ ID NO: 24300 - protein, 503 aa, Treponema denticola ATCC 35405
MENINKECHKHVTHEDLSDRAKQLWADLKGKTLTPKERAQIPIQEMPTLDPHKRASLMNEVAMGYTDEQARIEAERCLNCKNKPCVKGCPVGIPIPEFIAEIQKGDYKKAVDIIKTTNLLPAICGRVCPQEKQCQAFCTVGKMLKSTEQAVAIGRLERFVADWERNNNKITIPPVAPETGKKVAIIGSGPAGLTVAADVRREGHSVTVFEAFHKTGGVMVYGIPEFRLPKEIVAKEVENLEKMGVEFKTNFLVGRTETLEQLLKEDGYDAAFIGTGAGLPKFMGIEGENLIGVFSANEYLTRANLMKAYDAEHSDTPLYEAETLAVIGGGNVAMDAARMGYRLGCKKVYCIYRRTRAEMPARIEEVAHAEEEGVEFCFLQNPTRIIGDKEGKVCAIEVLDYELGEPDESGRRKPVAKPGTEHQIKVDAVIVALGNDSNPLMAQTSHGLEVTKKGNIVVDENQKTSIEGVWAGGDIVLGAATVILAMGEGRKAAAAINEYLKTK

SEQ ID NO: 24301 - protein, 426 aa, Treponema denticola ATCC 35405
MENKGKLGLLSICLLGVNAIVGTGIFLLPGKAAKLVGVSSIGVILFDAVLVILIALCFAEAGGLFKKNGGPYVYAKEAFGEFVGFEVGFMKWAIMVIAWAAMAVGFPTALGSVFPLAATPFWRSVIAVAILLFLGLMNIAGVRISKIVNNVITIGKLVPLIFFILLGIFFIKGDNFQPMQSVGALTTTSFGAAALLIFYAFTGFESIAVAAEDMDKPEKNVPLAIVLVISGVSVFYILIQVVAIGILGDGLTASEAPVADAAAKFLGPVAKAVVTTGTLVSIGGINVASSFLAPRSAVALADDGFLPKFVTKRNKKDVPYISVILTTALTALVCLTGSFSKLAAISVVSRFAQYIPTCLAILVFRKRGMKGSFRIPGVYVVSFLAVGISLWLLYNSSWDKILFGLGGLVVGAVFYVIMKLTQKKAN

SEQ ID NO: 24302 - protein, 335 aa, Treponema denticola ATCC 35405
MSLLFSSFKIKNIELNTKLVMPPMASEKADAGGIVSQALCDYYDEKTKGSYIGLVIIEHSYVSPQGKASAGQLSISDDSTIEGFKKLASVLHKNGAKVIAQISHAGAAARHKITGYDVLSSSSVMIPRKAPDYELPRAMTQEDIDKVINDFVQAARRAKEAGLDGVEIHSAHGYLLNQFFSPIMNKRTDKYNGSSIEGRTRLHIEIIEAIRKMTGLDFLIAVRLGACDYISGGSSLEDSVEACLLFKKAGVDLLDISGGFCGYTNPELEEEGWFSRITQAVKEKVGAPVILTGGIVSPEAAEKILQEEKADLIGVGRALLNDSDWPKKAKQKLEG

SEQ ID NO: 24303 - protein, 448 aa, Treponema denticola ATCC 35405
MKNLTQGDELKQITLFSLPMLLGNIFQQLYNVVDSIVVGKSIGDHALAAVGISFPVWFIFISLVIGFTMACNILIAQFVGAKKEEEISKVIQTSILILFWAGLIATAIGFVFAPYILKIMNTPSDVFEEALIYLRLIFTGIIFLFIYNAFTAMLRGFGDSMTPLYALIISTIINIGLDCLFVIVFKWGIAGAAIATIIAQFISCFWLIFYCRIKYKDFRVNFFKLKFDKTICIQSVKMGFPSGIQQALVGGGFMALLSIVNTFGTQTAAAYSAAGKLDGFIVMPALNIGVALSSFTGQNIGAGRLDRVKKGLRASLFLGLGITITATTAIVIFGKAVMFLFVNNPEVIELGARYLIIVAPAYFFNTITFTLNGVIRGAGETVFPMISTLLAMWVFRVPAAAVLSRYLGSDGIWLAVSVGSAAGFLLTLFYYCSGKWKKKTAEILNLKK

SEQ ID NO: 24304 - protein, 433 aa, Treponema denticola ATCC 35405
MSDIIYIEGREILDSRGNPTVEVEVQLSDFSYGRACVPSGASTGEYEALEMRDGDKSRYMGKGVLKAVDQVNTVIAEELDGADALDQAEIDNMLINLDGTENKSKLGANAMLGVSMAVARAAADSLGLPLYRYLGGVHAMQMPVPMANIINGGRHSDNKIDFQEYMIMPVGAPSIREGIRMTAEVFHALKDILKKEGHVTAVGDEGGFAPNIENVQALDYIMKAIEKAGYKPGKDVVIALDCASSELFDAGDRKGYKFWKSEPSKILNADEMVDLFKDWISKYPIVSIEDPLDQNDWEGYAKMTKELGNQIQIVGDDFFVTNTKRLARGIEEGACNSILIKLNQIGTVTETIDAVRMAQKAGYTAVISHRSGETEDAFIADLAVALETGQIKTGSMSRSDRIAKYNQLMRIEDELGYNARYAGMATFANLIKK

SEQ ID NO: 24305 - protein, 209 aa, Treponema denticola ATCC 35405
MNCIFLGPPGAGKGTLAFEVSKSYKIPHISTGDLFRAAIKEQTDLGKKVKAVIDSGALVSDDLTIALVKERLERDDTKKGFILDGFPRTIAQADALEDIVKIDSVINFDISDDEVIKRLSGRRVCSSCGQSFHIEFVKPKKEGICDSCSGDLMIRPDDKIEAIQKRLETYRNQTAPLIDYYTKKDLIVNIDARPASEKVLASFKVKFPH

SEQ ID NO: 24306 - protein, 250 aa, Treponema denticola ATCC 35405
MKKFYIAANWKMNMNRAEAKQLATEMKAGLKDGKNKYMIAPSFTLLQDVASVLKGSNILLGAQNMGLEEKGAHTGEVSVLQLLDVGVQAVILGHSERRHIYKETDDLINKKVKLALKHGLEVILCVGELLEEREAGHAEAVCERQIKKGLAEVSAKDLDKVTIAYEPVWAIGTGKNASPEDADAIHSSIRKTLAALYGEKAAKNMIIQYGGSMKPENAAGLLKKHNIDGGLIGGAGLKTETFLPIALFSE

SEQ ID NO: 24307 - protein, 434 aa, Treponema denticola ATCC 35405
MERFFRLKEHNTTVRTEVIAGITTFLAMAYILAVNPGILSEAGMDRGAVFTATALSAAIATLAMGLLANLPVALASGMGLNAFFTYSVVIGLGYSPSTALTAVFLEGVLFILLSLVNVREAIVKSIPLNLKKAVAAGIGIFITFIAFQNSGIIVDNPATLVGLGKFTWGSPAVLAMIGLIITCALFILRVPGAILIGILITTIIGIPLKITVPFGGWEGWSPISLPSAPAVLNFDFSNILSFKFFIVFFSFLFVDIFDTVGTLVGVATQANLVDKDGNIPKIKQAFLSDAIGTVVGAALGTSTVTSYVESTAGVAAGGRTGLTSVVTAGMFIIALLFSPIFLLIPSAATAPALIIVGFLMMTQAGEINYKDPTEGIPAFLTMIMMPFTYSVAEGIVYGVLAYVILKCIKGKFKEIPVVTWILFVIFMLRFFVKF

SEQ ID NO: 24308 - protein, 496 aa, Treponema denticola ATCC 35405
MQNVFYSLRELDKRAEEDFNLKNGILMENAARGSAEKIKNLFPLKKRDEKKTLQIVCGSGDNGGDGLALARILADDFNIHVIILKEPKSELCKLQYERLKALNIRTAKNILPESDILFDAFLGTGLKGLLKAEDKKTIEKINKVKAFKIACDIPSGLNLDGEASPNAVLCNMTFSMGALKQAFYSDEAKDITGKIEVIDLGLPRSLYEQNEKSNVFLLEKEDMLLPSRKKQNTHKGSFGHAGIIVGEKNGAALLAASAALEFGAGLVTLIGENRERPKNLKADFMYDGKFEAGKFNVKKFTSIAIGQGLGRKNDGLFSILKVKETQSMPMVIDADIFYYAELKKILPELSAAVLTPHPKEFSSLLNIAGFGSLSIEEIQKKRFILALSFSKKFPKLVLVLKGANTLIAHNGKICINTLGSPSLSKAGSGDVLTGLICSLLAQGYKPLDAAITGSLAHSLASQNSRASYSLTASKLIKNLEKLEAEQFKESKARQVK

SEQ ID NO: 24309 - protein, 322 aa, Treponema denticola ATCC 35405
MSEKLNLVILDGFTSNPGDLSWDELKSVSNLTIYDKTSAEELLERCKEADAVLTNKVVFSKEIMDSLPRLKYIGVLATGYNVVDIEAARAKNICVTNIPSYSTDSVAQLVFALIFHFYWHVKEHSDEVMGGKWSASPHFCYHSFDIRELSDKTMGIVGFGNIGQAVAKIALAMNMKVIYFNRSKKNIKGLEEAKQVSLDELFSSSDIISLNCPLTPETKEIINAESLKKIKKTSIVINTGRGPLINEKDAAEALKEKRLAGLACDVLSVEPPAKDNPLLKAPNCIITPHMAWQTFEARERLIKTAAANAKAFIAGKEINRIN

SEQ ID NO: 24310 - protein, 453 aa, Treponema denticola ATCC 35405
MYDLIVLGGGPGGYVAAIKAGRAGLKTALIEKNRLGGTCLNKGCIPTKYLLHTAEVFGSFAENDLGLSGENLKYDIKAIYEKKNAVVDKLVGGIEKLIENAGVDFYNGEGKITSKSSVSVNGKELEFKNLIIATGSSVFAPPIAGIETAMTSDDILGKEPVDFKSVIIIGGGVIGIEFATVYANLGKEVTIVELEKTILPPFDRDIAMQQAIVLKKRGVKIINGAMVTKIEKTGCTFTLKEKEESITADAVIVCIGRIAEIKDIGLDSAGIEYDKRGIITDACMKTNVEGIYAIGDAVKGNVMLAHNAENQGHLVVENIVNNTKHEKQDVIPSCVYSTPEIAGVGLSEKEAEAKGITVKIGKVPMGSNGKSVLSGLDVGFIKVLFNEEDRIVGCQMMCDSATDMIGAIGTLVTNKAKRENILKSMYPHPTVVEAFYEAVEDVEKSATHMIYKK

SEQ ID NO: 24311 - protein, 247 aa, Treponema denticola ATCC 35405
MRLVLVRHGESEWNKLNLFTGWTDVDLSEKGVEEAKEGGTYLKKEGFDFDICYTSYLKRAIHTLNYILSQMDREWLPVIKTWKLNERHYGGLQGLNKAETAEKYGEDQVKIWRRSFDIAPPVLEEGDKRCPYLQEQYRGIEKSELPLTESLKDTIARAVPFFEKTIKPQMLEGKRILITAHGNSLRALVKYFENLSDEEIISVNIPTGVPLVYEFDKNFKVLSKRYLGDQEKINAKINAVANQGKKK

SEQ ID NO: 24312 - protein, 419 aa, Treponema denticola ATCC 35405
MIKTVKDVNLKDKRIIMRVDFNVPMKDGVVQDDTRIRAALPTIKYILEQGARSLVLMSHLGDPSKDAKKAKEKAEKDGKPFDEEAYINGKHRMKPVAEYLSGLLKLPVDFAPSCMGQLERVKALPQGGILMLENTRFHKEETSKEKAEQQILAKELSLYGDIYVNDAFGTAHRSHASTAEIANFVNTRVAGFLMEKEIKYLEPMLNNPAKPMTAIIGGAKVSSKIAVLESLLKNASSLIIGGGMAYTFLKVQGKKIGKSLFEEDFMDTAKNLLDKAEKQGVKIILPVDHICSETFSPNAEAVLVESTDIPDNLMGMDVGPKTLALYKEIILSSKSIVWNGPVGVFEFEAFSKGTEETARLVAAATEKGALTIVGGGDSVAAVNKFNLADKMSHVSTGGGASLEFLEGKVLPGIACLDTI

SEQ ID NO: 24313 - protein, 155 aa, Treponema denticola ATCC 35405
  misc_feature (35)..(35): Xaa can be any naturally occurring amino acid
MGIYNYTVKDSLGNDFSFNDYKDYVILIVNTACEXGLTPHFQGLEALYKEYRDKKFLVAAFPCNQFGGQDPGTNEEIRNFAQSKYGVSFPIMAKIEVNGENTEPIFSFLKKASNGEDIKWNFAKFLVDKTGERVTAYAPTVAPEDLKKDIEKLLN

SEQ ID NO: 24314 - protein, 427 aa, Treponema denticola ATCC 35405
MFKLKENFLLGVATASTQIEGGRVNSNWNDFCDRKMTNDGSDVARANMHYEKVEKDTELLKKMGIQTYRMSLEWARIEPEKGKFDTKAIDHYKEELSLLKKAGIRPLISLYHFSHPMWFENSGGFTKKENVEVFLNYVKTCISELGNLCSDYVTINEPNVYAVQSFFLGLWPPEKKSIAKTLKVMNVLIAAHCKAYDLIHEIRKEKGLTDTRVSFAHHMQAFHPKDKNRKADQRAAKRISKIFQDGIMEACFKGEFSFPFKNILNIKKKNYVDFIAINYYSRQAVRGLSYKAFENTPKNDLGWDIYPLGLIECAQTCYNCLPLPIVISENGTCDNKDEFRCRYIYDHLKLISESPLPFEAYYHWCFIDNFEWKEGEAARFGLVHCNYETQERTIKKSGEFYSEMIKKRGVDKSMMEKYIEPCKYNVR

SEQ ID NO: 24315 - protein, 457 aa, Treponema denticola ATCC 35405
MNQDIETIVKNCRIFFETNKTKSYEFRISQLLKLQEVLNQNKKELLNALYSDLHKTEMEGFFSEFAIVRGELKFAIKHLKKWIKPKRVPTSIAHFKSSSKIMYEPFGTVLIMSPWNYPLNLTLAPLVGAIAAGNCAVVKPSNYSPATSEVIKKIISENFPPEYISVITGGREENSKLLEQRFDYIFFTGGTTVGKLVMEAAAKYVTPVTLELGGKSPCVVEKSANLKVAARRIAFGKYLNAGQTCVAPDYILIQDEVKEKFIEELKEALKEFFPTETYLDMHLPHIVNEKHFDRLMGLIEGEKIITGGKGEKGRKFIEPTVLDNITFDSKIMQEEIFGPILPVISFKTIEEAIKLIKSREKPLASYLFTTDSNIEKKFLNEVSFGGGCINDTIVHLASDYLPFGGVGFSGIGKYHGDESFKVFSNAKSILKKSNLIDIKLRYHPYSEKKLNIINKMM

SEQ ID NO: 24316 - protein, 462 aa, Treponema denticola ATCC 35405
MAKKKTGDLAHRCNKCGYTQARWLGRCPECGEWNTFEEVTINQDYSAAERSIAEKFVKEAHSVPLDAIEANDAVRLSTGIAEFDRVLGGGAVKRSAILIGGEPGIGKSTLLLQAASASSSGSVKKVLYVSGEESGGQIRSRADRLNLPLKNIELLCTCRLEDVERVLNKVNPVFVIIDSIQTMYSADAGTIPGTINQLKLCAHELVSWVKERDSVLFLTAHVTKDGNIAGPKVLEHLVDTVISFERTEDDVRFLRALKNRFGSVDELGIFSMDESGLKAIDDSSSLFITNRTGPLPAGSAAVPVCEGSRVFMVEIQALTVPAKGVVTRVFSDKIDSARVSRIAAVLEKRIGLQFSDQDIYVNVAGGIRLKEPAADLAIALALYSARANIPAQKEGAYIGELSLAGEIRSVKKLKQRIKTAQSMGFTKVVSPPPSDSEAGDINTSQLFKAEDLSSAIKKVFGG

SEQ ID NO: 24317 - protein, 471 aa, Treponema denticola ATCC 35405
MKKTKIVCTIGPASDSERVLAEMFKAGLNVCRLNFSHGSHEEHKVKIDRIKKIREELKMPIALLLDTKGPEIRLGLFEKPVEIVQGQEFIITTRDVIGTNQICSISYKNIAAEIKPKSRILINDGLLELQVIDILNDTDIECVAVNSGTLSSRKGVNIPGLRVNLPYMSEKDISDIEFGIENDVDFIAASFTQRADDIIQIRKLLEKHKSTIAVIAKIENQEGLDNIDEILAEADGIMVARGDMGVEIEPEKIPHLQKQLIKKANLAGKPVITATQMLESMTHNLRPTRAEVTDVANAILDGTSAVMLSGETAAGEYPVETVAMMTSIANSIEETLDYEKLFAENASLHETTITNAIARATCSTALALDANAIITASASGITPRALSKFKPRVPIIAITESPQVMRKMALDWDVYPVLADPIKSTDNMFDVCSQIAKDTGHVKKGDIAILTAGIPIGKAGSTNLLKVEIIE

SEQ ID NO: 24318 - protein, 209 aa, Treponema denticola ATCC 35405
MDRCFKLSPSLLSADFSKLGEELAFIEKHGGDWVHIDVMDGQFVPNLTFGAPVVKSIRPCSKLVFDVHLMVNNPENLVSAFADAGADYFTFHAEASIHADRLIADIRSHGMKAGVSIVPSTPVGILEEIAPLADLILVMSVNPGFGGQKLIPYCLEKVKRLRSLREEKNYNYLISVDGGIDSKNVGSVIDAGADVIVSGSAFFSGDLRI

SEQ ID NO: 24319 - protein, 504 aa, Treponema denticola ATCC 35405
MAFFYDEPSHTFSEYLLVPRLSGVEHIPQAVSLKTPLTKYKKGEEPKISLNIPLVSSIMQSVSDHNMAVALAREGGLSFIFGSQSIESEAKMVTKVKNYRAGFVESDSNLTPEHHLSDVLDLKDRTDHTTVAVTHDGTGHGKLLGVVTGRDYRIGHTDLNTKVKEFMTPIERLHVAEEGISLKKAQDIIWEFKLNSLPILDKKGCLVAFVFRKDYESNTENPLELLDEKKRYMVGAGINTRDYEERVPALVEAGADVLCIDSSDGFSDWQKQTIQFVKEKYGDSIPIGAGNVVDADGFNFLADAGADFIKVGIGGGSICITRETKGIGRGQATALIEVAKARDEYFKKKGVYIPICSDGGIVFDYHITLALAMGSDFCMLGRYFARFDESPTNKVLINGNYMKEYWGEGSARARNWQRYDSGGEKKLSFEEGVDSYVPYAGKLHDNVAVTLNKIRSTMCNCGVLSIPEFQRDAKITLVSSASIIEGGPHDVVLKDMSHSSSSNY

SEQ ID NO: 24320 - protein, 512 aa, Nicotiana attenuata
MDGSTVQGGSSVESFLRNYKLGKTLGIGSFGKVKIAEHTLTGHKVAVKILNRRKIKNMDMEEKVRREIKILRLFMHPHIIRLYEVVETPSDIYVVMEYVKSGELFDYIVEKGRLQEDEARKFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMYTLPSHLSAGARDLIPRMLIVDPMKRMTIPEIRMHPWFQAHLPRYLAVPPPDTMQQAKKIDEDILQEVVKRGFDRNSLVASLCNRVQNEGTVAYYLLLDNRFRASSGYMGAEFQETMEYGYHQINSSEAVASPVGQHLPGIMDFQQVGARQFPVERKWALGLQSRAHPREIMTEVLKALQGLNVRWKKIGPYNMKCQWVPGVPGHHEGMSNNSIHNPFFGDDSTIIENGGVTIPNAVKFEVQLYKTREEKYLLDLQRVQGPQFLFLDLCAAFLAQLRVL

SEQ ID NO: 24321 - protein, 450 aa, Triticum aestivum
MSTCAASLAPLLGTAAANATDYLCNQFADTTTAIDSTYLLFSAYLVFAMQLGFAMLCAGSVRAKNTMNIMLTNVLDAAAGALFYYLFGFAFAFGTPSNGFIGKHFFGLRDVPQVGFDYSFFLFQWAFAIAAAGITSGSIAERTQFVAYLIYSAFLTGFVYPVVSHWIWSADGWASASRTSGPLLFNSGVIDFAGSGVVHMVGGVAGLWGALIEGPRIGRFDHAGRAVALRGHSASLVVLGTFLLWFGWYGFNPGSFLTILKSYGPPGSIHGQWSAVGRAAVTTTLAGSTAALTTLFGKRLQTGHWNVLDVCNGLLGGFAAVTAGCSVVDPWAAIICGFVSAWVLIGLNKLAARFKFDDPLEAAQLHGGCGAWGVIFTALFARREYVEQIYGAPGRPYGLFMGGGGRLLGAHVVLILVIAAWVSCTMGPLFLALNKLGLLRISAEDQMAGM

SEQ ID NO: 24322 - protein, 258 aa, Triticum aestivum
MSATCAADLAPLLGAAAMNATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAIAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGTSCSGSAGTVQPGSFVT

SEQ ID NO: 24323 - protein, 248 aa, Saccharomyces cerevisiae
GAQRPRGPQRGKDIKHEISASLEELYKGRTAKLALNKQILCKECEGRGGKKGAVKKCTSCNGQGIKFVTRQMGPMIQRFQTECDVCHGTGDIIDPKDRCKSCNGKKVENERKILEVHVEPGMKDGQRIVFKGEADQAPDVIPGDVVFIVSERPHKSFKRDGDDLVYEAEIDLLTAIAGGEFALEHVSGDWLKVGIVPGEVIAPGMRKVIEGKGMPIPKYGGYGNLIIKFTIKDPENHFTSEENLKKLE

SEQ ID NO: 24324 - protein, 224 aa, Escherichia coli
  misc_feature (35)..(35): Xaa can be any naturally occurring amino acid
  misc_feature (92)..(92): Xaa can be any naturally occurring amino acid
AEAAKPATAADSKAAFKNDDQKSAYALGASLGRYXENSLKEQEKLGIKLDKDQLIAGVQDAFADKSKLSDQEIEQTLQAFEARVKSSAQAKXEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVK

SEQ ID NO: 24325 - protein, 245 aa, Escherichia coli
AEAAKPATAADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 24326 - protein, 369 aa, Escherichia coli K12
SYYHHHHHHLESTSLYKKAGLKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 24327 - protein, 148 aa, Gibberella zeae PH-1
MARYASAKKRAADSDDEPEIATKRVKNATSVESDGKDDDGNPFWELSNKRRVGVSDFSSKTFVNIREYYEKDGKTLPGKKGISLSIEQYNAFLKAVPRINAALRAKGLVVEGDTEELDTAMEMVPTKVKRERKKSPKANIETTSEEED

SEQ ID NO: 24328 - protein, 349 aa, Gibberella zeae PH-1
MDVVLEVVDTFIADYAYAYFYPKRLAPYDFPSPSNTTDTSAKAFSTWIYKPATQFITLEPPEQAYMSSWDRDNPLRQALTLYLITWIFGLLVYFIVATLSYIFIFDKRTFEHPRFIKNQVRMEIIAANKAMPVMAIITAPFFLLEVQGYGKLYDTTEDGPGLWYDFFQFPLFLLFTDFCIYWAHRWLHHRLVYKYLHKLHHKWIMPTPFASHAFHPLDGFTQSLPYHIFPFIFPLQKMAYVALFVFVNLWSVMIHDGEYLTNNPVVNGAACHSLHHSRFEVNYGQFFTAFDRMGGTYRMPEQWMFERDMKMSEGRWKKEIEKVDELIEEIEGSDNRTYTDSAPIMKKTQ

SEQ ID NO: 24329 - protein, 335 aa, Gibberella zeae PH-1
MTDYIKAVDIRGGTGERDALFINDKTPKPSAAEGQAIVKIKAFGINRMDIIQRRGFYPLPPQAPKTLGVEFSGIIESFGPGDHGAFTEGDEVFGLAYGGAYAEYIAVSTRMLLHKPSSIDFTTCAGVPEAWITATQALHLVLGFTKGKSILWHAGASGVSVAGIQLSRVAGASAVYATAGSQDKLDFITSKLGATAAFNYKTQDWAEEIKKATGGKGVDYIVDFVGGNYFQKNLDVAARDGRMVLLGTLSGAKVPDADISQILFKRLRIEGSTLRSRDEEYQGELRDRLEKYIPEFESGNLKIFVDEVFPWEQIQEAHKHMEDAKNLGKIICTIS

SEQ ID NO: 24330 - protein, 380 aa, Gibberella zeae PH-1
MDSAARQQPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYFESDAADLVRATLSAVAYLHDHGIVHRDLKPENLLFRTPEDNADLLIADFGLSRIMDEEQFHVLTTTCGTPGYMAPEIFKKTGHGKPVDLWALGVITYFLLCGYTPFDRDSDFEEMQAILNADYSFTPIEYWRGVSAHAKDFIQRCLTIDSTKRITAHEALQHPFVAGFINAEGESQNLLPNIKKNFNARRTLHAAIDTVRAINKLREAQSGLMDGARSKEPSRGAAQQTPTNRKHPTSHPRCNPATTEIELSKLPKVSGAQRRAVRIR

SEQ ID NO: 24331 - protein, 329 aa, Gibberella zeae PH-1
MSPHSASTTVNELVNEYADIIKGKVILTTGVTLNSLGGLFIQETASKSPELLILAGRNASKLQELAEAIAKGYPSVKTRNLVVDLSSLASVRKAAEGVNSWEDVPVIDVLVNNAGIMAVPYAKSVDGFESQFAICHLSHFLLTNLIMDKILASKSPRIVNISSNVHSLGPVRFADPHFSNGETYNEWSAYGQAKTSNALFSISLAQKLGGRGLQSYSVHPGLILTTGLGTHLDFASMEGDLGAIIKAHRERGNTEGWKFLDPVPVEVGAATHAFAAFDPNLRANNGAYLLETRVSDPFVDTYKSWARDPVDAEKLWRLSEELVGQKFGY

SEQ ID NO: 24332 - protein, 324 aa, Gibberella zeae PH-1
MAPFTPRGGARGGRGGARGGGRGGFGGDRGGFGGGRGGARGGRGGGRGGFGDRGGRGGRGGRGGAPRGGRGGATGAKGGAKVIVEPHRHPGVFVVRGGKEDGLATRNTTPGESVYGEKRISVDEVVKNDDGTTTTTKIEYRMWNPFRSKLCAAIAGGADEIYIKPGSRVLYLGGASGTSVSHVADIVGPTGYVYAVEFSSRSGRDLITMASKRPNVVPIVEDARQPARYRMIVPMVDVIFADVAQPDQARIVAMNANWFLKVNGGVLISIKANCIDSTAPAAEVFAAEVQKMRAESIKPKFQLTLEPFERDHCLVAGEYLRYKS

SEQ ID NO: 24333 - protein, 211 aa, Gibberella zeae PH-1
MDGTFEIQWSVCHESCNHASLLLRWPSSPYTLILLPDLSTNKKSQGDQRLPHNSGKPVSVDDLMNIGVYYYHLPELEQVDNLSKEREYKNRDEITVSPQAMGDIYETKVKSFFAEHLHEDEEIRYILGGRGYFDVRSKDDDWVRVLLEKNDLLILPPGIYHRFTTDESNFVHAMRLFKEDPKWTPLNRGPDVDKNEHRQEYVKQFIGESTE

SEQ ID NO: 24334 - protein, 497 aa, Gibberella zeae PH-1
MELQGQSLILTVSVLTSLGFMLIGYDNGLMGGLVNTTAFKDTFNDPNADMIGVIVAIFEVGCFFGAIFTSIWGERLGRRCSILIGCIVLMIGAILQAASYSRAMMIVGRVVSGVGLGTINSTVPVLQAEFSPKSSRGIYVCAQLSTLNFGIFLVYWIDYALSSHHGSYAWRVPVILQCVPIFVMICLLKFIPETPRWLAAHDRPEECLQILARIHGTSVDDPDVRLLHSVITQTVAYETSIGSGSWKDLLKEDSIKSRKRLLLSCTLQSFQQLGGINAIIYYSTTLFEKSIGFSAHMSSLMSGFLQTWFFIASFIPWFLIDRIGRRPLLLSMTTVMAATMAVQAGLIYQVQNNTASAHASGIAAAAMLFIFQAAFTIGFQATVWVYPSEILPLRLRQRGSSISTASNWIFNYMIVQITPVSISNIGWRTYIIFAVLNAFFVPVIFLFFPETKGLELEDVDQLFGGEDIAKVLDNKGDGTVVTVESVNQDGARCASNR

SEQ ID NO: 24335 - protein, 340 aa, Gibberella zeae PH-1
MARVYADVNQSMPRSYWDYDSVNISWGVLENYEVVRKIGRGKYSEVFEGINVVNYQKCVVKVLKPVKKKKIKREIKILQNLAGGPNVVALLDVVRDSQSKTPSLIFEHVNNTDFRSLYPKFNDIDVRFYIFELLKALDFCHSKGIMHRDVKPHNVMIDHENRKLRLIDWGLAEFYHPGTEYNVRVASRYFKGPELLVDFQEYDYSLDMWSLGAMFASMIFRKEPFFHGNSNSDQLVKIAKVLGTDDLFDYIDKYEIELDAQYDDILGRFQKKPWHSFVTSENQRFVSNEAIDFLDKLLRYDHQERLTAKEAQAHPYFNPVRDPEVFKQHLAAASGAANKS

SEQ ID NO: 24336 - protein, 1341 aa, Gibberella zeae PH-1
MTESSPRAVRFQGSEDDGRPDKVRGHRLETPIESNGDPHATERHDELGNLIGYGATGHTGSLTSLAPGTVINGVSKAQRGPNTGDDGTAYTPNGSWPQRPLGPARTPSNTYNPATSRKPAHPPATPSFTESIRSSSKTRPRNESRFRAQERAYVQKLRQDYSGGYFTSYSNLNGNDSDSEGETPSSEGPYDDRFDQETIMFYGNDTLQPTDEDLKDPENRERLEWHGMLEAVLTGDVVRQEKKRLIGSADQQAGKSAHKTELWLGIRSKVCGRHIPVQRRMLEESRSTLDRTLDEIINFQIKGESEAGKPPYEQVKDMVAKIQMCENLYPSWAALATEHKAADSATFKESHDAIISWYNTNEMINTELNILKKWVGNEELDFTRTKQRSPAVNGINNDETSFLDRLMKEDGLQSLYNDDNGNLEKGMLAPISTVISKAKDTLIRNSEAFRKRHLPPYLEELLTLISFPSRLIEEITRLRLAYARRVKESAQQNPLMQDQMISQFQLLLKFAIRIKIECTSIANPEPGWDLPPCIDESFDQVVLEALKYYFKMLNWKLSGNKNTFKEAELLFQEWDFANEIGSHLQRGHIEVAEQFSSLTFKALHRLSQTFEKELQAKPKETATEMSKRYKACLDSVRVRQRMLQRFTRMLNDNYEHASDYSISFPPETMQKFYDQLVASGHFQVDTRLLEQDNIYVIASPELRERLEDIQAMMAITSKDQFPDELGEQYLLILRPEDPLNWFGETIEVPLRDLNIDLKRGHIRLCASSPQTLHNARRAFIENVDMHVDLVQEARSNIQKVNSRLTEIRRVAYKLSNNFMDSVEIIRKQARGKDCQELIQTCFVFATEFGQRSLLYMDSNRRQMNNLKLTKLALDWVSFICDDCVASDRKTFRWAVLALELAMGMTRGRHILALGEGEYAKLRSKVAGCMSLLISHFDVMGARSNLAAQAEKERIEALVGQFRKLDKNRMMNDEEASRCVTEQRMSELERVDEYRCEKIAERQGVGRVLEGNNEVDRSLAYLSSSATNVTMRWQQGQFVGGGTFGNVYAAMNLDTGHLMAVKEIRLQDPKLIPQVAEQIREEMGVLEVLDHPNVVSYYGIEVHRDRVYIFMEFCSGGSLANLLEHGRIEDEQVIMVYALQLLEGLVYLHESGIAHRDIKPENILLDHNGIIKYVDFGAAKWIARQGRTLAGDVQPSLPNRSMTGTPMYMSPEVIKGENPGKPGAVDIWSLGCVILEMATGRRPWAQLDNEWAIMYNIAQGNPPQLPPSDQLSPQGLDFLKRCFTRDPRNRSSAVELLQHDWITSIRSQVVEPATPSDTSSSAQSTPTVGSISSKLGGSDGFY

SEQ ID NO: 24337 - protein, 502 aa, Gibberella zeae PH-1
MVSETHSLDGKSPKSDLSFENVEHLATVEHAPVVLLNEDISYGRGGIRGVIESPYIFGVAFLASMGGFSFGYDQELGAFIGCLFMPTLCDKISRKKALSIVVVIFNIGAIMQTAANSYGLLVAGRTIGGIGVGTLAMGAPIYISEIAPPNLRGTLLVLESVSCVIGVVVSFWITYGTRELAGELSFRLPFGLQMVCSTILGIGIHFFPYSPRWLALVDRSDDALTNLERLRRLPRTDPRVHQEHAGICNEVTIQKRMQEKRHPGVTGLKLEILCWADLFKKSSWHRTSIAVGVAFFQQLSGINAFIYYAPTLFQSLGQSTEMSLIMSGVFNMLQLVAVTVCFFIIDKVGRRPLAIWGGIGGGTAWGIMAVLVGVFNEKWGSNPTAGWAAVAMAFCFILIYGVSYAPLGWALPAEVFPNSSRSKGVALATATVWLFNFVVGVATPPMIESIGFGVYIFFGSWCFLAAVWAFFLVPETKGKTLEQIDEVFNDHAAQEELMILRS

SEQ ID NO: 24338 - protein, 1173 aa, Gibberella zeae PH-1
MKFGRNLPRNQVPEWAASYINYKGLKKLVKAAAEKAKNGEKVDPAEFFFALDRNLEDVDFFYNKKLAEFCRRLNLLQNRYGRTPDVVATLDQDEVEEVMGALLELRSQFRNLQWFGEINRRGFVKITKKLDKKVPDLVTQRPYITTKVDVKPFAKEANTARLLNEINRWMSVLSEAQTFNDTMSEHSTRSLGRASAKGMLSLPQAQLDALDQAVRNDDALALEDGLKECNAIEEGAHPLLLGLLQRSISARSKTCISFLVSNTKTLDEPDDINSRNCIHRLVIHIGRTKATNGEQDSKSRPVPAGSQFSNRHLEPGLTTSKAATALNQNEALLLNKDDEAVQLFIFLLEQLRPEQRITLKSRDSFGRMPLHYAAQFGIVVICQIIMSKMQEWGQFHVKDGIDTPEWQDNDGYAPLHLSVVGGHPLTTRALLQGENWEGCSKGKADIRKSIAKSGAVLAIATKSNYSVIVQLLIEAGVDINWKDKTGETALHVAARFGHVECAQIILKGTQDQKVDLEATESTYSWTPLHVAAVDGRFSVAELLVEAGADITRLDSSGWTAREHAALRGHMDIARLLETDALEAESPPVRPVDTLQPTPSDMSSIDERRSNGNGANNVSRSQDAIKSFGHRYLTNESLVLVSLGSMDMRKNVEPVSLDRVPLTEAHNTQLDTALSIVVSATGAHGEPTIIDLPVHDSISTEPIVFMTSEAEKVKLLFDIVPTYSGNDKNKVGRAVALLSSVKPTLGSRRMNLQGDVCVPIMSSNFDVIGTVNFNFLVITPFHHPNMEVTSRQTYWKKLESTMLIGHRGLGKNLTSNKSLQLGENTLPSFIAAANLGAHYVEFDVQLTKDHVPVIYHDFLVSETGIDAPVHTLTLEQFLHINSDKSRDSQQQAKKKPPHSGVPGDFRARSNSVAPKRSQSMGFAGSGPDDLDERMKHTKDFKEQGFKGNTRGNFIQAPFATLEDLFRELPEHVGFNIEMKYPMLHESEEHEMDTYAVELNSFCDTVLSKVYDLSGERHIIFSSFNPDICLCLSYKQPSIPILFLTDAGCCDVCDIRASSLQEAIRFASRWNLLGIVAAAEPFINSPRLIKIVKENGIVCFSYGVLNNDPIMVQRQVKQGIDAVIVDSVLAIRKGLTNGETPAELTNGEAETNGTLKSTHALKEKLEELTVNGAGP

SEQ ID NO: 24339 - protein, 355 aa, Gibberella zeae PH-1
MSTQQKFEGWVAEKSTKEQDLVWKEYEMKPFEDTDIEIRITHCGVCGTDDHISKNGWGSTKYPIIVGHEIVGVATRIGSKAEGDIKEGDIVGVGAQSDACFERDGPCEECANGLYNYCSKNTPTYGGVHWCGTPSTGGYARYHRCPSRFVVKIPQGLAPELAAPMLCAGATMYAPLNYFGATGRKVAIIGIGGLGHFGIMFAKALDAAEVVAISRGSDKKGDALTLGADEHIATSEEGWAEKNKRRFDLIINTADGSNMPWNEYLGLLRVDGTMVSVGAPEKPIPINIFSLLPIRGRFTSTSVATPNEVRDMLQLAADKSLKPWVEERPMREANEALKDLQAGKPRFRYVLVNED

SEQ ID NO: 24340 - protein, 1994 aa, Gibberella zeae PH-1
MSSAALQTAPHQHTALASSPLGTPSSRQYRPSQSSPNSQAYNAQQTSTASSSSRRPPSRKTNDSAPSPSYHLTPGFGSPVTASVANHQEPVASDWQGNMPPVAPPRSSSNHQSGSSRRSHYPNEKPPSSPRRNESTRTGSRGEQAAAENGYRSSKADTAARASSRDGKAAPSQLPVRSTHSTPSKPVHDATDSLTKAIAAAQDTIDRDRNHASNQHNGDDTAAPPPAVATGEHGEERRQRSRHDHSRSNKGNTKFGDFILGNTIGEGEFGKVKLGWKQDSSVQVAIKLIKRDTVGSNPSRFAKIYREVAILRGVQHPNIVRLIDKVETDRHIGIILEYASGGELFDYILNHRYLKDNAARRLFAQLVSGVGYLHKKGIVHRDLKLENLLLDRNRNIIITDFGFANTFDAHEELTKEEELNLTDKEFVKRMGLDRVKMNGSRKGDLMQTSCGSPCYAAPELVVSDSLYTGRKVDVWSCGVILYAMLAGYLPFDDDPANPEGDNINLLYKYIVTTPLTFPEYVTPHARDLLRRILVPNPRKRADLFEVARHSWLSEYANLVEFITSTTTLPSEVPDSGVSPDDYAEAPTVARSNSVREASKHKQPHPPVVGGLAKTHGSVDPDSEATHRGTPKDAKRRTVQVEYVAPTTKTQRGADVAPSKPSSHSLQQQQPANTPEPVTEKPLPREPPLTKDNPSRAQQSRRPQSSHKNAPPPHRPSRDTRATSDNAFMTGGTTTTRPRTQGSMQSSTSMGLQSQTNYGQPAPPTIADTNAHGRIQQPQNPEEEGNIAKDVGSVPPKVMKMTTFQNETKAAGRGHKRSNTLGDIGSKIMGRSGSIFGGRSKKRPEQQQQQQQQQAEKSSRKYPPVSMSNTMLPGEDAGPRPSMDSKASRRSFSIGLGKKRSGSVQGSSDKQNRRFSLAKAMGLGRNEGSVTGSEADSQQDLPIQHPRTEQLRGYSAHDEPRHSEPYFDAPYEQYPQRDTAQSSPVYNTRYGSQQQDGRRPSAIPTYIQGGSHLNTGSDSSVDMRRPNDPRSRPYQEDFSGSEGYDGRPVGSSREDRPGVLHKSHKKFADAYDGENYRGHEGSSGAAKRVMDFFRRRGKARGATSNEGRTPRALDDAHSQLGDHPGQLILTTYARDWLCFDCYNHINWRSVVCFDGNETRDDETTISSLTVPFAKQITSHELAGKLTERAKKLSSQRVATIAYLEYMYMRPGSVSLPDTYVTWAKLAFAYSGIQTHRRIDLNLPFGSDASYTRMLSPLRHVTSNVGFASYGSRSVAQPTAPTAQGLSEQPRLQEFDEKKTRLDNQNGRKTKSLHKIPSAGGVSSPAAGSGSVLEAPSKAEEPAQGETPSTTSKNAGFFAELKRSVRIVITYSWLNVFMVFVPVGIAVSQVPGVPAGLIFGMNAIAIIPLAGLLAFATESVALKMGDALGALLNVTFGNAVELIIFILALVKNEIRVVQSALLGSILANLLLILGMSMLLGGLRFREQVYNSTVTQMSACLLSLSVISLVLPTAFHASFKDNDKADRESLKISRGTSVVLLIVYVIYLTFQLKSHAYMYESTPQHIIDAELAPGPAAGFLDSSSSDDSSSSSSDSSDSDSSHGTMRKRMKKVLRNRRHRRSSAASADTADTKGTRSASFATNNTTTPQEEVSEAKASRQRVPRSASYEGSEHAVDDDDEEEAERSHRRRRYRRHRHRRSKKEARKAKKEAKNAQSQNGVPESIPENKGEGEPRRVDFAVQDDLEAGPSTNGGKRPFPLRGISVKALAPVFTEKPPTASGPAPHVRYGIRRTNSLPDRLQFRAPGAMLPAQIPPMLNAPGVKSTDSDEEDEEEHLSQFSAVILLLVSTALVAVCAEFLVDSIQEVVKTSHINQVGIGLIILPIVGNAAEHVTAIKVAYKNNMDLAIGVAVGSSIQIALLLTPFMVILGWIMNKEMTLYFTLFETVCLFVSAFIVNFLVLDGRSNYLEGALLCAVYIIIAVVAFFYPDSEDASVWGGGT

SEQ ID NO: 24341 - protein, 444 aa, Gibberella zeae PH-1
MSEAEAPKPVEALQPEAEAAPTTQPTEEKPEETTQTSEDKSEEKKEILKTTAKHDENPRNNRKFDPSVREVTDDPEAIRKQVEFYFGDWNFPQDKFMWESCGGTENKPMKVKTIHSFKRMRTFQPYSAVIAALKDSKFLDLSGEEGEEELKRKTPYQPLNTSKSKVEAATVYVKGFGDETPNTQFDLESFFAQFGEVKGIKLRRTNEGLFKGSVFVTFADEEEANKFLKAEPAPKWNDHDLKIMSKRAYCDEKNELIKQGKIEPNHTQPKKFYEGRESGKARGRGRGGNDSGSRDNDNWKQRRDNDQKNGFKDRRGGRGGRGGRGRGRGRGGRDGGRDRDQTKDGAKHNSNDTMPRIQSTADESSDNKKRSRDEAPAGEPAAKKSIGNREDTPVGDLIPQVKTEPGIKNEPGIKTEFEVKTEPQVKSEPDIKTEWVKVKTEPSI

SEQ ID NO: 24342 - protein, 1069 aa, Gibberella zeae PH-1
MAESVPIPEPPGYPLIGNLGEFKTNPLNDLNRLADTYGPIFRLHLGSKTPTFVSSNAFINEVCDEKRFKKTLKSVLSVVREGVHDGLFTAFEDEPNWGKAHRILIPAFGPLSIRNMFPEMHEIANQLCMKLARHGPHTPVDASDNFTRLALDTLALCAMDFRFNSYYKEELHPFIEAMGDFLLESGNRNRRPAFAPNFLYRAANDKFYADIALMKSVADEVVATRKQNPTDRKDLLAAMLEGVDPQTGEKLSDDNITNQLITFLIAGHETTSGTLSFAMYHLLKNPEAYNKLQKEIDEVIGRDPVTVEHLTKLPYLSAVLRETLRISSPITGFGVEAIEDTFLGGKYLIKKGETVLSVLSRGHVDPVVYGPDAEKFVPERMLDDEFARLNKEFPNCWKPFGNGKRACIGRPFAWQESLLAMALLFQNFNFTQTDPNYELQIKQNLTIKPDNFFFNCTLRHGMTPTDLEGQLAGKGATTSIASHIKAPAASKGAKASNGKPMAIYYGSNSGTCEALANRLASDAAGHGFSASVIGTLDQAKQNLPEDRPVVIVTASYEGQPPSNAAHFIKWMEDLAGNEMEKVSYAVFGCGHHDWVDTFLRIPKLVDTTLEQRGGTRLVPMGSADAATSDMFSDFEAWEDTVLWPSLKEKYNVTDDEASGQRGLLVEVTTPRKTTLRQDVEEALVVSEKTLTKTGPAKKHIEIQLPSGMTYKAGDYLAILPLNPRKTVSRVFRRFSLAWDSFLKIQSDGPTTLPINIAISAFDVFSAYVELSQPATKRNILALSEATEDKATIQELEKLAGDAYQEDVSAKKVSVLDLLEKYPAVALPISSYLAMLPPMRVRQYSISSSPFADPSKLTLTYSLLDAPSLSGQGRHVGVATNFLSQLIAGDKLHISVRASSAAFHLPSDPETTPIICVAAGTGLAPFRGFIQERAAMLAAGRKLAPALLFFGCRDPENDDLYAEELARWEQMGAVDVRRAYSRATDKSEGCKYVQDRIYHDRADVFKVWDQGAKVFICGSREIGKAVEDICVRLAMERSEATQEGKGATEEKAREWFERSRNERFATDVFD

SEQ ID NO: 24343 - protein, 277 aa, Gibberella zeae PH-1
MLALPGRLIYGSLIKRHSVGLRAEPPHLLLCRIPNFITHGREARIGARERRTCYQARQVSSLQGSPMHEKELHHLHVFRNTTMSRGGTTLYVTGFSHGTRARDLAYEFERYGRLVRCDIPAPRSTSSRLFAFVEYEDRRDADDAYHEMHNKRIGRDDILKIEWARTPPSASWRFESGRDRDRRGGARSPRRGRSPSPRRSTRDYSPRKDDRRDRDRDYDRESRRDRDRSRSPDHRDRERDSKDDREDRDRRENGTNGDDRKPLDSPPPANEDLDVAE

SEQ ID NO: 24344 - protein, 450 aa, Gibberella zeae PH-1
MSESNALLAFFSQQSNTGGIIVRGRTRIDRLIQIGKSSVPLCIDALKLAIVEAKAGSDLTQYAEAWNCLRVAAPQEPEAQLETEWVDRVERENKAETTRLESQLKQYRHNLIKESIRMGNEDLGQHFEKTGNLEAAAEAYNRMRQDVTTTKHIIDCGIHLVNVYIAKRDWTMVLNNLGKIVGVQSGDEERMYQPYTKLVSGIALLGLKHYKDAANNFLQVDFALPPAQYNHIASPNDIAVYGGLLALATMERNELQARVLDNQSFRSFLENESHIRKAISLFVNGRYSSCLAILESVRNDYLLDVYLQRHISTLYSQIRNKCIVQYFIPFSCVTIESLNKAFASEGESVETELVTMIREGDLKAHLDAKNKLLIAVQPNPRLVMQKQALDVSRQYEQEAKDRLRRMNIIAAGLEIVGKRQQHSGQAGRGIDEQWYDDARTSGQQSQIEGV

SEQ ID NO: 24345 - protein, 361 aa, Gibberella zeae PH-1
MAEYEFKGWLGKDAESANGKMEWGSFEPKKWEENDVDIKITHCGVCGSDLHTLRSGWGETPFPCCVGHEIVGKAVKVGKNVKNIKVGDRVGVGAQARSCLREDCIECSAGRVNYCDNMVSTYGSVYPDGIGKSYGGYADYNRTDSRFVVKIPEALPSELAAPMLCGGVTVYAPLRNNGCGPGKTVGIVGVGGLGHFGILFAKALGADKVVGISRKASKRDEVLALGADSYIATDDDEDWANKYAKTVDIIVCTVSSSKMPFSDYFKLLRHGGNFIQVGAPDSGLLPPVNAFTLIKGGFKLSGSLIGSPADIEEMLELAVKKNVKPWIEKRPMEDANQTIIDIEEGKARYRYVLVNQKNIEQ

SEQ ID NO: 24346 - protein, 261 aa, Gibberella zeae PH-1
MRSSVSSSIVRDLSRTCIRCQLRARRASTLASSHRASAPATSVQRNGAFVTATSGPVTAFAYSSAASSAAQPESQTSSSSSAPPSTHYGLFPETLPDGPPPAGHFPINTRALRREFLRLQARAHPDMHGSQNKARAEAMSALINEAYKTLSNPLLRAQYLLSLRGVDVANDETLKVEEPELLMLVLEAREEIEDAEKEEDLDEPRAANDARIAESEQVLEHAFRHDDIEAAKHEAVRLRYWVNIKESLDNWESGKPIVLQH

SEQ ID NO: 24347 - protein, 2113 aa, Gibberella zeae PH-1
MGLNEDFDDRQIQTEAEQQPYVPYEYQTENNDSWAGALPVKQGLYDPSYEKDACGVGFACHIKGKPSHKIVSDARNLLCNMTHRGAVGSDARDGDGAGVMTSIPHRFFIKNFEKEEDIKLPPLGQYAVGNLFFKPDEETLQESKRQLEDVAESLGLRVLGWRRPPVDSTLLGPAAKSREPIIAQPFVVLASAYGTGNAPEMTDPEKFDERLFERQLYILRKRATQSIGLHNWFYLCSLSNKNIVYKGQLAPVQVYSYYHDLVNADYEAHFALVHSRFSTNTFPSWDRAQPLRWAAHNGEINTLRGNKNWMRAREGVMQSDVFKDELEQMYPVVEDGGSDSAAFDNVLELLTINGVLSLPEAVMLMVPEAWQGNQHMDPKKAAFYEWAACQMEPWDGPALFTFADGRYCGANLDRNGLRPCRFYVMDDDRIICASEVGTIPVEPESVIQKGRLQPGRMLLVDTQAGRIIDDKELKEAVSSRYDFRAWLDSELITLPKVVEIMERALDLAPKLDDKTIQSDPLLHSYGYTHEQVSLLLAPMAADEKEALGSMGNDAPLACLTQSPRLLYDYFRQLFAQVTNPPIDPIRESIVMSLECYVGPQGNLLEMDASQCGRLLLPSPVLSIEEFNAIKNMSNKYSEWTVKTIDLTFPKNQGVQGYIKHLDEICNEASAAIEARDRVIILSDRNTSADRVPVSAVLASAMVHHHLVSNKWRSMAALVVETAEAREVHHMCVLLGYGADAVNPYLAMECILKLNREGLIKKKTTNETLIRNYKHSCDGGILKVMSKMGISTLASYKGAQIFEILGLDETVVERCFRGTASRIQGMTFELIAEDAFRFHERGFPSRASIGPPGLPESGEYHWRDGGEPHVNDPTSIANIQDAVRTKNDKSYEAYSRSEYEQIKNCTLRGLLDFKFEDCTPVPIDQVEPWTDIVRRFCTGAMSYGSISMESHSTLAVAMNRLGGKSNTGEGGEDPERSQRMPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSEVGVGIVASGVAKAKADHILISGHDGGTGASRWTGIKYAGLPWELGLAETHQTLVLNDLRGRVVVQTDGQLKTGRDVALACLLGAEEWGFATAPLIAMGCVFMRKCHLNTCPVGIATQDPELRKKFTGTPEHVINFFYYVANELRAIMAQLGFRTINEMVGHVEVLKMRDDLRTNKTANIDLSLLLTPAHKLRPGVATFNVRKQDHKLHVRLDNKLISESELTLDKGLPSRIECDIVNTDRAMGTSLSYHISKRYGEAGLPMDTVHVNIKGSAGQSFGAFLAPGVTLELEGDSNDYVGKGLSGGRLIIYPPRSAVFKSEENILIGNTCLYGATTGTCFFRGVAAERFAVRNSGATAVVEGVGDHGCEYMTGGRVVVLGSTGRNFAAGMSGGIAYVLDVHGDFHSKLNGEMVETSGLEDPAEIAFVRGLIEDHHHYTGSERAARILVDFNRALPRFVKILPVDYKRVLLEEAAKAAEAKRAEYNLPAVSGVQHKKSEKAAKLQDLEEAVGDNAAEKKRALVLDKTRGFKMYKRRQEKYRPVNSRLKDWAELSSRLDEDELKYQSARCMDCGVPFCQSETGCPISNIIPKWNELVFQNQWKDALNRLLMTNNFPEFTGRVCPAPCEGACVLGINEDPVGIKSIECAIIDRGFEKGWMVPQPPKVRTGKTVAIIGSGPAGLAAADQLNRAGHLVTVYERADRLGGLLMYGIPNMKLDKRIVKRRTDFMADEGIIFKTGVAVGEEGHPSLSDLRASHNVVVIATGATVARDLPIKGRQLEGIHYAMEFLHKNTKSLLDSELGDNAYISAKDKHVVVIGGGDTGNDCIGTSLRHGAKSVTNFELLPQPPPERANDNPWPQWPRIYRVDYGHTEVRQHTGKDPREYCIMSEEFMDDGSGKVKGINTIRVEWTKSPSGGWDMKKVEGSQQFFPADLVLLAMGFLGPEARVLGDEIEKDARKNVKTAPGKYSTNLEGVFAAGDARRGQSLIVWGINEGRQAAREIDLYLEKYTNLPVTGGITKRTAQEIFSQIQVEA

SEQ ID NO: 24348 - protein, 432 aa, Gibberella zeae PH-1
MPKAPPQPASSPGVAAPAAASSIPNLKDRLPKLEPRKRRSGPSNPTPIPETPALPTPPDTSSNWTFKTPSRRILSKKDHDIFLSSPTCKLVTAWVFGLAESIVDTPNSAIRDADLSALIKTILHILDETEQLVTKSPPNEQGGSRFGNKAFRGLLDLAQKNSAAWHHDIGVQNEDAINELSTYFCESFGNANRIDYGSGHELNFMIWLLCLYQLGLLKQSDFKPIVLRVFVRYLEVMRVIQMTYYLEPAGSHGVWGLDDYQFLPFLFGATQLLHHPYITPRAIHQDLTLEEFGHEYMYLGQVSFVNSTKTVKGLRWHSPMLDDISSARSWTKIDGGMRRMFVAEVLGKLPVMQHFLFGSLVPADDSMSEDTGAGDEADVEDDPHAGHDHTGKAHDGTGWGDCCGIKVPSSIAAAQEMKKRGMNQGLRRIPFD

SEQ ID NO: 24349 - protein, 438 aa, Gibberella zeae PH-1
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEGGVAPDIQTAEEALELITDAIEQAGYTGQMKIAMDVASSEFYKESEKKYDLDFKNPESDPTKWITYEELANMYSELCKKYPIVSIEDPFAEDDWEAWSYFSKTQDIQVVGDDLTVTNPLRIKKAIELKSCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 24350 - protein, 502 aa, Gibberella zeae PH-1
MDIDSYRYRVPKPNYLPHIPDDDRDNSLVEEYSNTPLGLASEMDNAKFYNKCKRLAEESGITRPKGYNVSFHCNPDIEEHHFGVTHPMKPWRLTLSKSLIYSYGMSFAMDNYISRSATYEELNEFHSSDYLDFLGTVLPEPVPRDLENQGVDLKFNLGGSDCPLFDGLFNYCSLSAGGSLDAARKICSKQSDIAISWGGGLHHAKRSEASGFCYINDIVIAILQLLRHFPRVLYIDIDVHHGDGVEEAFFSTDRVMTVSFHKYDPNNFFPGTGALDDNGPKSEHNPGAHHAFNVPLNDGITDEQYDHLFNTVIGKIVEKFRPGAIALQCGADSLAGDRLGRFNLQVQGHGACVKFCKDMGIPMILFGGGGYTPRNVARAWTYETSIAINAQDKINPILPEHAPWRDHFRQDTLFPTLEQILGEPRVNKNPPKRLQDIVQHVTEQLRFVEAAPSVQFQTIPPDLGGVRDDVEERIKEENEERRDEIRKAREAAVGAVGTAMQL

SEQ ID NO: 24351 - protein, 366 aa, Gibberella zeae PH-1
MPDSRLFQPMKIGNIQVQHRVGMAPMTRLRASVDRIPNALMKEYYSQRASTPGTLIITEGTLVSPAAGGGFARTPGIWNQEQVTAWKTITDEVHSKGSYIFVQLFAMGRAATVEVAKEEGIDIISASPVAFEGSNAQPRAMTLAEIHDMIDAFETASKNAVAAGFDGVEIHGANGYLLDQFLQDVSNHRDDEFGANIENRSRFISEIMERVVKAIGPERVGLRLSPWSTFQGMRMKDPIPQFTDIIGKAKTLDLAYLHLVESRICGSTDDINNGQEKLDFAYDIWKSPFLIAGGYKLQGAQDLVDSEHPDKEIMVMFGRDFVSNPDLVLKLQHGLDLTQGERNTYYTSDSAGYIDYPCAAKVAVSA

SEQ ID NO: 24352 - protein, 442 aa, Gibberella zeae PH-1
MTVQSQQQSQAIPVLSSQNGTEPQDANKEVVQNVAAKGVQYFNPEQLPAPGLGINGPNNTLPKVFTPIKIRGMTMPNRIWVSPMCQYSARDGFQQPWHFAHYGGLAQRGPGLIMLEATAVQARGRITPEDSGIWLDSHVEGLRKHVEFAHANNSLIGIQIGHAGRKASCVAPWLDAGLAAEKAAGGWPDDVVGPSNEPFAPGYPTPRAITLEEIEQLKEDFVSGVRRAVEAGFDTIDFHFAHGYLVSSFLSPATNKRTDKYGGSFENRVRLALEIVEAARAVMPEDMPLFTRISGTDWLENNPEYEGETWTLEQSIKLAHQLADRGVDVLDVSSGGIHKMQKVAAGPGYQAPLAKAIKKSVGDKMLISTVGSIKIGTLAEEIIAGGEDDTPLDLVASGRLFQKNTGLVWSWADDLNTSIQIAHQIAWGFGGRAKKNAPKLVL

SEQ ID NO: 24353 - protein, 327 aa, Gibberella zeae PH-1
MVKSMQFGDLDVPVPGFGAMGISFALGNDLSYEQAEPVLLKALEQGCTFWDTAVSYGPGKNEKIIGDFIKKHNCRDKLFIASKCGIAAFEDGSVTNSAEHIRTYMEGTIERLGFTPDLYYIHRMDPNTPLEESIPALNLLRKQGKTKYIGLSECSAETLRKANSIAKIDAVQAEYSAFETIHETDGLVDTARELDISFIAYGPLGHGWLVENFPYETPEDFAPEDYRRQIPKWQGENFYANKRIADKFKELARKKNCTLPQIAIAWVAAQGMIAIPGTTKPERLVENFSAREIEITEEENKEMRKLVDALKPQGDRYNEIAMRNIGK

SEQ ID NO: 24354 - protein, 395 aa, Gibberella zeae PH-1
MLFKSFTFLSIASVAIAHGSHDQEPMEGPHQSLWYNTLPGDGGTQADSVFSGISTFGRLPYQPCLGHNSIKYDIAFIGAPFDTGTSYRPGARFGPSGIRQGSRRLNLYGGYNVPLATNPFNSWATVLDCGDIPVTSYDNQFALQQIEEGHYSILSRPPVTDADKLGPASKGRTLPRVITLGGDHTITLPLLRSINRAYGPVTVIHFDSHLDTWRPKVFGGSPSEAASINHGTYFYHAAMEGLLVNDTNIHAGIRTTLSGPSDYDNDGYCGFEIVEAREIDTIGTTGIIEKILKRVGPDRPVYLSIDIDTLDPAFAPATGTPETGGWSTRELRTIIRGLESLNLIAADIVEVAPAYDTNAEHTTMAAADVLYEVMSIMVKKGPLSRMMDGKLQEEL

SEQ ID NO: 24355 - protein, 496 aa, Gibberella zeae PH-1
MTSQHSPSIEPSYRILESFPDEETPLIPHSRNSSLEIKSSSRSPWLTETVVLVKASVPVILAYMLQNSLQTVSVLMVGRLSPEALATAAFSYMFTMATAWLIALGGTTALDTLGSSTFTSSKDKHDLGILLQRGLIVLTGFYGVVAIIWCFSGYIFRSLGQEEFICVQGPRFLQLLIPGGLGYVWFEAMKKFLQAQEIYRPGTYALLVISPLNAVLNWFFIYTLDFGLDGAPIATGISYWLCFLLLVGYTAFIKGSACWGGFNIRQALQHLGPFSKLAFLGVIHVGTEWWAFEIVALAAGRLGTIPLAAQSVVMTLDQIINTIPFGLGVAASSRLGNLLGLGDAVQARRCAHSAALLSIIFGTIILTVLLSTKNVIAKIFNDDEEVVTLVAHIMPYVALFQIADGLNGSCGGALRGMGRQWVGAVVNCISYYGGALPAGIWLAFHGWGLSGLWVGQCVALFLVGALEWVIIALCDWKKEVKRASDRIRVDDLDRNL

SEQ ID NO: 24356 - protein, 484 aa, Gibberella zeae PH-1
MSTNSTKTLNLKDNYVQIINGKSAPTQKTHQGINPATLEKKPEVPVASQDDLNNAVDAARKAFKSWSKVPWEERRQKLFAWADAVEAQKKEFAQLLTSEQGKPVAQANGEADAAVAWIKGQASLDLTEEVVEDSDTRKVVTRYTPLGIVAAIVPWNFPLMLAASKIAPALLTGNVIIVKPSPFTPYCGLKLVELAQQFFPPGVVQSLSGDDNLGPWITSHPGIDKISFTGSTHTGKLVMQSAAKTLKRVTLELGGNDAAVVFPDVDIDSVAEKVSTLAFMNSGQICLNVKRIYVHESIYEKFRDAVVNHVKNYKLGDGSEEVTSHGPVQNQMQYNRVKTFFEDIEKQGWKVATGGKFDPEPKNGYYITPTVIDNPPEDSRIVVEEPFGPILPLLSWKNEEEVIERANDTRLGLGASVWSADLETAERVAKQLDAGTVWVNTHFDITPMAPFGGHKESGIGAEWGINGLKGMCNVQSLFLSKVAA

SEQ ID NO: 24357 - protein, 170 aa, Gibberella zeae PH-1
MLIYNDILNGDELISDSYDLKEVDGIVYEADCAMIEEGAVEVNIGANASAEEAAEDLDDGAVKVNNIVNSFRLQSTTFDKKSYLAYLKGYMKAIKAKLQENGSSAEDIKAFETGASKFVKDTIVPKFKDFEFYTGESMDPDGMVVLLNYREDGVTPYTIFWKHGLKETKV

SEQ ID NO: 24358 - protein, 494 aa, Gibberella zeae PH-1
MTSSVTLQGAQGRQITVQTGLFIDNEFVPASNNATLDVENPNTATIIAQVSAAQASDVDRAVRSSQKAFATWGRSDPGTRRTLLLKLADLVEAHGPELASLEAIEGGLLYRDSLGLHVTQSVDNLRYFAGWADKLDGVSLPIPSGVAYTRREPIGVCAAIVPWNSLMILFWKLAPAIAAGNTIVIKTAELTPLWAQKAAELIKEAGFPPGVINIICGLGREAGQALAEHPVVRKIAFTGSSVTGRQIMQSAARSNLKKVSLELGGKGPSIVFADADWENALLWTTMGITASNGQICAAGSRIYVQDTIYEKFIQEFSRRSRDAVHGDPLLDETTKGAVASKAQLDKILSYVGKAKQTKARLLHGGQPLPGKGHFMANTAFVDVDQDDTIMREEIFGPFASIAPFSTEDEVIRKANDSDLGLNSAVFTNDVSRAFRISEAIETGTVTVNCWAMLNANTPFGGVKESGFGRDSGQEALDNWTVTKTVKFNILPPKL

SEQ ID NO: 24359 - protein, 496 aa, Gibberella zeae PH-1
MKSDAWLSKPFLTSIFLGIGGFLYGFDSGIITPSLALGTFVNYFGNPPPPLRGAIVSMYQAGAWLGSASVGITSDRLGRRKAIAFGCIWGVIGGAIMAGAAHVAMLIIGRMLVGFAVGTITGVSPVFGAEIAKTHERAKVTAVNQMMTAWGFFVALWIGVAEGKWHSPNQWRLGFAIQSIPALILGVGVLFLGESPRWLCLKGRHDEAEKAFRNYHFDGTNDEWCRTEFTVIQVNIAEEQQAQGRLSWGDLIKTPSFRKRLFVGSFVWAAAMLSGISFVQYYQTAIYATLQFDQDRQLLVSGLYGSVAPVACLISLFFVDKIDRKKILITSSSLLSVCYLIITILAAKFPAVPGMSTNAAAQRGLIACIFAVSANYSALLGPMTWIIPPEVFTTELRAKANAIVQVVHYSISLIITQCSPIALAEVGWKYYILFVLTNALCALIFFFVYPETRGKSLEEIDEIFGDVKIVHEEDVKFSEKAGIDTIERRDSRVVSH

SEQ ID NO: 24360 - protein, 426 aa, Gibberella zeae PH-1
MSNQTQKLQPAGRVQGQKKDVWSMINEAAASSPIQPIVNLGQGFFGYNPPDFILNAAKEALDRVECNQYAPAKGRPRLRQALADAYSPSWGRQLDPETEIIITTGANEGMLSAFMGFIEAGDEVIVFEPFFDQYISNIQMPGGKVVYVPLHPPKTGATKNSSAADWTIDFEELEKAFTPRTKMIVINTPHNPVGKVFSKEELQGIADLAVKHQVIILSDEVYDKLYYVPFTRIANLSPEVEKLTLTVGSAGKNFYATGWRVGWLIGPQELIQYVTAAHTRICFSTPAPFQEASAIGFEQAGKNGFWDETIKEMKGKIDRLKEVFEELELPVTYPEGGYFLLVNMAKVKLPEDYPFPPHVASRPRDFKLAWFLIQEIGVAAIPPTEFYTPVNAHLAEDYIRFAVCKNDDILEQAKERLRGLKKYIPE

SEQ ID NO: 24361 - protein, 446 aa, Gibberella zeae PH-1
MAMRLPLRARLASSCAIARPRIVRRGLASLPNADVASDSKSAAMVNEHAPYMVATYARPPPVFIKGKGSWLWDAEDRKFLDFTAGIAVNGLGHCDPEFTRIMTEQAQTLVHASNLYYNPWTGALSKLLVEKTLESGAMHNAASVFVCNSGSEANEAAIKFARKAGKIVDPSGEKVEIVSFNNGFHGRTMGSLSATPNPKYQKPFSPMVPGFKTGDYNDIAGIDALVTEKTCGVIVEPIQGEGGVTPAKEEFLVALAKRCREVGAVLIYDEIQCGLGRTGTFWAHGNLPKEAHPDILTTAKALGNGFPIGAVLVTQDVADKMKVGDHGTTFGGNPLACRLAHYIVGRLADKQLQADVKAKSEIFKKRFAKLQSQYPDLVKEVRGRGLILGLQLSQDPSPIIKAARERGLLIITAGTNTLRFVPSLTVTDEEINQGLDIVETAIAATQ

SEQ ID NO: 24362 - protein, 436 aa, Gibberella zeae PH-1
MSSDLSHQIQSKLDAAIDRYVARNPRSKALHEEALKSMPGGNTRTVLHTSPFPVAIKSGQGYQVTSEDGHVYTDLAGEFTAALYGHSNPVITSAIRHVLDNVGMNVGGHTAQEQLFARELCSRFNLEHVRFCNSGTEANIHALAAARAFTKKRRVVTFSGGYHGAVIGFKGGKPEANNVDTDDWVVARYNDLGSARAAIKSDGVAAILIEGMQGSGGGLPAMPEFLQGVQDIAAKAGVLFIIDEVMTSRLSGGGISELRGLKPDLKTFGKYLGGGLAFGAFGGRADIMAAFDPRSPNALSHSGTFNNNTLVTHAGHAGLTKIYTPEVANQFTKSGHELRERLNAVTEGTRVLFTGLGTIMGVHFTTHGDRVIERSGEVEEIDALRDLFWFEMLEEGFWVVRRGFIALVLGTPTAEFDRFVNCVEAWVSKHADLVKI

SEQ ID NO: 24363 - protein, 493 aa, Gibberella zeae PH-1
MKPFAITTALFSLVSAALAGASTESKTSKIILPADFKPPQVFQNANLVHVISLEKNYVKEQINVLVENVAKEPQTEYYVPFTTEQLPRVGGFEVKDRKDANAGPFVVEPVEYDANSDVQYYRIQLPTPLKPGAQQTLGITYYYLKAYTPSPAVISQRARQFLAYDFSVYAPSAYTTKKQKTEIKTGTSNIPDYTKLPGSGDVKEYPVKQGSKLIYGPFEEKPAGAVSPARVRFEFQKPVTHVKELDRDIEVSHWGGNIAFEEHYDLHYRGANLTGSFSRGDFTKDLIQGNRPSYALSDMRVPLQVGSVDAYYVDVIGNISTSRFRSNKREALLELKLRYPLFGGWKAPFTIGWNSDASNFLRKTATGGYVLRVPFIEGPKQLEGVEYEQVNINVLLPEGAVNVKYYANVPESSIMSTSIDLTRTYLDTVGRTHINIKARNLVDEFRDRHLIISYDAPLSSALRKPLIVFASAMAVFVTTWALGQLQVEFKQKK

SEQ ID NO: 24364 - protein, 206 aa, Gibberella zeae PH-1
MSKLFIGGLAWHTEEATLRQKFEEFGPVEEAVVVKDRDTGRSRGFGFVRYTQEGDAQNAIAAMNNVEYESLWFLVIQQRCYRIILRDLTMYRFDGRNIRVDKASDNGPRGGFGRGGGGGGGGGYGRNFGGPMPYGMGPPGPGYQMPAPNMYAPMPYGRGYPPQQGYGGPPQGYMPPQQQYGYHDPSQQIPPQQQQQQQHHQGGRGY

SEQ ID NO: 24365 - protein, 421 aa, Gibberella zeae PH-1
MGLQKHRHWHDDEIATLARLHQHPLCLADLVRHGRPPLSSESLLSSANFALSLLPVRLAHRIQALRNLPYIVVANPNISRIYNNYLHSLSILLPYWHATREGRPISTQEDEVHFTNVLAELVATHTDTIPILAKGFLECRRYISPEEVTRFLDQHLRARIGTRLIAEQHIALHFSSQPHFDPSASPTPCPEHPSYIGVIDTALRPAQIVESCAGFVADICELRYGVRPLLYIRGEPDTTFAFVPMHLEYIVTELLKNAFRATIENRSNEPVIVTIAPEPALPKESSTSTTSPSAENKQSDTNSDGIRPLDDNAPGVTIRIRDRGGGIPPEVTPNIWSYSFTTFSDDVDDFPGDANGNDGGLSAISTASTGGSSIAGLGYGLPLSRAYAEYFGGGIAVQSLYGWGTDVYLRLKGVGNLDKQQ

SEQ ID NO: 24366 - protein, 342 aa, Gibberella zeae PH-1
MTKVLLTGGSGFIAAHTLEQLLEKDYSIVTTVRSEDKAQKIRNAFPDKVKDGKLEIVIVTDIAKPDAFDQVAKTPGLDAVIHVASPFHFNITDPKKDLIDPAVIGTTGILKALHASAPNVKRVVITSSFAAIIDEAKFTDGSHVFSEKTWNPVTIDDITRSDTTAYRASKTLAERAAWDFVAEKKPSFDLVTVCPPLVLGPVSKHLATLESINTSNARIVNLLRGEWKDEIPPCTPVPLWIDVRDAARAHVRGLEEPSAGGKRLFTTAGLFSHREIVDIIAEKFPEFKDRLPGPEVKGGELPPKDQIFGIDNKETNELLKIDWLTVEKSMTDLVESLKEIGI

SEQ ID NO: 24367 - protein, 308 aa, Gibberella zeae PH-1
MSDYKTYSFNPAQDIPSLDGKVILITGANTGLGKATALELAKHNPAHIYITARNSTKGNTALEEVKGVASEGTQVSLLELDLSSFDSIKAAAKDFLDREVRLDVLLLNAGVMGAPPVLTKDGYEMHIGTNHLGHALLLKLLTPVLDKTPNARVVHLFSAGFRHVGPNGIEFDTLKSATSPTPLPLRYAQSKLACLLYAREAAKRYNFTNIAINPGEVQTELFSRKAGDEMMKHLQENVAPKMAGPISEGVKNHLWAATSTEIKNGEFYEPVGKTGGLEGAGLDEEMANKLWDWTEEQLEGLRVSEIDR

SEQ ID NO: 24368 - protein, 476 aa, Gibberella zeae PH-1
MSSPLAFSKVSSSTSYSNRYACSGTADIISTVEFDHTGNYLATGDKGGRVVLFERNETKKTCEYKFHTEFQSHEPEFDYLKSLEIEEKINKIKWCRRQNASHYLLSTNDKTIKLWKVFEKSLKVVAENNLSHDVTPGSIAGGGGAPKPLPAHQFKNAADLKLPRLTHHDTVVAAVPRRTYANAHAYHINSISVNSDGETFISSDDLRINLWNLNIQDQSFNIVDIKPANMEELTEVITAAEFHPMSCNWFMYASSKGTIKLADMRESALCDQHAKLFEQEEDPSSRSFFSEIISSISDVRFSHDGRYILSRDYLTVKIWDINMERQPVKTIPIHEHLRPRLCDTYENDSIFDKFEVVFSGDAKNVMTGSYNNNFMIYPSDPDKEVEVVLQADKSAFKAKKVGVPTPINSSTSPTATNGKKGGSRAGSPGGQGQRMRKETDADQIDFNKKILHMSWHPFEDSIAIAATNNLFVFSAL

SEQ ID NO: 24369 - protein, 287 aa, Gibberella zeae PH-1
MEMQDVTTQCQIQMENIIQRAASYWPIALCTGGPNESRPIHHTSTISHHTASLIDVTPSEFQASQRLPGRCDFQFYDTYSILHVPVSAPTTIMKAALFLSALASTAVGVVAEELKIDVTLPVICERKTQKGDGVHMHYRGTLKDSGKQFDASYDRGTPLSFKVGAGQVIKGWDEGLLDMCIGEKRVLTIPPEFGYGQRAIGPIPAGSTLVFETELVGIDGVPKPEKIETKVVEGAESAAEAISEATEAAATASQKVAGKVAEAIVDAAKAAKTIIADTDDAPEHEEL

SEQ ID NO: 24370 - protein, 497 aa, Gibberella zeae PH-1
MGSRMTPEAIKPVMLIDGQANACLIQLVGASDGNSFPLFNPATGEKVADVPEATEDDTNRAVAAAQRAFPEWSAMDPAKRGSYLKKLASLIKEHNEELALLEAKSMGRPLAEFFEGHIAASSYEHYAEAWPHIQGQASLNTPGYVTMTLRQPFGVVAAIIPWNASLLFFASKSAPALIAGNTVVVKSSEKAPLGAAKFAELIHKAGFPPGVFNVLSGHGNPSGATLASHMDVRAISFTGSSPTGRAIQEAAAKSNLKKVILELGGKSPVIIFDDADLEQAAKDTMYSIQWNSGQVCMANSRVYVQDSIADNFIQACKKALSAAKSGNPTEKGINHGPQADKVQYEKVMSYINEGKKSGTLELGGNGNLDKTGGFFVEPTIFLNTPEDAKVMKEEIFGPVVNINVIKTEEEAIEKANDTEYGLYAAVYTKNVDRAMRVTQKLNSGYVGINCTSPTTARDLPFGGYKSSGQGREGWLYSLDNFLEVKSVMMKVDSGSKL

SEQ ID NO: 24371 - protein, 495 aa, Gibberella zeae PH-1
MTSTTQISLPNGKKYDQPTGLFINNEFIAATGDEFVVTNPHTEEEVIKLKGASKEDVDKAVQAARKAFEGEWSELAAVDRGAFLYKIADLIDRDRELIAAIDAFDNGKPFSACLAGDLDESYNVFRYYAGAADKISGKTIETSPAKLAYVLQEPLGVCGQIIPWNFPFMMLAWKVAPALACGNTVILKPAEQTPLSALYFGNLVKEAGLPAGVVNVLPGLGPSTGKAIAGHMDIDKVAFTGSTNTGRAIMKDAANNLKNITLECGGKSPSIVFADAELEQAVKWCHFGIMDNKGEVCTSTSRIYVHEDIYDKFLEKFVEVTKENDKLGAPFDESTVQGPQVSKTQYDRVLSYIEEGRKSGAKLLYGGSKHGGKGYFLQPTVFADTTEDMKIMKEEIFGPVVSIAKFSTDEEAIKKANDTSYGLAAALFTEKIARAHKVARKLQAGMVWINSSGDSHFGIPFGGYKSSGIGRELGQYALDAYTQPKAVHVNLGFEL

SEQ ID NO: 24372 - protein, 331 aa, Gibberella zeae PH-1
MVSFKVFRGTPEGKIVADNVERELENHEVFIETTHSGVCGTDKLYMTSGVVLGHEGVGIVKAVGSAVTNVKNGDRVGFGYTHQICGHCDNCCTDRDQYCRDRQIYGFSDFNNGSFSYGAVWDSKTVCPIPEGYDSADAAPLLCAGSTVWTCLTQYGLRPLESVGIVGIGGLGHLAIKLAAAMGNHVVVFSSSESKRQEAMDYGASEFHVYKSGDKAPEGLKPVKHLLLCGSANIDYSGLASIVDYDGSIYPLTAALEATPVPLTELSLKGIRIQGSLVGSRDSVRKLLEFVARKNITPTTMKYSLNEEGIEKALHDLKDGKVRYRAVLVKE

SEQ ID NO: 24373 - protein, 475 aa, Gibberella zeae PH-1
MRLLTRPSSCAIARGLCRNSTFPCSISRASVSTLHAKINSPPPRIVRSEGCWLETHQGHRILDASSGASVVSIGHNDSRVKEAIIAQLDQVAYCYNPFFTTEAAEKISRFLTDSTDGHMSKVFVVSSGTEAVEAALKIARQYFTELPTPQPNRTKFIARKQSYHGNTLGSLSVGGHKARRGVYEPVLATNVSHVSPCYPYREMKEGETEEQYVERLAKELDDEFKRVGPDTVCAFIAETVSGTSLGCAPAVPGYFKAMREVCDRHGALLIMDEVMSGMGRTGTLHAWEQEGVVPDLQTVAKGLGAGYMPVGALLVGNKVANTLEQGSGAFSHSQTYQGHPVACAAAFSVQMAMKEDKMLQNTQEVGKVLGKKLKERLAGHKNVGDVRGRGLFWGLEFVRDKDTKEPFPLDDQIAGKLHKAGLTSDHGISLIPATGNVDGMQGDMVIVSPPLTVTKEEVDMVVDRIEKVVTSVLGS

SEQ ID NO: 24374 - protein, 463 aa, Gibberella zeae PH-1
MKSPIPDYLNQVLENARPIEGGKPASYIETLAKADTSKVAVALAMVDGEIYSAGDDDVEFSIQSISKAFVYALAIEDAGLDKVLEKIGVEPSGDAFNSLSLERGSNRPMNPMINAGAITAHSLIGKPDWTMEQRTERILNALSLLAGRQLHVCEEVYEAELRGADRNMGIGYMLKAAGIITGDAQQIVTGYIRQCAINVNVRDLATMAATLCNAGIHPISGDRIIPQDSVRQILSVMSTCGMYDAAGDWLSRIGIPAKSGVAGGIIGALPGQMGIAVFSPKLDHRGNSVRGVAICEQLSSDMGLHMMDVSQIAQATVRTSVATIVAGDNEPNHSNCNKEILIFSLRGVVRFAGSERLTREITRVLGAPNPDDPGCGSSRHACAIVFSFRDVFSFNAVAQRIIQADITRLLLDGRTIVVIDPSGVLTIDTARAGAKLKVVKSETDARDFIGGIGCHTVSKSDEW

SEQ ID NO: 24375 - protein, 505 aa, Gibberella zeae PH-1
MPSKTRTYNWFIAMVAASCMTLYGFDSSVFNALQASENWLNWFNLDLKEDSYTVGLINTCYTIGAIVSGFFIGGPLADWLGRRAGMGIGCIITIVAAIIQAFAPKGKLGVFILGRVLIGIGQGTALTAGPVYIGEVAPAEIRGQVMTFWQLFYSVGAFIAYWINYACGKNREKLGEWDWRMVVIFQVLVPIFVVILLPFQPESPRFLIKKGKVDDARAALRRIRDTEEEVEEEVMGILAAIEYEKEAISPGYRALFKDPSLRKRFGIAVVLNVGQQLTGQGTLNTYSTSIYKQVWTSTEKINLINALWATMGILFTLNAVWTADRFGRRWIFMVGAIGMAVCMLIVPIIGLATPTPKTEPSAIGIVVMLYLFIFFYKPSWGAGVWMWTSEVFSANVRTQAVGMASQCQNVANTIFQQFFPTFLAKTGLKCLFFFFGVNILLAIFVFFFVPETKGIALEHMDTVFGGVDHSEKGAQMLGTDVPHNDTQQFKDGAEIQQSEKKPESV

SEQ ID NO: 24376 - protein, 218 aa, Gibberella zeae PH-1
MTMNTPLDGHFVPNITFGPPVVAAIRGHVDQPTEAHGRGTFDCHMMIAEPKKWVKEFKKAGCNLYCFHYEAAFSSAAENPEDQTDEKTNPKALIRYIHDQGLLAGIAIKPDTSVDVLWEILENSEEKERPDMVLVMTVYPGFGGQKFMASELPKVQALRAKYPELNIEVDGGIGPKTIDEAADAGANVIVAGSAVFGANDPSEVIAQLRQSVDARSAK

SEQ ID NO: 24377 - protein, 1396 aa, Gibberella zeae PH-1
MVPERQYHGNGRPAIASRERSVPGTPSRKEKIRESSALQDPGLKDYVRIPLSPMLLRLGECLGKGAFGSVYKAFNWGNGEAVAVKQIKLADLPKMKSIFSKTFTYETDESRYCENGSLHSICKSYGKFPENLVGVYMTQVLQGLQYLHEQGVIHRDIKGANILTTKDGTVKLADFGVSTSTLAGGQDKEAQVVGTPYWMAPEIIQLSGASSASDIWSVGCTVIELLQGKPPYHNLAAMPALFAIVNDDHPPLPEGISAAARDFLMQCFQKDPNLRVSARKLLRHAWITGCRRTEAPVSRKPANFSDAVEEVKQWNKALKSSEPNLRASLGSETGPSTRLQGGTPAKGSLSLAKLRSGAGAFNDDNWDDDFATSISPSALHLPHIKPQDNFGGLLSSDRLKAFASINDGRNESNTYDDDFEGELMTIKGLGQWQDSSDLQEQTIRPTPRKPTKAPEPVKVHSRNKSSTSKAVGGGRTKSPTKSHLNNKFELPLRPDLAYREQSVDDFSDLFVDNDNVFTHNVNQAVRRNSRQSDAPQLFHPSDLTSLPRSMQESSSGSIKKKPLSRPSVLPDAPMRRTRSGIEIQKFAEDDDEDFSDVFGPESSIAEKEESEKGSEDGGLMLMSRVSSSSWLGDEEDEDDPFAYMDPGWDEMDLEANIARDRHARLAERVEDLVRSLKTTEGDDALAEFSEDLLALLWENSEVKNLIISAHGLLPILEILEPCTVKSRQYMILQLLKVVNAIILDDVEIQENLCFVGGIPIITKFAARQYSDEIRLEAAAFVRQMYQTSTLTLQMFVSAGGLNVLVEFLDEDYDNTRDLVLIGVNGIWNVFELQGPTPKNDFCRIFSRSKILYPLALVLHRVVDDDDEDELGELVEGRIVNIFYLFSQAENYVKEVVADRQVLKSVLRDLRLMTPIHQITMLKFIKNLSMLSTTIESLHSADAIESLINLLGYSMRKGQTHFREISNQVLNTLFNLCRLSKERQEDAAVHGIIPILLKIMQTDRPPKEFALPILCDMAHSGSKGRRFLWQNKGLNFYVSLLTDQYWQVTALDAILVWLQEETANVESHLADGGFTRAINSCFNTNRVNAFDSNLLEPLLKLLRLSPSVAASLAKPEMFAGIAQRLGHKKAVVRLNLLRLVRTIMDACEPGLGNGDGTRSLNSSQVRSLMATIQILAEKDTAVLVRNLASELVRSNIDTTVRPSEGAATAVPSSSRQRGSRRNNSYTPPSLQTSVSAGPQTPTHRTRPSLANNAYVEVAASPRRSAAVEREREGMIYRPRSKDGPTGIPRRISGEFAPVKSRLPRTSLVTSSSSRAGVGISANGNSPALSSRHDITMARSDSSLSNKENVGRAPGSRDGIGSRDSSSSLASPGLSGVPERAGIISKRRSRMPTEPKWP

SEQ ID NO: 24378 - protein, 500 aa, Gibberella zeae PH-1
MSLDIQLTAPNGRTYKQPTGLFINNEWVKSSNGEKITSINPTNEQEITSVYAGSSEDVDKAVRAARRALHNPSWRDLPGTERGKLLSRLATLVEENKEILATIETWDNGKPYTVALNDDVNEVAETLRYYGGFADKVYGQVIETTGDKFGYTIREPIGVCGQIIPWNFPLAMAAWKLGPALACGNAVILKPAEQTPLSILYLANLIVEAGFPPGVVNIINGLGTVAGAALASHMDVDKIAFTGSTPTARSIMKMASSNLKNITLETGGKSPLIVFDDADVDLAAYWAHAGIMYNQGQVCTATSRILVQESIYDKFMAAFGAQVKNISKVGDPFEESTFQGPQVTKAQYERILSFVDVGKKEGAKLALGGQPFKVGDGKGYFVEPTVFTDVTPKMRVFQEEVFGPFVVVTKFSSEDEAIHLANDTQYGLGSALFTTNLTRAHQVAKRIEAGMVWVNSSNDSDWRIPFGGVKQSGIGRELGEAGLAAYSNIKAVHVNIAAKL

SEQ ID NO: 24379 - protein, 466 aa, Gibberella zeae PH-1
MYRPRILGQGLRGFTHGRTCRRTYITDADVQSARRYCLTQLHDYDAHLIRRFVPSPVQDTYAVLRTLNLELVRLPELVSNPTIGAFRMKFWQESIDNTFAGRPPREPICILLHKCLQDLEARDGSSAKKSIKFWISRLIKTREKHMSNRPFATLSSLEEYAENTYSTLMYATLASLPLKSMHVDHLASHIGKACGITAILRGIPLLAAPPPPVNTPSGQAPPVREPAILLPLDAMAEAEVKEEEVFRQGPNAPGLQDAVFQVATRANDHLITAREMLKRLKAGEDPGHEFEHQGEGEHFYGEGSDTLNEIRQGFGVLLEAIPSAQYLQRLEQADFNPFAVKTADAVAKMLYELIAIVRPGSLLEVKEIAQTVGSLVLKNGGVVRGLANWGVFSLPKPISVHQMKHTHGHYFVMRYDAAAKVHHDVRNTLRLEPRMIRAAHVKLGDGKLESLSRFGPPKWKTTGSEA

SEQ ID NO: 24380 - protein, 342 aa, Gibberella zeae PH-1
MAPPAQLPLRQLTKNGPKIPAVGFGLMGLSIAYGAAEPDEERLKVLDRAWELGCTNWDTANIYGDNEDLIGKWFKLHPERRQDIFLATKFGIKVSDGGMVTDSTPEHVKASIEKSLKRLGVDHIDLYYMHRVKADVPIEKTVGAMKELVEQGKVKYLGLSEISSTTVRRAHAVHPIAAVQVEYNPWTLDIEGPSGTHILKTCQELDIALFAYSPLGRGILTGRFRSVDDFEEGDSRRRLTRFQGDNFKKNLKIVDKFDEMAKSKGYTSSQMALAWLLKQSPNVFVIPGTKKIKYLEENVGAAKVTLSEEEDQELRRLVEEAEVSGGRDAFFGNYMDTPPLET

SEQ ID NO: 24381 - protein, 492 aa, Gibberella zeae PH-1
MALTVELSTPVTGTYQQPIGLFIDGKWVEGVDKGKFEVINPSTEEVITSVCEGTEKDIDLAVAAARKAFDGEWKNTAPQTRGNLLLKLADLAEKNLDLLAAVESLDNGKSITNARGDVGAVVGCLRYYGGWADKIEGKTIDIAPDMFHYTRSEPIGVCGQIIPWNFPLLMLAWKIGPALATGNTVVMKTAEQTPLSALVFTQFIEQAGFPAGVFNLVSGYGKTAGAALSSHMDVDKIAFTGSTVIGRQIMKAAASSNLKKVTLELGGKSPNIVFEDADIEEAINWVNFGIYYNHGQCCCAGTRIFVQESIYDKFLAAFKKRAEENKVGDPFNEETFQGPQVSQLQYDRIMGYIKAGKDEGATVEIGGERLGDKGYFIKPTIFSNVRPDMKIMQEEIFGPVCAISKFKDEAEVIDLAHDTAYGLAAAVHTKNLNTALRVSNALKAGTVWVNCYNMLHHQLPFGGYKESGIGRELGEAALANYTQNKSVAIKLY

SEQ ID NO: 24382 - protein, 286 aa, Gibberella zeae PH-1
MPLVGGHEGAGVVVARGELVKDVEIGDHVGLKWLHGSCMSCEQCRQSNESLCSHASLSGYTVDGSFQQYAVGKAAHVARIPKDCDLAGVAPILCAGLTVYKALKSSNVRPGQSVVIAGAGGGLGVFAIQYAKAMGLHVTALDGGEEKRKVCTELGADTFIDFKTSADIVGEIKNATRGLGPDAVLLLAASEKPFQQASQYVKSKGTIVCVGLPANAFVKAPVFDTVVSIKGSYVGNRQDAAEAIEFYRQGLIHAPYKIVGLSELQKVYDMMIAGNIAGRYVVDTSR

SEQ ID NO: 24383 - protein, 386 aa, Gibberella zeae PH-1
MFPSLFFTSILAAGISAQSIPDPALTANRAFQHLGCVAIRPGTFPRQFNLGQTGCASTCSSNGNIIGFRGNSCVCDRLDLSDRPITYRVVKVDNALCTQWCDPADKSKGTCGGASVQGWPIYDLYKRNNAQIVYENFPSATPTPMSSAYPVQTGGPKPGDVWHECPPHVVNCPYRNKCPSGNCHPVHKPIVKPCYGCSHNGTGNWTAPTCPPGGCGNGGKPAPAPVPVPVPNPPCKDCNNGNDGNGGNGGNGGNGGNGGNGNNEGNGGNGGNGGSGGNGGDGGSGGNGGSGGNGGNGGNGGNGGNGNNGGNGGSGGNGGSGGNGGNGGSGGDGSSGNSSDGQNGSDGNGNGNGGDTPPVIVNSAIKIQSASFISFFLTFSLTFILL

SEQ ID NO: 24384 - protein, 279 aa, Gibberella zeae PH-1
MSVVSLLGVNVLNNPAKFVDKYEFEITFECLEQLEKDLEWKLTYVGSATSDQYDQELDSLLVGPIPVGVNKFIFEADAPNISRIPDAEILGVTVILLTCAYDGREFIRVGYYVNNEYDSEELNAEPPVKPIIERVKRNVLAEKPRVTRFAIKWDSEASAPAEYPPEQPEADLVADGDEYGAEEADEEAAEEAEEEAKSKGKASSGEDAEMAGVEHEGENAADEDELSDDGSVDIEGESEDDLEEEEEGEGEGEADGDAMEVDSAEKPATSTAKPVSVAS

SEQ ID NO: 24385 - protein, 1099 aa, Gibberella zeae PH-1
MKPVYALTICLGLLEGADAIAIPEFVSPKVGYSTSLNHGEKKAESGSDANSSPRVFGAYGPKSKLVGLPPVRRSDKTEESYGSDDGVDDDDQDDSGDNTADPPEDSPDSDDPELIYPEPMMAPAYVHTGVLPVDKPEEAPKSKSSKVDTKSKSKSGSKPDDTVHTAKHGGDDDSESGSSGKKKQKGKDKNKGNGDNPGKHSGDDDASKSRTKSEDSKPTSKLTTSNTSTSGTAPLPTSVNTRPTTGRHSGDDDDKKSRSKTEDSPRSGSPKPTSTSDASSKGSGKGKGKGNDGSGKHSGDDDATKTSSKKGSKDDSAKADDSKSAKSAFKKSSSTPRHPRGITATHQSGSTFDPNSAKGGGKNGPGFFKPFEPPKLNNGYIQAVPPQASQKNSKSSPKVKPKPRLNGKVSGPFSSLRKREQLLSLRAAAPLESVTIDRSKWKATCDSVHEGDECQNAIDGNGDTIWHTQWEGTEPAPPHMITVDMKKVYNVNGISMLPRQDGSQNGYIAQHQVFLSKDNHNWGSPVAYGTWYSDYTTKYANFDTQPARYVRLVAITEANGGPWTSIAELNVYQGNDYTAPQPSSLGAWGPTVNFPVIPVAGTVDPKTGKVLIWSSWARDTMDGGPGGLTLTSMWDPATGLVAERDVTETNHDMFCPGISLDGNGQLVVTGGNNAERTSLFDPVKQAWIPGPDMKVARGYHASATTSTGKVFTIGGSWSGGEYFKNGEVYDPKKKTWTLLNKADVQKMLTADTQGLFRSDNHAWLFGWKKGTVFQAGPSQAMNWYYTDGKDGNVKTAGKRQSDRGVAPDAMCGNAIMFDAVKGKILTNGGTPNYQDSDATADAHIITINNPGNKADVSYASEGLYHARVFHSSVVLPNGNVFITGGQEYAIPFADSMPVLEPEMYLPDEDRFVLMKPNNIVRTYHSIALLLPDGRVFNGGGGLCGGCDTNHFDAQLYTPPYLYDSKGRLATRPKIASVSVSTVKVGGTVTVQTSGAVVRASLVRYGTATHTVNSDQRRVPLTLSNAGKNSYSFQVPSDPGVALPGYWMLFVMDKNGVPSVASTIKVTVLQTYKGPGTVNPNDLPLNALLAIQQAKCLRCL

SEQ ID NO: 24386 - protein, 401 aa, Gibberella zeae PH-1
MSANQPIAVGDSKGPTADAVQTSSASATTNQDAAVSQGIHTLEVKSVHWYSYLTTVDFWVVLALGQVLALCITATNTFTSFLANAGTNIPAFQTVFNYILMFLIYTPVFLYKDGISGWWKIAVKDGWKYLIMAFLDVEGNYFTVLAYRYTNVLSAQLINFWAIVCVVVISFFLLKVRYRIFQIIGILVCCGGMGILIGSDHISGTNGGSGLDMVKGDLFALLGATLYGTTNVFEEWLVSRAHLYHVLSFLGLFGMCINGVQAAIFDRESFDNATWNGKVIGWIIGYTLCLNLFYILVPIMLRMGSAAFLNISLLTANFWGVIIGIRVFGYTIHFLYPIAFVLIIIGQLIYFVTGSMLSDSKKPWLGDNQEDGVLGFGTAKLKALNAARKAQMESETGSNES

SEQ ID NO: 24387 - protein, 455 aa, Gibberella zeae PH-1
MDDLHLAPEPHLMHRSLLTRPEAVSSASGVYLNLSSGRKILDGCAGAAVAIIGHGSTEVQDAVVAQASQVSYVHTLTYTTSSAEELADHLLENEPFGLTRAYLVCSGSEAMDSAMKLARQYHVENGQPERTRFVSRRQAYHGNTVGAMSVGSHLARRAPYEGAILLDNVSHVSAAYEYRTKKDGETEEEYSKRLVDELEAEFLSVGPEKIMAFIAETVGGATAGCITPPAGYFSGVSKVCKKYGILLILDEIMCGVGRCGTFFAFEQDGDVQPDMVTIGKGLGGGYMPIAATLVHKGIIETLKKGTASFNHGHTYQAHPVSCAAALAIQKIIRRDNLVSRCATLGERLHKSLVETFKDAEFVGNIRGRGLFWGIEFVQDKKTKMPFDSKIRFGVKVQERAFELGLAVYPGMGTADGLVGDHVIVSPPLTITEEEMDVLVGLLKRAYDDVASKYGV

SEQ ID NO: 24388 - protein, 361 aa, Gibberella zeae PH-1
MSVQIPSQQRAAVRQGSGPDARAPIKTVPVPSPGPGQILVKVNWTGLCGSDKSLLHDEWSDFGICMKDVTNGIAGHEGAGSVVAVGQGMEQRWKIGDRAGVKWIASVCGECDFCMVGSDEVHCPEQTNSGFSVPGTFQEYVVADGKYSSKLPDGVTDEEAGPIMCGGVTAYTACKRSGVTPGQWLVIPGAGGGLGHFAIQYAKAMGMRVIAIDGGDEKRDLCLKLGAEVFIDFKTTKDIATQVLKVTTHGAHGVIVTAATRAAYESAPNYLRPNGTVVAVGLPQDPTVLAGAPPMLVALRRLKIVGSVTGSMKDVEEALEFTARGLVHPILSKGKLEDLDDWVHKLATGQVAGRCVLKVAA

SEQ ID NO: 24389 - protein, 495 aa, Gibberella zeae PH-1
MSTVKITGIGGRQISVHTGLFINNEFVPAQDNATVKTENPFNGKVLADISAAQASDVDKAVAAAEKAFNGTWKLTQPTVRRDLMNRLADLIERDNEELASLESVDAGILFRESSGMFVPQAVETLRYYAGWADKVDGQSLHIPQGISYSRRVPIGVCAAIVPWNAPLMITMWKLAAALATGNVLIIKTPEASPLYGQKLGQLIVEAGFPPGVVSILCGLGIVAGSALSAHPAIRKLSFTGSPGVGRQILAASAKTNLKKISLELGGKGPSIVFDDADFENALQWTAAGITVNNGQICAAGSRIYVHADIYDKFVKAFSERTKDSVAGDPLLQETTKGPVINAGQKKRVMEYIKIGQDEKVKVLHGADDSKLPTEGHFVPNTAFVDVDPQATVIREEIFGPVACIAKFSTEEEVVRLANDSSYGLGSAVFTKDINKAIRVSEELESGQVTINMWGVVNANVSFGGFKESGFGRDCGKEAIDDWTQAKYISVMVPKL

SEQ ID NO: 24390 - protein, 442 aa, Gibberella zeae PH-1
MGVKSDSHLNHGELRTSCVFSSQDALKAEQDHSAKNYQSLPIVFSRAQGASVWDPEGRHYLDFHAASTALNHGHCHPKLVATLVDQASRLTLTSRAFHNDIYPQFARYVTGLFGYDRVLPSSTGAEASETAIKVARKWAYKVKGVPENQAIVFGAAGNHHGRTLATIALASDNMSRDNYGPLDQNISCTIPGTNRHIEYNNKAALDEAFEAAGFNLAAFIVEPIQGDAGVIVADDDYLRHARSLCDKHNVLLICDEIQTGIGRTGKFLGHYWSGIRPDMVLLGKTMTGGMYPFSCVLGDNAVMLTVEPGTHGSTYGGNPLGAAIAMRALQVVEEENLAENAERLGCVMRDGLKEIQAQTNIIETVRGRGLLNAVVIDQSKTNGHTGIGLCELMKEKGLLLKSSRTGIIRISPPLVITVEEIHWSLRIMKESIDELMQLPSAS

SEQ ID NO: 24391 - protein, 327 aa, Gibberella zeae PH-1
MVTLPSPFSDIDRVQLLFNRPTDIEPLSRLTESVNNNVKLWIAREDRNSGLAFAGNKVRKLEYVLADALAQGADTVVTTGGIQSNHMCQTSAAAARLGLKVALYPADRVASNDAEYKYLGNIQANAILGAETFPVDTAEETVITTLKDRGQKPYSIPPGASSHPLGGLGYARWAFELLEQEKKIGVTFDTIALVAGSCSTLGGLLAGLKLAQKEQIPGSKKRLIGFSVLHKSKKDVEALVLKTSRTTASKIGISPNEITADDFEINTSYIGDGYGQLNDSTAEAMKKLARKEGILTDPVYTGKAFTGLLDLAKTGYLNVSTTIVLNI

SEQ ID NO: 24392 - protein, 416 aa, Gibberella zeae PH-1
MGDLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLQIWHDASDEPDCPTTFNFDFEVVEDVGQMRGMILDEVQRFRQNVRTVPGQSGGGLQGQGVPVPLPQGNGQWTAEDPRPQEYAGHGNTGLEQDLQGGLDASRR

SEQ ID NO: 24393 - protein, 294 aa, Gibberella zeae PH-1
MSNEEITHPTIVDGWFREISDMWPGHAMTLRVEKVLVHEKSKYQDVLIFKSTDFGNVLVLDNVIQCTERDEFSYQEMIAHLALNSHPNPKKVLVIGGGDGGVLREIVKHDCVEEATLCDIDEAVIRLSKEHLPSMACGFDHPKSKTHVGDGFKFLNDYKNEFDVIITDSSDPDGPAEALFQKSYFQLLHDALREGGVITTQGSESPWLHLPLIARLKKDCGAIFPVAEYAYTTIPTYPSGQIGFMVCSKDPKADVKNPIRSWTKEEEDEKLRYYSSEIHKASFVLPKFAAKALE

SEQ ID NO: 24394 - protein, 502 aa, Gibberella zeae PH-1
MSPPSIPLIAPNGVKWSQPTGLFINNEFVSSSSSRTLTSIDPATENEIATVQAADAQDIDKAVKAAKAALRHPSWKDLPASDRGQLMARLADLIEAKRELFATIDAWDNGKTYIETLENDLVEAVGVIRYYSGWADKTFGQTINTTPQKFAYTIRQPIGVIAQIIPWNYPLSMATWKLGPALACGNAVVIKAAEQTPLSLLVLGELIKEAGFPPGVVNIVNGLGKDTGAALVQHPLVDKIAFTGSTATAANIMGVAAKTLKNITLETGGKSPLIVFDDAEMDQAVKWSHFGIMSNQGQICTATSRILVQETIYEEFIKKFIDTLNTVSKVGDQWDKTTYQGPQVSKVQYERILEYIEIGKKEGATLAAGGGPLKINGSDKGFYISPTVFTDVKPSMRVFREEIFGPVVVVSTFKTEEEAIELANDTTYGLGAAAFTTNLEKAHRVAAAIEAGMVWINSSQDCDPRVPFGGVKQSGIGRELGEAGLEAYTQIKSVHINMGNRL

SEQ ID NO: 24395 - protein, 143 aa, Gibberella zeae PH-1
MITDSYPIKEVDDVIFEVDCDAIYPESVAGDDEPDEFNNVIYSFRLQPTKYDKKDYVSSLRSYLKIVKNRLKNIGKNPEYIANFEKNAQDFLKTKLLPNFDDLEFYTGESMDVDGMIAVMGYREDGTTPYFMFWKDGLEEMRI

SEQ ID NO: 24396 - protein, 246 aa, Gibberella zeae PH-1
MSGLWAQVVTQYGTFKVEIIGSLAIQVLFWWVPSAGFVLLDRLAPSFAAKHKIQPAPKQPTSSEIFDAVLISFRNQLIITGLQVTPAILSTRSSAFQITPSLPSTKDFILHFLICLIAREILFYYAHRLLHLPYLYRRIHKIHHKFTAPVSFASQYAHPVEHIVANTIPIVLPPVLLQTHILTMWAFVSWQLIETATVHSGYDFFGGAAYRHDRHHERFNVHFGGMPWLDRLHGTDEIEGLVKKHN

SEQ ID NO: 24397 - protein, 499 aa, Gibberella zeae PH-1
MANPFQRPFQLENESLFHCTSLINGDFVSAKEGKTFNVVDPGSGKTWASCPDCTASDVDSAVASSYETFKTYSKTTPRFRAQTLMKWHNLILAAREDLARILVHETGKTLVEARGEIDYALTFVWWFSGEADRAHGTSMSCAIPGRRAVTIKQPIGVAAALVPWNFPIALALRKAAAALAAGCTMVVKPSPETPLTCVSIAHLALEAGFPRGALNVVTTSLENTPTVAEALCLDARVKKVSFTGSTRVGKIIASFCAPNLKKTTFELGGNCPFIVFDDADVGQAVSQLMPLKWRHAGQACITSNRVFVHSSIYDTFVEKVVQETRGLKLGHGMEEGSTMGALTTPRGLDKAEELYQDAISKGAKTVLGTGKREEGQGYFMAPTILTEMEDDMLMTHEEIFAPVLGFYRFESEEEVVQRANDTPLGLASYIFTKNVDRLWRLFENLDAGMIGLNAGNSSSAEAPFGGIKDSGHGKESGKDVAIDEFLITKTATLTIDGHY

SEQ ID NO: 24398 - protein, 285 aa, Gibberella zeae PH-1
MFPLPSTTVLVTGANGYLGLHVLNQLLRDDKTVCAVVRSDKAIETVRANFKAYIESNQLRIITVEDLTKPESFQNVLDETIASIAHIASPCPMGKNIRDNVRDMLSPAITGTTPILNAAKTYASPSLRRVVQISSFSAMLDLSKGSRPRYVYTEADWNPMTYKEAMVKKNKPRLDIVCLCPSTIFGPHIETIDSMVRLQLTASLLWNLVNAPEVPSLDFAGAVDVRDAALMVVAAIDKPEAGGRRFLLAEHFDWQSAANAARDGLSNEGRSRIPAGEPGFNIGHW

SEQ ID NO: 24399 - protein, 441 aa, Gibberella zeae PH-1
MHISNLLSAATLCALATSVAGNPKPHNDLPKRPHVVAAPYGTGKAFPHSPPRSTKDLCYVKPTKGKKKDDSPRILKAFKKCNKGGTIVLDKNYDHRFATGLNMASDPYYWAENSFKYDFQNMSSFWKIGGKDINIYGDLSNDQSVLDGHGQDYWKEYVTNKTLMRPILLTIEDAHGLTMSNMRMRNSPNWFNIIINSTDVLISDLDLRAKSTDGVKIANSDGWDTYRSDRVVIQNSYIDNTDDCVSFKPNSTNTVVQNLVCNGSHGISVGSLGQYKGKVDIVENLYIYNISMSNASDGARIKVWPGVESLFQDNLNGGGGLGRVRNVTYDGFYHENNDNAITITQCYGQKNQTLCNQFPANLTIEDITMKNFWGTVSKKFDPRAGSLVCSAPDRCSNIVAKNITVGVPSKKPPVYDCYNLDESTLDITCQDPTTDRDMTNG

SEQ ID NO: 24400 - protein, 1034 aa, Gibberella zeae PH-1
MAEIKIDSKIFQERISHFATAWKNDLRSKDGLFNGAQSLVVMMGKVEEVPEFHKNNAIHFWLLGYEFPTTLMLFTLDTLYILTTAKKAKHLEQLKGGRFPIEVLVRGKDAAENEKLFVKLTDKIKEAGNKVGTIAKDTSRGPFVDEWKKVLAEHCKEVSQVDISAALSTYAFAVKDESELRAMRTASKACVALMTPYFLDEMSNILDAEKKVKHSTLADKVDKKLDDTSFWKTVQLPSKGKLPSDLDPAQLDWILGPAIQSGGKYDLRFAGESNDDNLHAGIIIAAMGLRYKSYCSTIARTYLVDPNKAQESSYKLLTLIHNTIIKEIRDGMTAKEVYGRAVGIIKSKKPEMEKHFLKNVGWGVGLENKDPTLVLNAKNQRVLKDGMTLIINTGFQDIENPHPQDKNSKVYALVLTDTIRVTSSEPVVFTAEAPTSADANSFFFKDDEETEPAPKKEKKDSRVGAVATKNITTTRLRSERTTQVANDDIEKKRREHQKELAAKKQREGLARFSESTNDQNGGEVKKFKRFESYKRDNQFPVKIKNLEVVVDSKNSTVVLPIMGRPVPFHINTIKNASKSDEGEWSFLRINFLSPGQGVGRKDDQPFEDASAHFVRSLTFRSSDGERYNEIATQISNMKRDVVKKEQEKKDMEDVVEQDKLVEIRNRRPAVLDNVYIRPAMEGKRVPGKVEIHQNGIRYISPLNAQHRVDVLFSNVKHLFFQPCQHELIVIIHIHLKDPIIVGNKKKTKDVQFYREATDIQFDETGNRKRKYRYGDEDEFEAEQEERRRRAELDRLFQGFAQKIAEAGRNEGIEVDMPIRELGFHGVPFRSNVFVQPTTDCLIQVVEPPFMVITIEEVEIAHLERVQFGLKNFDMVFVFKDFTRAPYHVNTIPVEFLDQVKDYLDSSDIAYTEGPLNLNWPTIMKTVTADTHQFFADGGWSFLQADSDDDGGDPSDEESAFEMDEDEFDEESESSDEGSDFGSNASDDEGSDAELDSEDEGEDWDELERKAKKRDRESAMEEEDRGANKKKQRKR

SEQ ID NO: 24401 - protein, 253 aa, Gibberella zeae PH-1
MTSSASTATPSRPQHDFELRVEEVKSPKSDINALILDYLTMEGYPNAAANFSKEANLVPHQETPSIIARQEIQKCIHSGNIQTAIETLNDFDPEILDEDKALHFSLLRLQLVELIRTCNTPGGDIGPALKFATEQLGPRAPTNNKFLGDLEKTMALLMFPSDSLEPELAALLKPELRLEVADNVNRAILERQSQRRESAIRQLVRMRVWAENTARDKGKSLPEYLELGLYNDVPDLGRLPPQTRNGHDPMITT

SEQ ID NO: 24402 - protein, 1535 aa, Gibberella zeae PH-1
MDAATQHQVKTPEEAVARIAYLSSDVIVSVQPAIGTDSEFSSHLNRYAGRKDSSLVAQSADTVPEIIPVRHNTDPLLSVYTPTRAGKLVSVTTTSTILLPSVSHLYKLANYPVVLHVSLQPRTFPDYSVITAIRNSGFTFVQSETLQEAQDLALTAHALAIRTGKGVIHFFAPSTSANDKPIGVEDASVVRDVLDIESVRRYQAGSAPSSQTGIYADDGHIAVSSDHDAPATTGAASGNLTVPPSANASKAPSAGTSVKSSQDSESSTPVAPSSVATTVESAPPQVTSEDIYKSAGRIWAHLKTAVGREYSAFEYSGPPNAENCLFIFGSDAGAFAQAIDEANTQEIFANTAILTPRLYRPWLGSRLVEAIPRSVKRIAVLEQIHRKTTKWGPLLIDVLTSVKSGPGGVEAIVGHQLGYIAPEVVVQALRGVLQNLTAEKPIQNLEVGKKEAWKEPTGYDLKAPQLETAYTKILDQLFGQRAYVANAIKSSTTGISPTVSASPEFGFGSLLARKQRRGQFVSQVKDAATNGSFTTEAPKSWLARWAMNADDASKSTEIADDVIARLETDGSPLAAQLLTAKGLFRKESLWLTGSDAWSYDLGNSGVHHVLASGENVNMLIIDSTPYSERAAADANRRKKDIGLYAMNFGNVYVASTAVYSSYTQVLQALLEADKFEGPSVVLAYLPYFGETDSPLTVLQETKKAVDTGYWPLYRWNPENEKKGEPNFSLDSELIKQELKTFLARDNQLTQLASKEPKFAAALVKDFGSEVRAQQKRKAKDAYNQLLEGLLGAPLTVLYASDNGNSTTLAKRLASRGRARGLKTTVLAMEDYPLEDLPTEENIVFITSTAGQGEFPQNGLPFWDAIKDNTDLDLAAVNYSIFGLGDSHYWPRKEDKIYYNKPAKDLDRVLTNLGGKHLIDIGLGDDQDPDSFQTGYKEWEPKLWAALGVDKVDGLPDEPPPITNEDIKVASNYLRGTIVEGLNDTSTLAISAADQQLTKFHGTYMQDDRDIRDERKAQGLEPAYSFMIRCRLPGGISTPQQWVQMDDIANELGNETMKLTTRQTFQFHGVVKSKLKPAMQAINRALMTTIAACGDVNRNVMCSSLPTQSKYHREVFACSQLISDHLLPSTSAYHEIWLTDDDNKKTQVAGDAVQDFEPLYGPTYLPRKFKITIAIPPHNDTDVYAHDIGLIAIKGEDGKLAGFNVLAGGGMGATHNNKKTYPQTGRMFGFCKTEDVHIVCEKIMLVQRDNGDRKNRKHARLKYTIDDMTVPVFRSKVEELWGKKFENERPFEFKSNVDTFGWQKDEHGLNHFTFFIENGRIEDTPEFQMKTGLREIAKSLKGESEFRLTGNQHLILSNVADEHLDDVKELMKKYKLDNVQFSALRLSSSACVAFPTCGLAMAESERYLPVLISKLEGCLEENGLRQDSIVMRMTGCPNGCARPWLAEVAFVGKAYGAYNMYLGGGYHGQRLNKLYRQSIKEDEILDIMKPLLKRYALERNEGERFGDFCVRSGVIVATTDGQNFHDNVADEEEDDE

SEQ ID NO: 24403 - protein, 320 aa, Gibberella zeae PH-1
MDDYVSESDSDYTSYWRDWFISSRGNEYFCEIDEDYLTDRFNLTGLNTEVQYYQYALDLVTDVFDLECDDEMREAIEKSARHLYGLVHARYIVTTRGLSKMLDKYKKAEFGKCPRVMCHSHPLLPMGLSDVPNLKPVKLYCARCEDIYNPKSSRHAAIDGAYFGTSFHNILFQVYPALIPTKSVDRYVPRVYGFKVHASAALIRWQSSKRDEMRRRLRKLEIDTGFRDEMEDEEEDDDEELEFEGIDGRMAVVEGLYALSVQLTGRGSPAGWISIISQGVTILLLSFLLVRFWIGVWRQVNVGQNWQGWYKPQMGEIVFS

SEQ ID NO: 24404 - protein, 489 aa, Gibberella zeae PH-1
MALADKLDVRRIAIIGAGPSGLAAAKYLLAEKKFSKVRIFEQRATAGGVWNYTPLAREQGFSVPRTQPSYAADQALWPNDHGDVEFMSPIYDLLETNIPHSLMRYSDKEFPKGSSLFPRHSVVLQYLKDYAQEITPHISFQTQVLNIDKPRSDHSQSWSVEVLDLKSNKVIKEEYDAVVVASGHYNDPFIPDITGLTEFDKKYSGVISHSKFYRRPNDFKDKKVIVVGNSASGVDVSAQLSNVAKHPIFISEKEKSTVVAPTKEPWAAGVPEIVEFLPEQRGVRFANGQVENDIDAVIFCTGFHYSYPFLKSLDPPVVVPSGGHAAHLWEHILYTADPTLSFLSVPQRIVPFPVAEAQSAVIARIWSGRLSPPSEAMMEAWVEEQHEKKGEGKAIHVMAFPEDVDYVNRLHGLSKAAPRAPELGLENEGQGKLPPYWGLDKRWVRERVPKIKLASRAAGEKRHELRRLEDLGFDYEEWKRTVEEGERLF

SEQ ID NO: 24405 - protein, 477 aa, Gibberella zeae PH-1
MSAKLHTVPFLINGSDHVSETTADVVSPVNGEVTHRYSSADVKDANSAVDAAAEAFKSWRKTRPSERRDLLLKVAEIMERRQEELRGYAMTECGSDAAWASFDVNTGISHIKEIAGRVGTIEGSIPTVADPNTTALVLREPYGVVVAIAPWNAPYILGTRSVLFPIAAGNTVVFKASETCPRTFWAIGDIFREAGFPDGVLNVIYHERANAASVTTALIEHPQVKKINFTGSTPVGRLIGKIAGENLKPVILELGGKAPAIVWEDADLDLAALQCTLGAFINSGQVCMSTERILVHKNIKDEFEKKLSATIDQVFSSAADAPILVASAPVEKNKALIKDAIAKGASLAHGDVDAKEVSNTRMRPIVVRDVTAEMDIYKTESFGPTVSLISIETEEEAIKIANDTEYGLSSAVFTSDLQRGLRIAREIESGAVHINNMSVHDESGLPHGGAKSSGYGRFGTSAGLEEWTRTKNITFKN

SEQ ID NO: 24406 - protein, 318 aa, Gibberella zeae PH-1
MVQFGSRANTNMTGLPTEQAVEDRRVGNPKRDRMRNALVIVLGEFCGTFMFLLLSFIGAQTALVTNSPSDAGSPLLPFSLMYIAASFGTALAVNVWIFYRVSGGMFNPAVTLGLVLVGAVTPIHALLIIPTQLVAAITAAGITDALLPGKLLVTNALGNGTSVAQGVFIEMFLTSQLVLTVYFLAVEKHRSTHLAPIGIGISVFIAHICATNWTGTSINPARSFGPSVVAGFHGYDWIYYIGPFMGSLLAFGCYKIFKVLEYQTANPGQDDDNLDRSGHHHFFGHRKEPMPHTHTDNIEPKDHGVPQRNDSVIDDQMV

SEQ ID NO: 24407 - protein, 338 aa, Gibberella zeae PH-1
MAEQMQAWQAAGPGTFESVFKHHPSIPKPTPESLKPGQILVQVSRAALNPADYKVIELGLASRALTSYPKTPGMDLSGRVVAVAADVTDTKAGDYVLARASPLKAFGSLAQFTVCDKEGYSVIPEDMDLDQAAGVGTAGLTAYQSIQPYVKAGDKVFINGGSGGVGLWGIQIAKALGCHVTVSCSTGKAELCKSLGADEIIDYKTSDVMTELRKRGKVFSHCADNVGDSPPNLYGASNDYLLPGSSYVFVGGHVSAKSFISLSAGIVRPAFLGGVKAKFVSYMTVNKTKDLNQLRDWMVEGKVKTVIDSTFGFNEADKAFESLKKGSSGGKIIVRVEE

SEQ ID NO: 24408 - protein, 1112 aa, Gibberella zeae PH-1
MADIMIPNVRSPLSEASNRINSNHPPQEAHRYKPRHDRPPASTNNPPRASYGHPAAYFSGRPPPTQPQSTGPKPQGNPTLKPPTDMDDDRRHSGASYDSSGSGHSKKNYKTHIGPWQLGKTLGKGSSARVRLCRHNVTHQLAAVKIVNRRMAYLVQDSSLAALSKWDNNLPEQIDGEIRVPMAIEREVAILKLIEHPHIMKIYDIWENRSEVYLILEYIDQGDLFTFINMKGRLSEEVSVYFFRQIISAISYCHSFNICHRDLKPENILISANLKIKIADFGMAALHQTDTHRLNTACGSPHYAAPELLKNRQYRGDKADLWSMGVILFAMLTATLPFDDPDIRVMMSKTKKGQYEMPDYLSPEAEDLIRRMLQVNPDRRITLKEIWRHPLVKKYAYLDNLDDLNSQPPDIRKGFQYTPVPAQDVDSQLVRQLRSMWHTFSENDLKLKLTCDEPNDQKAFYWLLYQYREQQLEDFKPEIAHSTSDYHHMKPGTWKKHPQAASLSKKTTMALTPGNQKGFEVDQVRAVDVEHQLEPPPQDAYYHREARCRPCTAVDKARRMHATRATNEESTSRMSGSVPPYVTEQGSTYQLEMARPFTPDVSELPSTVLPKTKDRHEAQVNTKRASGQAMRIALGSRYASEIFKEELRHFSSNIAKDCDEAFKSSLIEEDSIAGSLTEPDRTQYESTPISFTIDAPDESAPDILDLTAKSFSNRPLPPLPTPLQGHDERSLAPTPIGSRPTTGDSHLEELRAEQVKVAQPVILTRHAERRVVSAPAYHQKSKMNPALPSINETGAISNDKARIVSAPPHTPTKRGVDRIRGIEYLSQVENSIRVVNSPGDESPVKMPKPLNVRKKFCDSEEEEEDVMVKRASKVESTHGRESVDWQDCNSYLTSSDGKRSDSTTTDAPSKKKTFNFNFWKSNKQRDSIMSITKEPDDKEERPSVELSVVGKTNTSTKVSQSRWHESNSGPVRNIEVKQNWLARLFRVKPATDHICMTISRRRARQEVTILLREWRKYGIRDIQVDKQRNIVFARVADKNFLNLKEVSFAAEVITVIEHGKKQPLSIIRFTQERGAASSFYRVVDTMRMMFETRALVISDKNKQKMMIKTLNS

SEQ ID NO: 24409 - protein, 1065 aa, Gibberella zeae PH-1
MPHQESAPVAKTNSADFNKLSSSLPFGQQVPLSSISGPTYVTAQLLVQQIAYKLSDKIFSYSPETFDLDIALKQWASQNEKNIHGYSTEVLPLQTRVGAGALALGYIFSPDFDVTKRHIPQSLVAPSGSLQQLRGTLDQLSLLYGVSSPFVAHVAALDYSDSKGLISNYDVALRLAEDLGLGLVASTSTYEAQHMSVFATLLATLLPTLHIYDGVRVARETLRVVDALSENGIADLYSKLSAEAGKLNTRLDTAGKAVELLKLFNDELGTVYQPFEYHGHESPDVVLVAFGSVESQVSKEVLAKLSADGAKVGVINVRIYRPFIEEAFLNAIPASARTIAVLGQVKDELAVEDEATQSALYSDVLTAVAFSGKFDNEPEVLDIKYTPAQSFTPQGLVGTLHKIFNNDGEAKKLPSLVQAQQFTFWDLDSSSALNSPSVIGNLLSQESTSNVYVNEIFDNLTQGGVVRSDLRSSKKALEAPYDIDNADTIVVGDENILKEIDVLKGLADGGKVIVKLSNFKDDEVEKRLPVAFRKGLQEKSAQLFVLDSTYSPAFEKDPLFSKFLIELAFLKVALPDYTPEKIAKHILTEGHPPTLEEAIDAVGLCLRQFEVPATWAEVDADFADPNLPTTIQSNSFVVHNKEEIEETFELRDWQAAAKSLAFKEAYGTKNVLRPELAVKTSTITVKENRRLTPQDYDRNIFHIEFDLGDSGLTYKIGEALGIHAENDEEEVSQFIEFYGLNPAELVQVPAREDSTLLETRTVFQALVQNVDILGKPPKRFYEALAEFATDETEKQKLEALASPTGAEDLKRRTEVDTATYVDILEEFKSARPSFQELIKIVSPAKRREYSIASAQAVTPNSVSLMIVVVDWVDPRGRTRYGHATRYLSRLPVGAKVTASVKPSVMKLPTKDTAPLIMAGLGTGLAPFRAFVQYRAMQKAQGKEIGSILLYLGSRHQREEYLYGEEWEAYLAAGVVTLIGSAFSRDQPQKIYIQDRMRQTLKEIAKAYIQDEGSFYLCGPTWPVPDVTKVLEEAIAHEAKAAGKKIDPRKEIEKLKEEGRYVLEVY

SEQ ID NO: 24410 - protein, 503 aa, Gibberella zeae PH-1
MFSLLFLQFFEQHFIATAILLLLPIPLRAIETYLRRWRLAQAQGCQDAASKVPVKDPIVGFDFLYKVFFGKAPERYLDSTWQAFKEMGTTYIERRWSWQCVYTCDPHNLKHILASACEDFDLPEFRTSVIGHVFGQGIFVLSGHTWKHARAVLRQSFRKGNPTPFLETLERNFQAFSKHVPTDGSAFDLQPLFLAFAMDVSTEFLMGHSTNMLSDKADHTREQQFVDDYMICSEEIIQQMQLGPLHRLKFNFAANRAKKRVYEYLDIFIEESLNSPRQGSKVSFLTDMMAIAGDRKGLSDHILHILLASRDTTSSLLSNLFFFLSKNPRIYNKLRDQVLNVAGHEPPTASQLKELTYLKWCVNESLRLHPVIPTNARVAVRDTTIPRGGGADGTSPLFISKGTALFYNVYAMHRNKDVFGPEPEEFIPERWEDLRPGWGYLPFNGGARACIGQQYALLETHYVVARMAQTYTLLESRDDGDWMEFLDWFQWSIWTEDLMGANR

SEQ ID NO: 24411 - protein, 489 aa, Gibberella zeae PH-1
MPQHIRRVAVIGAGPAGAIATDALVKEEAFDTIRVFDRRIVVGGTWVYTPHLPPKVPSLDALVSGEADKRVPIPEYLPAVTPFNERVNSHQQRYSDTPIHENLHSNIAPEIMGYTEEPLPNKLSQQTLKEYGPGAPFRHHTVVRQWVEDLFIRGDHDKLLELRTTVELVVKEGDEWVITLRKVVNGSNYWWKERFDAVVVASGHYNIPWFPVVQGFLDYNQRFPGKILHSKHFRGGQHYRGKRIIVVGASVSAIEVMYEILDFIDGPLYASVRDEPLEYYGWVPLEHPKISVKPAIDRMDPRTGRVWFTDGSYLDEIDHIIYGTGYTFSFPFLPAVQERVKKAHRRLPGVYQHTWDIEDPTLTFVGMIGSFTFKAYEWQAVAVARFLAGRSQPLPLIEDQREWERQRVAERRGGKAYYSIGPDYESFFEWFREFAGEPVRGTTGRVLPPFEPRWLAIWGSMFLPKLDRWRWKKKEAEWKQEFKAKLSRI

SEQ ID NO: 24412 - protein, 1088 aa, Gibberella zeae PH-1
MTATIQKRIVVVGLGMVGIAFIEKLLKYDAKSKEYTITVVGEEPYLAYNRVGLTTFFEHRKVEELYMNPSEWYLESEASLNYHINTKATHIDTDNKLIECANGESYPYDILVLATGSEAILPRTLKGWDSNGVFVYRTIDDLNKLIKFSGDKQGTNGVVVGGGLLGLEAAKAMLDLECYNKIDLIERSPWVLSRQVDETAGKMVADQVQQLGVNINLGKGVSSLKTDENNNLTGVVFDDDSEVDCSTLCFAIGVKPRDDLARAANLEVGQRGGIVVNDDLRTSMPDIYAIGECASWRGMAYGLIGPGVAMAEVVAFNLTQAKLHSPQTFKTPDMSTKLKLLGVNVASFGDCFADRDGPITLPRKYAKNLVNGDAKSPKSVQALTYRDPFSNVYKKYIFTKDGKYLLGGMMIGDVCDYVKLLPMVKSQKELDVSPSELILGAKKGEEDSDDLDDDAQVCSCHNVTKGDIVKVIKDGTCKDIASIKKCTKAGTGCGGCVPLVTTIFNKTMASMGQEVTNYLCSHFSYSRADLFNIVMVKRLKSMNEVMREVGNDKNAVGCELCKPAVASIMASLWNRHVMDKTTHGLQDTNDRFLGNIQRDGTYSVVPRVSGGEITPDKLVVIGEVAQKYNLYTKITGGQRIDLFGAQKQDLLDIWGQLVAGGMESGHAYAKSLRTVKSCVGSTWCRFGLSDSVGLAVRLEERYKSIRAPHKIKGGVSGCVRECAEAQSKDFGLIATEKGWNIFVGGNGGANPRHAELLAKDVPPTDVVTILDRYLMFYMRTADKLQRTARWIENLPGGIKYLQEVILEDKLGINASLEAQMEELVDSFFDEWAEAIKTPAIANKFKQFANTSDTTRNMELEDDRGQKRPAFWPNDAAAKDDFQGLKDKWSMTAWEPIIESSYFDGADELPNGISATIKRGDTQLAIWRIKGVYYATQQMCPHKRAFILSDGLIGQEGHKTEQNGDKAGAAPWVSCPHHKRNFDLENGACKTDESMSIATFPTEARPDGMLYLKLPPVDELDSALGTKKWMVKKGEAGEAPLAKLDSKIKFVGIRGKKPYVKPTGQSKMTTKPMDLMMASNGCGGGAPEW

SEQ ID NO: 24413 - protein, 321 aa, Gibberella zeae PH-1
MTGLNYDPEYFKAIGSPPKGPRADPPKTAHEMRSNIENTIGIFVTNSPYPSGVKETVYKVKSLDGTEIEVTRFTCEETLASEKPTPAVVYFHGGGFVACTVPPFAPQIARFANDSKLPYFAVDYRLAPEHPAPAALEDAWAAIQFVSKSAAEFNIDPARIALYGDSAGGGLTAGAALMARDRHLDPPIAKQILIYPMLDDRYNLKDDDPYLEVLAMRPAGAKVAWDAYLSKLREGDDAQALSYAVPARAATLKGLPSTYIDIGSLDLFRDESLRYANRLADEHVEVEFHLWPGLPHGFDGLRELSWYTRATESRVSALKRM

SEQ ID NO: 24414 - protein, 485 aa, Gibberella zeae PH-1
MRLHLTLGFLAALAITAIDAVSLPQDVPRDVSGFRKKHPYTPPMHEHRKIIRIRSSKNHQDDVSKDFERGIRQADRGSTLYLPHGQTFVIGKALDLTGLSDIHVRLDGEIRFTDDVEYWQENAWYHPFQKSIMFWKWGGQNIKIYGSGVIEGQGYLMANGSRQRWWNEFEAGTGSILNPDNKYYRPILFYAENTTNLDISGIHLKDSPCWNNFIVSSKNITYTDVVATALSNNGSIIPKNTDFMNTMNTSTVRIERTWVNIDDDCFSPKPNSSDLYVNTMYCNGTHGQSMGSLGQYKGEVSNVHDVHIENVWMLNGDYSGARIKVWAGNETGTGFVNNVTFKNFWVARMDYGIFLDSCYFNKSADECNAHPSGMQITNIHFENFTGYTSGVYGNAVARLSCSSAEDAVCANITLKDFDVKSPCGGEPIVICDGMHGDVGVDCVPYESDEAQMALKAKCKIPLVPIDTDPWGSGLIEKKNCAFHPE

SEQ ID NO: 24415 - protein, 379 aa, Gibberella zeae PH-1
MTKLGFVLLAALAGSAAAAPSAPAITQAPEVHAYGKRATSCTFSGSDGAAKASKSQASCATIVLDSVAVPSGVTLDLSKLKDNTKVIFKGTTTWGYKEWKGPLMKISGNKITVEGSGAILNAGGEKYWDGKGGNSGITKPKFFAAHKLTDSKINNLYVKNTPVQAVSINGVNGLEINKFTLDNKDGDSQGGHNTDAFDIGSSTGVTIDGAKVYNQDDCVAVNSGKNIIFKNGYCHGGHGLSIGSVGGRDDNVVDNVQFLNSEVANSANGIRVKAFKNHTGKINKVTYSDITLTKIQKYGILVEQNYDGGDLHGDPTSGLPITNLTLKNIKGKNAVDAKGKNAAIVCGKGACTNWTWSNVQVSGGKKYDSCQNVPSVASC

SEQ ID NO: 24416 - protein, 379 aa, Gibberella zeae PH-1
MSTESKLWQPLKLGNVNLSHRIALAPMTRLRNDDDHLPLDSVIQYYSDRAGIPGTLVISEATGISKTAEAAPSTPGISSRDQVQRWKKVFDAVHEKGSYMFMQIWDLGRAGDPNYLKSRGYKYSSSSDIPMEGYPVAPEALTEKEIWEKIDEFRKAARNVIDAGGDGVEVHACHGYLIDQFISESVNNRTDKWGGSVENRARFLLEVVKAVTEEVGAQRTAIRLSPFATFQAAYTANPWDQFGYIIAELKEAQYKLAYISFVEPRGNPAQTDMTIHTLPGDNVNPWGDKKPSLDHFLEMWDNQSPVIVGGGYLPENVSAAVDGSYKGWDVVVAFGRWFTSNPDLVYRVKNGIPLTPYKREYFYAAKMRDLLKPPRPNGR

SEQ ID NO: 24417 - protein, 397 aa, Gibberella zeae PH-1
MTLSKTTTTVNPESRLFKPIQVGNAKLDHRIVMAPLTRYRNDDNHVVKPFVERYYAERASAPGTLVIAEATGVSMQDTGMRQGPAFVTDEQVAGWTKVISAVHEKKSFWAQQIWGQGRASDPEYQKERGFKYRSSSAVPIEEGAPAPEAMTEEEIQQFIQDMVATSRRVIDAGGDIVEVHAAHGYLIDQFTSDSINKRTDKWGGSVENRARLLLEVIKAVSAEVGPEKVAIRLSPYATFQGSESSDVKEQYTYIVSELKKIGALAYLSLVEARGDPAKLLAPDQDASTDSKTLDFILDIWDNTSPVIVAGNYSPESAAEVLDGHYSKWDVLVAFGRHFIANPDFVWRVKHGVELTKYDRTTFYVRGSEIGYNDYPFSQEYVNEQRAWAVKNLKMHAK

SEQ ID NO: 24418 - protein, 1573 aa, Gibberella zeae PH-1
MSHLLWKYYWENDVERFRRLLAPTSYNAQSVSKSPAVGGSGSFFGGSPGIPGTSPRPAAKQRRTSGHPQTPGKSRDNNTHLGRTEVNSRDHAGLTILLRAASSTDPNAYEFVRALVEHPAIDLYVQDPESGWNALHRSLYAGNISIARLLLEKERVDLTSHNLNAVNKVGLLIKTKDHEGNSPFDVYNSTIAARSLKNMEDGNSSDSDAESIDSGGDDLHHMVKASHGLRKSIDGDELFVFGSNKNRSLGVGDEDDRQYPDRIYLSRPDLLVHRFYHSHLEEQDIEAPSSLNLDEIPTLVRNRPIVIQDVHPVSNLYICGVGRGGRLGLGDENTQFKFVPVQGPFLDKKIHQVALGQNHTMAVADNGELWTWGLNSASQLGYALPAPLKADEEPMSLTPRQVFGSLKKEIVLGVAASANHSVAHTGASLFTWGRNVGQLALMDADSRSLDIQHTPRKVAASLLAAPIEMVSAIDKATICLLSNHTVWVFSHYGYNLVRFPFPDVFSNNITMTRYESGGRREINFITAGGETIAAVTARGDLFTLHLNDKGDSSQSAASTTNPVKIKNALAQPQCIWDSRKDGVASVGVGEDGSVIICTESGAVWNRVKRTKGKLTGFAGSNGIKRKDVKFQRVPYITNCVAVRSSIFGAFAAIRKDSKVMAQEIEIGAKSLRDDIGSLLCLNDFEASRHQKPRKVWEAAITRERRDPVTYEILRSADIETDLRRWLDMSSFQYDNMNMAICSSSLPDMKIPVHSWVLAGRSSVLRHGLTELRDRGSTFSTDTFRIELVGEKPLLTLFDVDIYTVLNVVVHAYQDKFVPVWKYTREAPPLAFRFRHVRTELMKVATYLALPRLEAAVRLQTGVEDSLDDDFKQAISDTSFFDDADIIIELDGEDIMAHSQLLCQRCPFFEGMFNGRSQGQWLAERRDGMDAAERIRVDLNHVDPETFHYVMSFIYADVGQELFDNVAMSNVDELSELVLDVMGVANELMLDRLSQICQALIGKFVTTRNISNLLNEISQCSITEFKDTGLEYICLQLESMLENHLLDDLDEDLLIELDNVVRDNQLARFPFVRSGRAELLLHESNPELAADIDEERQARIKEMAYKTTQRDEEKKLSSSFKTRVGSLDEASPLQTPDTIRRKSRGGRNEPFSPSLRPKQSQADMIFDMEDEYGSLSAKPRSPTNEAAKLRSPPDTDDIPQLPKTWRESKGKEHAGSAHSPAPLSFSLSPDSQPSELSSLKTPGGRSFKAGVPWSSSKLATSKLDLKDIMSEATSTSALTAGLQAQKIQDAAANKPQTRVSQKERKRQLQALAAAEAAAKDESTSHVPWETVPEGGRPAPWKAASSGPKTSLKEAMSDESNMPKGVSANAKPLVASETKSKSATRRTASPDTRFPGQGRTNSSPAIVAGPSTEQPRKPLVPHSKSYITPAPKAEATLGFSMSDIIGQQQREQEAVKEAVAKRSLQEIQEEQAFQEWWDQESRRTQEEEARRKQKDAREKDNKASKRGRRGRGGKAKSTGEAVANPGQSSASGAKGGVAAGSNTNNRGSSGGRGGGGVGGSRGRGGKGRGNKSQAA

SEQ ID NO: 24419 - protein, 413 aa, Gibberella zeae PH-1
MAYEIIDNIAAEGAPYYTPAQDPPAGTQTSGSTKVFTPITIRGVTFPNRLFLAPLCQYSAKDGYATDWHLTHLGGIIQRGPGLSMVEATAVQNHGRITPQDVGLWEDGQIEPLKRITTFAHSQSQKIGIQLSHAGRKASCVSPWLSINAVAAKEVGGWPDNIVAPSAIAQEAGVNPVPKAFTKEDIEELKNDFLAAAKRAIRAGFDVIEIHAAHGYLLHQFLSPVSNQRTDEYGGSFENRIRVVLEIIDLIRGEIPETTPILVRVSATDWFEYDAQFKDEFPESWTVEQTCKLAQILPKHGVDLVDVSSGGIHPKSAIAIKAGPAYQVDLAKQVKKAVGDSVLVSAVGGIKTGHLAEEVLQSGIDVVRAGRWFQQNPGLVRAFANELGVEVKMANQIDWSFKGRGKNGHKKSP

SEQ ID NO: 24420 - protein, 341 aa, Gibberella zeae PH-1
MPQQLIGSEYTVYRSGDGNGGFTPTTVKVTTLGPHDILVRITHSGVCHTDITFCQMGAPIALGHEGVGIVEAVGSLVTQFNVGDRAGGGFHRDACGHCKYCLSGKDIYCYNRVIFGEGDFDNGTFGKYYIGKETYLHKIPEGLASEHAAPLQCAGATVYAALKATVTPEKRVGILGIGGLGHLAIQYANKMGADVIIYSTSTSKETEARQLGAKEFHLLDNMFDDVKAPIDVLVICGTKYPDWDRVMAKEFLARDGVIVPLAAPVHGPLSLPAGAMFFQGYHVFSSLVGSRNVHDEMLEFSARHGIKPMVQIFKHEGAETIREVFELVQMNKMRYRAVLEM

SEQ ID NO: 24421 - protein, 347 aa, Gibberella zeae PH-1
MTDDTHRKIWQPLHPTIRDRLDPQYVAYHEAHLQYIEPDEIKDWDGSTRTKKVSLPPGGTKPVPVGSIDDYHVGRFKVRVYTPTGQCDERGWPVLVWLHGGGWAVGGLNNGTDLCCWACEKARCLVVSVDYGLAPENPFPVAVEDSIDAVRWVASCPAQLQKIDTSRISVSGTSSGANLAIVAALSASNPEAALPTARPSLSNTIAHPPVSLLLFIPVVDNTATVDGVWKPNAEVAPWLTPSRMEWYRKLYFTQDEHRSRWDASPNLAPDTLLKKLPKTWIAIAEMDILATEASTFSQQLKGLGVNVETLLVEGGTHSILSLHGVIDRGYKMIEDAIKHLQETFGTG

SEQ ID NO: 24422 - protein, 286 aa, Gibberella zeae PH-1
MADTYGMNGHNGHVKDRRSSSMNGRNRLYAQQEPQRTTHLSEFGKHMVAASGEFVGTFLFLYFGYAGNIVAVLQEPISGPNGTLANNTVMYIAMAYGFSLLVNVWTFYRISGGLFNPAVTFGLCLSGQLPWIRALFLFPSQIIAAMCAGGLVNAMFPGSASIANTTLGPNTSIAQGVFLEMFFTAQLVFVVLMLAAEKSRDTFLAPVGIGLALFVALIPGVFVTGGSANPVRSFGCAVGSRDFPGYHWIYWVGPLLGAALAAGYFRLVKMMHYEEANPGQDSPVDV

SEQ ID NO: 24423 - protein, 336 aa, Gibberella zeae PH-1
MSRYTAAHANLQGPGDARPTALQIVKDEDLVGKLTDKVILVTGGNSGLGLETAKTLHATGATVYITARTSEKLEEAIKDIKAWPEAESSAPVYGIELQLDSLASVRAAAKKFLEKSEKLNILILNAGVMATPEGRTEDGFETQFGTNHLGHFLFFELLKPALIASSTPSFHSRVVSLSSKGHRYGGVRFDDFNFEKEPYIPWIAYAQSKTANIYFASELERRYGSQGLHGLSVHPGFIFTNLARHIDVSQIDVKGDTKNYVKNIEQGSATTVYAALSKDWEGRGGRYLADCDEEPPLKPGIDPASSAPGYASWIYNEEAEGRLWAESLRLVGLKKD

SEQ ID NO: 24424 - protein, 330 aa, Gibberella zeae PH-1
MPCHPTEPEFEVRDIPSLRGYVAIVTGETDYSGNSGIGYETTLQLALKGARVYIASRSNDRVNKAIAEMHKNSPDLDLHFLKLDLQDMQSIKDTTADFMSRENRLDILINNAGIMSSPWELTKDGHEIQWQTCFLSHHALTMSLMPLLVTAAQVSGRMDRVRIINVASDMALRMGPEAIHYDDPNLTNETGKLAPWRRYGHCKEASIIAAKAITDRYQSLGVTAYSLHPGLVKSNLQSHNPTMLGAMSRMMFKVGPSSTPLEGAMNSLFCATSHKVYEHAGRYYVPVQKLDDRANKWLDDAQAVNKLWDLATRQCREHGFIIDDIPGYYN

SEQ ID NO: 24425 - protein, 460 aa, Gibberella zeae PH-1
MKLLQLAALVASISPFASAADANAWKSRNIYFALTDRVARSDSDSGGNACSNLGNYCGGTFKGLEAKLDYIKGMGFDAIWITPVVENTDGGYHGYWAKDLYEVNAKYGTKDDLKSLVKTAHSKNIYVMADVVANHMGKGIQDHRPEPLNQQSSYHSPCAIDYNNQNSIEQCEIADLPDLNTGSETVKKVLNDWISWLVTEYSFDGIRIDTVKHVEKSFWPDFQKAAGVYAIGEVWDGSPDYLAGYSKVMPGLLNYAIYYPMNRFYQQKGDPSAVVDMYNEISQKFDDPTVLGTFIDNHDNPRWLSQKNDKALLKNALAYVILSRGIPIVYYGTEQGYAGGNDPANREDLWRSSFKTDSDLYQTISKLGKARSAVGGLAGNDQKFLKSNDSALIWSRANNDLIVVTMNRGQGFSGQYCFNTGANNKTWERVLGQGTVKSDGSGQLCVSYTNGEPEVLVAAN

SEQ ID NO: 24426 - protein, 435 aa, Gibberella zeae PH-1
MRVYRVLVSSYHNIVPVSFKTLIKIHLREGLFMVWVNDLATIDVMQLEIDPSLGKYPISGYSSVRREGVIDCFLALDLVHINQCCSHAEAAHVNLSTNIKEFNAPYSVSEVDKPKPKPHQLLIQIKAGGFCHTDCMALAGEFGSKLPFIGSHEPTGVVVEVGSEVEGFTEGDRVGCLNFDSCCGKCPDCKAGKPIYCDAPLMKGLTADGAWAEYMVSDARFAVKLPDALKFPTAACMMCAGATIYGGIKNAKVPAGGSIGIIGIGGLGHIGTQLAKAMGYQVAAIDAKQDTLDLVSSYTLKPDVCILASDPLEYSMKKITDVVKSDYPGLDAVIIATDAPPAFDLAAQLTRKHGTMVLLGQPEKGITLSYQNIIFRDIKLVGSLLADRPVLEELLKLVVEHDIQVKIKEWKIEDAEKMRQEYLTGKNSGKNVIVF

SEQ ID NO: 24427 - protein, 270 aa, Gibberella zeae PH-1
MVEPVWGPQTSYLNFCEEDYIVTRYIAEFINTLSSLAYIVYGIYGLASCDKFPTASRLIPYCGLMGVGICSGGYHMTLKYHTQMFDELSMHLLTTPLLYRLLSYNASPQRTKLVGLALSTLFTTVMITHVVLDEFLLHAISFGLGVLIIARRSIQIISQRTLDLDTRRDLRNISIAGISFFIFGYMVWLIDNWACRYLIDIRHTVGLPFAFLFELHGWWHFFTGIGGYIAVIVVDSITSNEKVDNPTSRLAWPVPLVAQLMASSVVAKPA

SEQ ID NO: 24428 - protein, 317 aa, Gibberella zeae PH-1
MSFHPDNLPSLNGKVFIVTGGNAGMGYYTVLHLAAHGAHVYMCCRSLEKGNAAIAEIKKEHPSANIDLLQMDLMDFSSTVAAAKHFLTRETSLHGLINNAGIMATPFDMTKDGHEAQWQTNYLSHWVFTEHLIPVMQRTAKTLPPGSVRIVNLTSSGHLGAPKTGINFDDLTLKDQGVWERYGQGKLANILHTKSLHNKYGPGSENKDGEIWVTAVHPGLVETNLATTVDPTEKGMLTLVSALRCFRMLWTADKGSWNSLYCAASQDMKAEQSGQYMEIFHRFGEPWWASSAAKDEELAKKLDVWTRETMGKEGWVQ

SEQ ID NO: 24429 - protein, 508 aa, Gibberella zeae PH-1
MPRSERRRGERQQREREREQDSQYNGVLHDETSPLLPRISEVSEPETSVSLTDVHSLLAEAKLLCRYSLPLIATYLLQYSFTVITTIVAGRLGAEELAASSLALTTINIIGFTIFEGMATALDTLCAQAYGSGRYTGVGMHIQRMMVLMAIVMVPVGAIWLCSHWILPLLVPQRSLALKAASFLRVSLVGLPGYAFFEAGKRFLQAQGEFGPGMVVLIICAPVNAFLSWYFAVRLNMGLDGAAFGQALANNLRPALLLLYVILIGKKSHRCWGGWDARAAFAVREWGPMIRLSVASTAVNLAEWLAFEILMISTSYIDTPHLAAQTVLNTLSIVTWHVPFSISVAVTTRFGHLVGAGALKEARRAAILYSIVFVGVGILDGAFLFLLRRPLADLFSDDSMVKDLAVGSMVTVACFQIIDSVICGTNGVLRGLAKQSVAAWVVLAVNYLAAVPFAIWLELGSPDLKLDGLWIGLGSGMVIIAGIECAYMKWISWQDCVDDVKEREDDGT

SEQ ID NO: 24430 - protein, 477 aa, Gibberella zeae PH-1
MSDITDEPDRNEAAPLLADSEGGNTGEWPTNNWWTELSLIARYTVPLVATYLLQYSFSVITTTAAGHLSPDDLAAAAIGVTTMTIGGLALYEGMATALDTLCAQAYGSGNKTGVGLHVQRMLLLMTIVTVPVAIFWISSPAFLTLILRQDDLAAKAGSFLRVSIIGIPGYASFEALKRFLQAQGDFNTAMLVLVVCAPVNALLSWLFAFRLNMGLEGAALGAAVANTLRPILLLLCIFFKKSTHQCWPGFTTRAFQDWGPMIRLSVAGSAVTLAEWAAFEIITVSTSYMGTIHLAAQTILTTTSIVMWHIPFSLGVAVSTRIGHLIGGGHVLLARRITILYGILFVGLGTLNGTILLSLRNYIGPFYTDDDAVRRVVADTMFAVAAFQVVDSIICGCNGVLRGLAKQSVAAWVVFIVNYLAAVPIAVWLELGPLQFGLKGVWSGIIGGCATIATIEIVYMIRVDWRKSAEIVKSRED

SEQ ID NO: 24431 - protein, 1434 aa, Gibberella zeae PH-1
MIHQPLPNLISHIHHGRIQQIAMKLSRLTLYMTLTAGCRGAYVQFQDCSEAHDSSSLIPESFRASVERGRDTFDWKFDFIAGLTNRNSCEVDLSNIVPRFSIVDHGNDTPYISGQIVNVSCLTSQRIGSRSKFTIITSFNRSTLLETYKTTFELTNSNNTALSCIKAVLTPAVPGPIRILGLWFPIITFALACVAACWPVRRGPGPNSSKNSLVARAIDVLAYIQFIFFSGSMSLKYPGFFQPLVGLSGWSTLMLPAGVVESRSPYARQGVNDGIYEHNGTITGAPGLELLTQMTGSAVKPQSWMNTFVLSLFVFVSLYIFSFIIHRLGNTNSNARSASANLESSFRTPYWAVSTVGFLPGGTGHSGKILVAYIALCGHVIVLVCIFLIPTLFDLSKLAFGREPAVLSDIESDMQSTTADTLFGGNNELVKFSSSKSSVSNKTLWDMILSRETKMFGDKTVSRIQPEVLSLFMRKVQGEDEHTNVCEISRGFNGSSNTLVGSTQSDEEIKSAVDVSPDALASYLVCKGNLALPTAPTYQDLDRPINEYFISTSHNTYLLGRQVATRSKLEGYIEALSKGCRSVEIDCWDGLNGQPVVKHGYSLTTSVSFRSVINAIKEYAFVSSDMPLWLSLEVHCCSSQRDIMAQVMIEVFGSSLITEPLQGCLDTLPSPSQLRGKILIKAKMPQDMNTKDSDKEGRDTVKLDQTHNDAGSMPEKGDESAAVTNQLQRKGLQEDALQKLAIYGAGKRLPHPDAIDSHRNFIYSMSETKLSKRISKEKPLGLIGTQHMVRVYPDPNRVDSSNFNPIKCWQHGVQMAALNYQTPDFNMRLNDAMFTGSLGYVIKAQPEPKQIRIAVDVLLVGGIHGLGADSPVYVELELILPDMPSQRVRTTAVSTHGAGTVFDQNLDISIGTKYPHLAFLHWSIKSLSNSRPMSTQSGIAKVSNLKKGYRILPLGVTEETGGFIFCTVTKTTVAVTEFTRDCREARSDLTSINGELSQLQLVLELLRDDTAVSDDQILPESLQEQILSIIDNCSAVVSKINLVLDNHSGKVGVLKWATFGKSEVAGLRMSLEAHRGSLNLALELVSVSLSKAIKSDTAAIRTDVHDIKQDTSQIPQIMDELNRLRVIVAGGDVPAATIGQNYILQQYLDDLTSYAETVCNDVEWETDSSVHALSRSSSPSGPRIESSAPSAPVIQLETSADAGSQVASLPNTDTQVCNEGDKTYLQPTKIVSTLDTSKTTSQAKKKIVLVGDSACGKTALCRRFLEGTFLATEFQTIFETYAAHIDGVDLSLWDTSGMDDNDRLRPLSYPDADAVLICFSFDYPDSLENVVEKWIGEVMYFLPGVPCILVGLKKDLHYDEKTIKELRKYDQQPVTWDQVNDTAKRINAFRYVECSAKTGDGVKEVFDILVGPFFPAVKKRSNALKSMFKRWSSK

SEQ ID NO: 24432 - protein, 487 aa, Gibberella zeae PH-1
MGSDPQYAKWPLLPLSQHVFTLTNGYATKNAQQASVKALQDAIAQDKMAPFYRYLAHPLDGVLNTVGEGGASAPGRPLSRKSSLVGMIATKPAAANISLPWDEGLYNQLKEDNDRELEEIQKEEDDAVEQAGDTEVMAAQGKRAEFWARVGDKDKAIATYESLFEKTGILGTKIDLVLAIIRMGLFYGDKPLVKKHVERAKGLVDTGGDWDRRNRLKAYEGLHLLTVRSYNLAAPLLLDSLSTFTSYELCTYSNLVVYSVLAGSVSLKRVDFKSKVVDAPEIKAILGDGDDKLLALSGALSAGPGADDTVGAKAPKTATAAVNLTTLGTSTDHPEAEMAIDFSPLALLVSSLYKGDYKAFFTSLANVEEQFLNQDRYLHEHKNWFIREMRLRAYQQLLQSYRVVGLESMANDFGVTVDFLDRDLARFIAAGRIPCTIDRVTGKGVIETNRPDDKNKQYQDVVRQGDQLITKLQKYGQAVRLRGSERA

SEQ ID NO: 24433 - protein, 367 aa, Gibberella zeae PH-1
MGPYGAGIHPVPMIETNNTLSNPTGPEWQFLVGEGTYTLKEDLHLATPPPHPSEATVPNPNPLSTLPQPASAGTSVSLVALECRPAPNLFYKGLSSTTLALSGAPSSIQEHPNEGRYSAEGGVASEDGRTGSTSDAAAASASITIGSAPAFGEGNALLTQAPTKDVNKKRKPKNNMTKSNSSFISRVIVNESLSKKLTERPNDGIFAFANINRAFQWLDMSSSTKGAINGTPVAAIRWIPGSENLFLAAHMDGSLVVYDKEKEDAQFNPEEEAVNGMANGASGESLDANNMGTHHNTIRINKSVHSKNQKVNPVAAWKLSNHRINAFSFSPDNRHLAVVSEDGSLTFSTLIMAGSPAFAGPQTANTC

SEQ ID NO: 24434 - protein, 387 aa, Gibberella zeae PH-1
MAQRKPLSEVLPPLILGTATFNVQYHPDPKHMPYTDIVGRALAHNILAFDTSPYYGPSEILLGDALRKLTPPPPREGYFIITKAGRIAGDEFDYSPAWINYSVCRSLERLGTSYLDLVYTHDVEFVSPEEVLAAVTELRRLRDLGLVRYVGISGYPVETLASLAEMILRETGEPLDAVMSYSNFCIQNNKLGNQALLDRFKAAGVDCLPNASMLGMGLLTTRGIDNSPMRAWHPSPPELRDLCAQLSAIAQDEGEHLEEVAIRWALENWARVGSQFGTHLNPSDTGRLGVSVMGVSSVDELEETWALWTSVVGLVGDEEAEQRKAKIEKIVNEKMWPTLGSWRNHTWVSGGPGFVNTRAVEDMGVVPRDETARRWGLVPVALDTPKI

SEQ ID NO: 24435 - protein, 403 aa, Gibberella zeae PH-1
MFSLFPISPTLYHITLAAIDVSSSVAHTATPITDATPLPKLSVISKLSLKAQDQFHQKKHHHSLPSSSSSKTTTSHINKMSNYYASQQPQYPPSGAPAPTAAQNLQFFPSQYTNTASSGTPQGGYGYANTGGYGVGAPAQQNNFATPGFGAAQQGVSGRMGEQGGLRTGWVAAFSSEGYDGEPPLLEELGVNFGHIQAKTLAVLNPFRRIDAHIMDDSDLAGPLIFFLLFGFILLFSGQVHFGYIYGLAALGSISLHLILSLMSPSDIDPGTQAVNNFPQYSSDPSAPPQPHDGQHGGHFSSTLTYPRSASVLGYCLLPLVATSLFGIVMRMDTPIGIVATTAAILWCTYSASGMFCAVGQMKRMRGLVAYPLALFYVGFGIMGIFSSRGSGTFSGAATKLNA

SEQ ID NO: 24436 - protein, 325 aa, Gibberella zeae PH-1
MQRAAYAQSPPLHHPVPQHVSTVPQLRSPPPPPGSAQSQQGYAANAGGNPYQQQGGNSGNVFGAYGNFMNDPTAQVAAQFGQTAFRHGQEYVEQNLGRYVNVSALKHYFNVSNSYVVNKLFLVLFPWRHKPWSRKQAVGQNGQDGWYLPPRDDINSPDMYIPVMALVTYILLSTLIAGLNHQFQPELLGKTATISLIVVIVEIFFLKLGCYLLSISSQSQLLDLIAYSGYKFVGIIVTVVVAEILNGGKGTGGWVGWLIFFYTYLANSLFLMRSLKYVLLPETAAGVSGGPMQTDSRAKRSQRTKFLFMYSYFVQLFFMWILTRA

SEQ ID NO: 24437 - protein, 487 aa, Gibberella zeae PH-1
MQLKGVMVALLSMSVIADAAVVQRRHPLARALQRRQFGGGGGGNNGGNNGGNNGGNNGGNNGGNGGNNGGNNGGNNGGGGGNTLQGNAVQTGSQQDGNQPGSDEQAASATDDNNFINFCAGQTLTNGEQNRDGSCNGIPMGKIPAANKMVSSVFTSPQNGDNIQANQNFDISVQFINFAPGSFTNATNTYYSAPQDLDGGGNIIGHTHVTVQDTGNDLNPKQPLDPSVFAFFKGINDAGNGQGLLTASVEGGLPDGNYRICSMSAASNHQPVLMPVAQRGAQDDCIRITVGGNGGGGGGNNGGNNNGGQDGGQGGQGGQGGDQNNGQGGDQNGGQGGQGGQGGDQNNGQGGDQNGGQGGDQGGQGGDQNAGQGGDQNGGQGGDQNADQNAGDQGGDQNAGQGGDQNAGDQGGDQNAGQGGDQNAGDQGGDQNAGQGGDQNGGQGGQGGQGGQGGQGGGRFGRGGRGRFGGFNAASTDGAANSTTTDA

SEQ ID NO: 24438 - protein, 360 aa, Gibberella zeae PH-1
MFDLFPMLLSSVASFLFPIFASYKALKTSDPTQLTPWLMYWVVLSCCLLVESWVWFIISWIPFYGYFRLMFLLYLILPQTQGAAFLYDEYVHPYLEKNETQIDDFIASAHERLTAAGISYLKLAIEQFRVKVLGLPPSEPEAPPPETNQGYTQSLLSRFNVPAARWAGNNNNNNGGTGTDFYSLLSSAVAAATNAGAAQSAGTRTVGGEPTNPGALIPPHLRESGARMDFISTQRDRLNVLLSALDREAQDLRSDAQRAQANTGPQRDPMAYGGYDNTRNDDEEPTQRPPSGLSGWSGISKSRSETDFERIDADVSSDEDHKMRRRNMGAGTRNTSGSWVPWSWGGDAAQGGASASGRER

SEQ ID NO: 24439 - protein, 333 aa, Gibberella zeae PH-1
MSDKPIVLVTGANGYIAGSVVEAFLKAGYAVRGTVRSKASGDSLVKALSSYGSDLEIVQVPDIVAPGAFDTAVKAAGVSLSFTDPDPVLEVAIKGTESVLESALTEPSIKSVVLMSSIAAISATGNPSSNRVTEADWNDAALDAVKKLGKASPSPLIYVASKVAGERAFWKFRDEKKPSFTMTALNPTFVMGPQPGLESISKIGGTTAFIWQVFSGQDIPKPIVPNPSFVDARDIARVAVFSVDHPEKANGERFLLTAGLVPPQAAADVLRKAYPDRQDIIKVGQPGEGYYPGYAFPEEKILDASKTIKLTGQDFYPVEKSIIDTAKSLEKFL

SEQ ID NO: 24440 - protein, 489 aa, Gibberella zeae PH-1
MALLSVNLRDGLILTAVITILLYIWEKKTAKITRNGEPLRKPPNTLPLVGNGIIFLQPRQKLFSWFHRCERLYGYETLHITVPSLPPGVIVNDPQNLDFIFRNEGVFEKGEFFKQRSWDLFGHGIINVDGEFWRLQRKAGLRFLSAAALKTLTNEKLPKYLDQAIGVLEAKTNTKEVVDLQAVVHEVTTQLMGRMAYNMEMHADDDFTVAFEHASGGTAERFQNPLWFVTEMFTGARMRRSITTVKAYGKRIVTSAVADRKEAEGKTQSDAPGSLIQSLLDSIGDETLVADAALNYLSAGRDTVAQALTWTLYLLMKNPHVATKLRQSVESLRDEDTSTGDDPELLTPVRLPYVLAVFYESLRLRPPIPFEIKQAQQATTLPDGTFLPAGAIVVWCAWAMGRSHTTWGPNADDFRPERWLTTSLAGDVTVAQRPAAEFPVFNGGPRTLARLVPLFKFEPAFEGERVSKSSLTLPMEGGLPVYVQHQTPS

SEQ ID NO: 24441 - protein, 4202 aa, Gibberella zeae PH-1
MIVYPVLADDEYITITKPYRGSVTALYTVPPQGDEPGIIIVEQPGGSSAPENVVIPATDDRSYVIVIRPYKGAKSISAPITQVVPPRDGRPGQIIIETPETAAAALTPGVLFPVTLEPQYANDYVTVLQPVAGTLASLQLITITPTGTNRGSVIVNIPASSFNRGNAQGITLQPDAEGDYVTVLQPAGVSFTGTTPVRITVPPSGDRPGTIIIQTPIPGLLRPVSLETLSSNSLSALGLLAGQTITLQPTDATGYVTIIEPAEGSVTPTAPIRTTIPPTGTKPGTVLIQTPPGGNNGQPGGGASTDAVGATIPPTRTRPGGAIPYTTVTRGVSNNFGDSGSGSGNGSADGNGDGDGEDGSNEDDDSGSGGVQGRPGQGQGNNEGPRETLTIPPEGGRPGTVLVLTPDGQSDSQTDDDSDDSPGSTQPTGGSDTGGQTGSSNGDSQSGSGSSGSSGSGSSGSSGSGSGSGSGSGSGSGSSGSGSGSGSGSGSGSGSGSGSGSGSGSSGSGSSGSGSSGSGSGSNGSGQGGSSGNGDSNGNDDDETGSGGVQGNGSGSQGDDGEGDTDGDSSGNGVSSGSGSANTNGKGSQPGANPDGSSDGTSGSGDSGGSKGGNGGGAGSGNGRSSTKSAGTSKNTKGASNDDSDDDDGDSLNEGTLGGGGRPGGDGNANDKSSRSSGRKSSTSKRSTSTKSPVVVTEPTTYTTTSDKTVKTITSNIVKTLSDSKSSTRQSPTTKRTTSLKGNLEGLGGGSAAGSTTFTRPANSRSTSSKEASTSKDNGNAGKDPAASTVLTNAPPEASPGPSPESTKTSSSKSTFSGSIDTAVRPGGSGISTTSRKSTASPSQTTKGSSKTSSNVNGGPDKTDASTSKTGSSTSTVGSKSTLSSTKSGQGSSGSVVASSRASSSTSSTASLKGNPEGLGTRTDDTEESTTQRNTGSSSVITSSTSHSSTTKSSGTTSPIVNTRPGGDTAGQGSSTSSRPSSSQTITKTSTTTSKEVINIDTLIGSQSVAESDRVPQGDEETSTARRTTSSSTSSSRDEDQESATSTSESSPDAETTSTIDGSTATARDGEGDNDSSSTEAGLTGEPAGGPGRTTIVDEEDPEPSTVISNGAPIVVEPSSSATSDDADSEESSSGSEDGASETGEDDDEESSATDTATAQDPDAEETSSETQSDGAQETEDPGSDDEGTSLITPQMPVPTSPLLSTVSGDESLSDNEDPDAETGDIITDEPTGSATAGPDASDAASDGETSETDDSDAEETSATEGSEPAETSDTDGDGGGDSATATATATDDSGSNTEDGNQATTDVSTEIPSDTITEDGTQTTEEPDGDLSTVTFFREGQGPFRTTVYIPPQETGDPWTVIIETLVSDTQSEGATARGDDDAVATAPAITGTANITLFRGGSIRRTFYMTPSASDQPGTVIIETPTGAIPSTTAFTTIFSAGTGSATVTIYYPPDDPDEPGTFVIETPVSGADEASASEDVNEGTDSDATITPAPSDILSPEVEGNLTLYRSGEESTRQTIFIPPTSSGDRWIVIIETPASETELEETGTAATVPGFQTTIASVTGTANFTIFTTGTATTRKTSYIAPKTSGEPGTIVIETPVPISSSSGLTANPEALTTDDAISVESTTTVFIQGTGTRATTYYVPPAVTGVPGTLYIEAPATGSSDENTETDLPPGVLPNVTISSGVPGSVTRTVYVSPTASGEAGTIIIEVPTGGSGDNDDDGDIISAATTVTSFRGGPASVTITSYIPPTVSGEAGTLIIITPTEGSGASTTGGEDAVETGDPSDPNADSISATTTTTVYQGGPGSIRSTSYIPPTASDEPGTLIIVTPTDGSEASATDDEDAEETEDASKTDSITDIDVIEATTTFTSFTEAGSPTAVITSGGNVTIYSGGPALSTTTRYIPATVSGEQGTVIIETPTSGPQATGIGNVTIVTGGPATITQTIYIPATGTDEPGTIVIETPTSGVDEDIMINSTIYSGVSATGTRTVYVSPTASGEPWIIIIETPAVKAPENVTVYTGISATAATTRFVPGTDSDDIGTIIIETPLDSPTYVTVYTGGPGTATTTIYLTPSASGDSTTMVIQTPTQGDGDAEPSDTGAISVPGNVTVTSGGSGSATSTIYVAPTASGQSGTIIVEYPTGDTGDDDAITIAPTGSGGNSTITRGGPASVTTTIYIPPTASGEGGIIIVETPTDDDGETNVPETGTITDEPGATGQPGNTTIFSEASGTAAETLYYPPDDPSEPGTVVVVAPSRPTATTIYSGGPVTSPRTLYISATVSGELDTVLIETPTTGVEAEISEAESGQRTTTIFGGGSGSATRTIVISATVSGEPDTVLIETPTGAEVEATTITRGGSVSVATTVTVPGVSGGPDTVYVETPTVSDEDAASETDDDQVEATTITRGGPASVATTITVPGVSGGPDIVYVETPTTSLNDAASETADGEVQAITITRGGPVSAATTYTIIGAPGEPDTVYVETPTMSADDPTGSNGIDATTITRGGPVSVATTITVSGVSGQPDIVYVETPTTAADGAASETGDDLEPTTITRGGSVSEATTITIPGAPGEPDTVYVETPTAPAGGNDATTITTGGPVSVATTITISGVSGEPDTVLVETPTTSAGEVEATTITRGGTVSAATTITIPGEPGEPDTVVVETPAESSRSAVEYTTVTRGGPVTAATTVTVQGISGEPDTVFIETPTESPSDTEPEYTTITRGNTVSAATTITIPGVSGQPGTIVVETPAETTRDGEVEYTTITRGGSVTAAITVTIPGVSGGPDTVFIETPTEPAAGSGELEPSTIITGGPVTAATTITIPGLSGAPDTILIETPTEFSGDEPSVTDNGSDEETIATTITRGTAVTAATTLTLTGQSGEPGTVIVETPIDGLEDEETATDTATGVVVSPQGRPNTTVYFGGPVTAPQTRYVSATVSGELDTVFVETPTAGSNEDEVEYTTIFSGGSGTAVRTTTLQPDDPDDLGTVIIVTPTGSGETTTDDAEEVEYTTIFSGGSETTIRTTTLQPDSPDELGTIIVITPTGSADTTTDDAEEIDYTTIFSGGSGTAIRTTTLQPDDPDELGTVIVVTPTDAGETATDDAEDVEYTTIFSGGSGTATRTITLQPDTPGELGTVIVETPTGAEVTATDDADDIEYTTIFSGGPVTAATTRTLQPDIPGELGTVVIETPTAPGDADDVEYTTIFAGGPGTVIRTTTLEPDAPGDIVTVIVETPIGYDDDVEYTTIFSGGPVTAATTRTLQPDIPGELGTVVIETPTATGDSVDIEYTTVFTGGPGTAIRTITLEPDSPEDLVTVIVETPTAIADDVEYTTIFSGGPVTATRTITLEPDTPGDLGTVIIETPTTTLDEIEYTTIFSGGSVTARRTTTLQPGSQGDLGTVVIETPTSADEEAQYTTIFVGGPANVPRTTTVTPESSGALGTVIVETPTGDNAIEYTTILSGGPVTALRTTTIAPGSPDDLGTVIIETPTGGNEEEIEYTTIFSGGSGTASRTTTLAPGSPGDLGTVIIETPTNGEGTAEIEYTTVFSGGSVTASRTTTLAPGSPGDLGTVIIETPIIREGTAAADETSYTTIFSGGPVTASRTTTLAPGAPGDLGTVFIETPTTAAAGEITYTTIFSGGSVTASRTTTLAPGSPGDLGTVIIETPTTAAEIRYTTIFSGGSVTAPRTTTLAPGAPGDLGTVIIETPTSAVGRNTTIYSGGSGSVATTIYYPPATNDPDQVGTILIETPTPTPSPTPPPVIQNVTQTIGGPAGITTTIYYSPAAPNEPGTVLIQTPTTTIEPVIQNVTRTIGGPAGITTTIYYSPAAPNEPGTILIQTPTTTLVVQNVTRTTGGSVATTIYLTPGAAGDPGTVIIQTQTTPAVIVPTTTTTIFRAASSTATAGTTFYIPPAASGDPGTVIIETLVSSTTSSSSTSTSVAATGMPTFDCNGYGYIVSSLLAPSLTRVDLVTGERLQIASGVGPGLSVQAVGFNPTDNYIYGFASRGLILSVLCLLVPCQQVQLIRIASNGNYELLPLYIKSSAISMGDFDNTGKLWVSEGGVKWWSIDLQKGSPNFATIINSGTSFGTGLLVAVGDWSYLPGMGNNLFSVQTSVIGNGLVRTNVVRWSMATQTWTTYRTYPSLLLTALNLLWGATIAAPNNVLFAQENLLGQTWRFDLSSTTSANPTPIPGGAILNLNGDGAKCASGVV

SEQ ID NO: 24442 - protein, 349 aa, Gibberella zeae PH-1
MSPLWVRRLCIRVVDSLYGSFLYLPLAILFLKRSVTGFGTGEWDESQIPKLDGKVAVVTGGNAGIGYYTVKHLASRGAKVYLGARSESRAKAAIKRLLEENPLIPQENVVWLRLDLANQSQVVDAAVELQSKEQRLDILVNNAGIDPYDYIRTADGFEMTMAVKYTNPAAAAQEESDVRVITVSSSGEAYSSPTNQFTSPKDLDDPCASPGWENSCLGQAMRYGTTKLANVLFASELQRRMDEEDANIISLSLNPGTVRTDGAANVMPFMVRPLVRFLFTAPERGADTSLFAATAEEIKENSERWKGRYLDGPGRIKVPSLRARDAVAGRNLWNITEAAVRGTGALDRL

SEQ ID NO: 24443 - protein, 230 aa, Gibberella zeae PH-1
MSTTPGVTFRKDGTKTFIPLENNPEVFTRLIHNLGVSKKLGFYDVYSVDEPGLLSMIPRPVHALIFITPAPMWAHVRESDPGSKELTYNGSGPDEPVMWYRQTIGHACGLIALLHSETQDLKPLARANFLYNSVELEKAHMDAAVTGDSAAPTSQEPVGYHFISFVKGSDGHLYDLEGGWGEPVDCGILDEGNDLLSDQALEATVKRYTKVADGNLEFSIIALSTVPEED

SEQ ID NO: 24444 - protein, 264 aa, Gibberella zeae PH-1
MGHHNLRFDGDPHSLSGAWSPPNSRANFCEEDYAITFYLAEFINALTNVTYVYLALRSMYGPRSRGLFAPNWDFMSFSLMVLGIGSFLFHATLRQTLEFVDELSMMLLSWSMLRALLILRQPPKNIRYISIILAVFFISFSVFYVMFSKIIYQVIAFWVSLILIGVRVRYLFYWAKPAFSAENVRKWAVRVWTATFTCLFGYLIWNIDLEFCHQLRAYRQKIGLPWAFLLEFHGWWHILTAVGASQFMNVLREVREEVDREKKE

SEQ ID NO: 24445 - protein, 371 aa, Gibberella zeae PH-1
MTTMDLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIAQAAGQANPEDDEKARANRTNAATAGQSAAKPNAIPSTRRKMLERGSGAGVDTPDTNRAIGGSDRM

SEQ ID NO: 24446 - protein, 341 aa, Gibberella zeae PH-1
MASIIDTVKNTIAENFGGPAEQLATHQFSLSETPNLSGKVAVVTGGSEGIGYGVTHTLLTHDISKIFILSLSKEVVEGAKKSVAEELGQEKADRTEWVQCDLSNWAEVKKAADQIKDSTDRLDILVNNAGRGIQTYQLSSYGVDQHMATNHFGHVLLTSYLLELLKKTSEKHGIVRIVNQASNAHQGAPSDVKFESLEELNTDLGPNPQYGRSKLANILYTRYFDRNVTKAGSPKILMNATHPGFVSTRQSLEHIHEAYPLAGYAMSVGMEPFKKDQFQGATSAMYAATMTDKSGQYICPPAVPELGNEKSQDEKLGDQLMELTRKIISEKFESFDDRKFY

SEQ ID NO: 24447 - protein, 496 aa, Gibberella zeae PH-1
MDLFNLMCPVLQDSDKVMQHAKKVHGSNTYDPKITTDMLAEVRRDLVMATSVMAALSSFMFGLATNLPIALAPGMGLNAYFAFHVVGYNGSGKVPYGVALTAVFLEGLIFIFFALTGLRQWLVKLIPSTIKIATGAGIGLFLAEIGLSYGSGIGAITGGWNATPLTIAGCPIEMIIPQTQMCDSGIMTSPKMWTAIFVGGIFVYLMAFRVKFAFLVGILLVSVVSWPRGTSVTYFPNTTEGDSRFDFFRQVTSFHPMKHTLNALDWEIAEHGTQFVLTLFTFLYMDIIDATATLYSMVRFCGVVDDIDGDFPRSTLTYCCDALSISTSALFSCLPITAFIESGAGIAAGGRTGITAMATGVLFLIAVMFGPIFSSVPPWATGPTLILVGCLMARQMTEINWRYIGDTLPSFVVIAFVPFSSNVAYGIIALSSGMFLYATINILVTLTVRMSGGTLEPENYDFKEYWTWKAPRSKPWYIRMFRNSVVTTMSEWAVDG

SEQ ID NO: 24448 - protein, 332 aa, Gibberella zeae PH-1
MSNQPPYPLHESVVGRIDPEYAAFYNKHIIDKQQVHLQPIEASRASGVLIPGSGPLQPVASTVDYKVERRESQGPDVSVRCFTPNGEKPEAGWPVCIYYHGGGWVLGTIETENVIASHLCARGKCVVVSVDYRLAPENPFPAAVHDSWEAVLWVIGEGKDILGLDTSKLATGGSSAGANLAAVMCQRAADLGSPQFSLQLLSVPVMDNTADISNNESWKENQNSPALPAPKMLWYRNHYLPNKEDWSHPEASPLFWKGDFSKLPPACFVVGELDVLRTEGEQFAKKLVDAGVKAEVNMMKGQPHPFIAMDAVLEAGSRAITLFCDALYKTIK

SEQ ID NO: 24449 - protein, 343 aa, Gibberella zeae PH-1
MAPQSLPSHPLGRNGPVVPRLGLGLMGISAFYGDAKPEAERMAFLDKAYELGECFWDTADMYGDSEELIGRWFKANPEKRDDIFLATKFANKFSEDGSLSIDSTPEYTLSACDKSLKRLGVSSVDLYYCHRLDRKTPIELTVEAMVQLKEAGKIKYLGLSECSATSLRRAHAVHPITAVQMEYSPFSLEIESSQFKLLETARELGVAVVAYSPLGRGLLSGTLRSPADFGPGDFRALLPRFTEENFPKNLALVDKIQEIAKAKGVTASQLTLAWLLAQGDDIFPIPGTTRQDRLIENLDSCKVKLSDEEKKAVRSAVDNAEVVGGRYPEAMSSSNFADTPALD

SEQ ID NO: 24450 - protein, 446 aa, Gibberella zeae PH-1
MRHSFVSILVVIGAAVQAAAQLNGKVGPLTPRQAKAAIKTCNITDYGAKANAKTDNSAAIQKAWDDCKTTGGEVVIPAGDYGLGTWLTLSSKTPMSFRLDGIIYRIGTGDGNMFMFKHLEDFEFYSSTSQGAIQGYGYEFHKNNKYGPRILRFFDVKSFSMHDVALVDSPAFHFSLDTCSDGEVYNTVIHGGARGGLDGIDVWGSNIHIHDVEVSNKDECVTVKNPSDHLLIENIFCNWSGGCAMGSLATDTNIHDIEYKNVYTQGSNQMYMFKSYGGSGTVSNIALKKFRGHSNAYTLNVDAEWSSMKPVAGDGILYSNMTFSEWSGSCTDGRQRGPIKFNCPADVPCVDLQVDDFTVGSSKGNVVEHICKNAYGSGVCLKEGDGGAYTATQTVNNPNFATQTMGGELTAGLGLTASIAIPTIRSSFFPGTPVINSLMSNSAKED

SEQ ID NO: 24451 - protein, 341 aa, Gibberella zeae PH-1
MSTSSGVPESWISSFCSLLGHEYFAEVSEEFIEDDFNLTGLQTQVAMYKEALEMILDVEPEDDEDEEEEEEEEDENDSDPERLTRASSERRHHRMASDLSVIESSAEMLYGLIHQRFICSRAGIQQMSEKYELGHFGCCPRTNCDQARTLPVGLSDIPGEDTVKLFCPSCLDVYVPPNSRFQTVDGAFFGRTFGSLFLLTFPEYDLTKRGIEVLSSSGPRVNEGDGLMNGMYAKNIGPGLGRERIYEPRIYGFRVSERARSGPRMQWLRERPTDINELDEARLYAEQNPDSEDDDESGGQVGMNGRVMVRRRPPGNARLRQRQTQNGSPMAMSTNGAESEL

SEQ ID NO: 24452 - protein, 492 aa, Gibberella zeae PH-1
MGKAYNIGLACFAAIGSFLFGYDSGVMTDVIASKHFQDYFDTTSTSSIIGAINSTFSGGAVFGALFGGVIMDRFGRRKTIGIGAFICTIGAILQAAAYHLAMMLVGRIIAGFSVGLLSMSVPVYQSECASPKNRGLIVGLAQQMIGVGFIVSTWVGYGSHHMPDTSSFQWRFPLAFQALPSVLLCLGMLWLPETPRHLIATDQLDDGMRTLLKLHFDGSNEEWIKSEFNEIKLTIDAEKLATAPGWLIMFKVPQWRKRLMLGTLVQVFTQFTGINVIGYYQTIMYESLGITGKTNLLVAGIYNCTGPLANLVFITLISDRIGRKRPLIYGIVAISIALVLESVVNSQNVDGTHHGLSIAGVAFLFCVTVIFSLSFGPVSWTYMAEIMPYQIRSKGCAFATGIGNWLVSTFWNQVSPLALKELGWKFYFLFVAFNIVVTLPTLIFAFRETKGLSLEEIDLLFGGRALGNLPADIEKDGGAVAVTNSRDERPDR

SEQ ID NO: 24453 - protein, 314 aa, Gibberella zeae PH-1
MKAVQILGDAASPKITINSSMPKPTTIDSDILIHVHAAGITGDETTWPEVYQTPSRIPGHDISGTIDSFGPAYKGNLKIGQDVFAMIAADRGEGQAEYVVCTTEEIAPKPSSLSHAEAAVLPIPALTAWEAVEDFVKIRPDMRVLVTGASGAVGKQFVQLVKHLTQAHVTALASARNHDVLRDLGADEVIDYASPHWESSIAPVSFVFDTVGGEVLSKTWETVEEGGTIITIGDPAPAWAFGNEEAPESLKYPSVKYKHFILSPNAKRLADVASMLDKGLLRPLDVRIFPFDQGVAAWDCAKQRGRDSKVVIGF

SEQ ID NO: 24454 - protein, 443 aa, Gibberella zeae PH-1
MSSFKNTFGDFSATIHGVIVSTILIPGALTALVAGALAHRFGHVRLIAIGSIIFGIGAAIECGAPYLGVFIFGRLVKGIGEGLFLSNVYVQVSEMSPSRVRGIMTALPQFLITSGLVTGYFTCYGTSRLGESSVTWRLPLAIVAFLGVLFSMVAFIVPPSPRWLLSKGRVEEARLVCRQLGIDEVEEKELLAQDYDAPVGLDGETTLWQDIQNTFKDFRCAFSAPYRARTGFACFLMGMQQFSGIDGVLYYAPILFTQAGLSGEKASFLASGISAVVILAATLPATIFADRWGRRMQSILGGVLIVGLMVIMGSLYAAGQVHPDHGPGRWVVIVCIYLFAIAFSFTWAIGFRTWVVESMPRRTRSSASSLAQSSNWTANYIVALVTPVLLDKSSFGAYYLFAGCSLATTVMVILFMGETKGHSLEEIEKRHGDTKEKSFPFNL

SEQ ID NO: 24455 - protein, 369 aa, Gibberella zeae PH-1
MTRITTPINIGRCALKHRVLMAPLTRLRADNHVPLDVMVDYYSQRASVPGTLLITEATFISEKSRGRDEHAPGIYTREQVDAWKRVTDEVHKKGSFIYMQLWHVGRAAKQDVLDKAGLEMVSSSDVPIGDEYPKPRPLTEDEIWESIKSFATASRNAIEAGFDGVEIHAANGYLIDQFTQDVCNKRTDKWGGSVENRSRFCVEVAKAVSKEIGPDRTGIRLSPFSTFQGMRMEDPEPQFTHLISELKPLGLAYLHLIEPRIAGNVDKVVDDDKESLDFALDAWAKSGPVVLAGGYTAEKANEALETRFKDEAVAFAFGRHFISNPDLAFRLANDVPLTHYNRDTFYKVKSPDGYTDYPYSEAWIEQQRV

SEQ ID NO: 24456 - protein, 289 aa, Gibberella zeae PH-1
MAPLQPTVDPGRGRHAVVVECRGRNDRVYAMKLFKEDSRDRITREIRILRFLGFGPNIIRIVDIVQGEEGADVGIVLEYVENIDYRTLYPRFTDSDIRYYTREILKALDFAHTLGVMHRDIRPQNVVIDHANKKLRLIGWGSAEFCSPGTEHDCCVGLNKPPEILLGYEQYGRGVDIWCLGNMLASMIFRKDPFFHGSSLLDQLVNIAKVLGTEKLYSLAEDLGIEMEPRELEALGHREETPWGTFVDSANDHLATEEGIDLVDRLLRYDPIVRRSELLVLPGYADLED

SEQ ID NO: 24457 - protein, 306 aa, Gibberella zeae PH-1
MASVNFSPDTDIPSLNGKVILITGGNSGLGLESTRQLLKHDPAKIFLACRSKAKYDQAIAELQEQGSKTDAVSFLSLNLASLESIKSAVRQFQQESTRLDVLLNNAGIMMTPEGLTEEGYEIQIGTNHMGHAFLTHLLLPVLEETTKINPDVRVICLASMGEAMAPKNPYQFEQFKTTMSNFSTSARYYISKLANVHYAAALAERHPSLKIISIHPGIVQTNLTGPAVSNSLIMGTLTRLFFSVVGVNSSKGALNQLWALSDPKAESGVFYHPVGVTGKGSKLSQNKDARESLWEWTEKEIKQHLS

SEQ ID NO: 24458 - protein, 414 aa, Gibberella zeae PH-1
MSWRASERLMDTIRHYARFPATGVSLRQMVQFGEKPSVGTLFRASQFLAEELPIRLAHRVQELDELPDGLNEMPSVIKVKDWYAQSFEVSIGRNAFRLPAATPNPSIDEGESDGWGGLQNNNSKNKGLTRRYFAVVDDSSDWPADLHLYNQRFAQTLHQIKRRHDSVVTTMAQGILEYKRRRQRMQIDSTIQSFLDRFYMSRIGIRMLIGQHIALTDQSHHRDPTYVGIICTRTNVQDLAQEAIENARFVCEDHYGLFEAPKVQLVCNPNLNFMYVPGHLSHMLFETLKNSLRAVVETHGMEKQAFPVTKVIVAEGKEDITIKISDEGGGIPRSAIPLVWTYMYTTVDRTPSLDPDFDKSDFKAPMAGFGYGLPISRLYARYFGGDLKLISMEGYGTDVYLHLNRLSSSSEPLQ

SEQ ID NO: 24459 - protein, 405 aa, Gibberella zeae PH-1
MKRSVLISLIPAVLGCANIKSNACAMSVAANVAGCADVNDSSSVPEWASGCSKKSLIKECDCQYTAGGDAEAPAPDPASTTLATRVASAVPEATAAKPVESAPDAGSAAGGSCGAAKVDQLVGYGDGTTGGSGEPVVVKSCSELKSALKNSGVIHIDGQLSGCDIMEVPSDTTIAGIGANSGLTDSGFRIKKVSNVIVRNLNMHNPPKEMDLIDIESSTYIWIDHNVFSSEGITGDKDYFDGLLDAKRGSDFLTFSWNKFVDHWKASLIGHSDDNGSQDTGKLHVTYHHNYWSNINSRAPSIRFGTAHIYSSCYEDLPTSGVNSRMGAKVLVEATAFVNVKKSIITNLDSREDGFAVEKDNLFENSEPAITQEQEFTPPYEYTVDSADCICELVKAKAGTGVITA

SEQ ID NO: 24460 - protein, 351 aa, Gibberella zeae PH-1
MSISIPSVQKAALIKNPGDEARIVIRSDIPVQNPGKNEILIKLACTGVCGSEIRALSGWGPYNPIVGHEGVGTVVKLGHDVDPNLLNKRVGVKWLYSACGECTICKRGYHNNCPKQLNTGKHVPGTLQEYMIADARYVTKIPDGVSSEVAAPLLCAGLTMAGAVSKLEGYAEKGDWVVILGSGGGLGHLGVQIAARLNGLRVIAVDTGEPRRKLSLESGAEHFIDFASENIEQRIKEITREGAAAVLVVTASQEAFIQAPNLVRNMGIIVTIGLPRNDFNIPLSASLCSARSLTVAGVAVGTETQMEELLQHASSGTIVPDITVLEFEQVGKVIRDLQDQTITGRVVVKIP

SEQ ID NO: 24461 - protein, 351 aa, Gibberella zeae PH-1
MSSTKDIVLVTGANGFIGARTVEAFLAADYFVRAAVRSESSASSLFSALPVYASSGYLTAAIVHDISATGAFDDAVQGATAIAHLAAPVNFSNRDIDYVIKASMQGTLSILESAIKEPGLKSFVYMSSIVTVRGQSPKYPDKGYTEEDWNDQIEDALSKAGTDATGHQIYVASKLKAERAFWEFQKTHADKVNFTMTAVNPVWVAGPPLILPDDPEKLSETAIVAYRIMNGQDMPSTGPGNGTHVDVRDVARLIVFAVEKKQVADGQRYIVGGNGNYANIQAYRDLLRKAYPGRKNIISEGEPGKGYNQDYSTPEGGFLVDGSKAVQATGQDWISFDQMTLNAAKAYERYF

SEQ ID NO: 24462 - protein, 505 aa, Gibberella zeae PH-1
MAGSRLRDISGYLILLIAITTLGSLQFGFHLAELNAPQDVITCQKKSINALSALDKIKGLIHKKPVEEDHGFLPHCIPMDEAAFATVSSIFTLGGLLGALTSGPFSSKRGRLPAMRITGLLYLFGAAVETVAGSVFVMALGRLFSGIGAGASTVVVPLYISEIAPPKERGLFGFMTQISINVGILAVQTLGYFLSYGTAWRWILGSGVFIATAQTLGLFVVPESPSWLAAQGDGTKAKRTLQRIRGNGYDINEETESWNGEERDASEEDGLLQADSASESAPKNRVEHLGFLQVLQDSDTRPAIIAVVGIMFVQQLCGVNSIIMYSVSLLADLLPISSALLTILISVVNLATTVACAPLPDRLGRKTCLLASIVGQGTSAFILALSIVFGAKIISAVAVVAFVGFFAVGLGPVPFLLASELVGQEAVGATQSWCLAANYVATFLVAQFFPIVNTALNNVLGGHGWVYFIFAGLAVGSFIFVFWKVPETKGKKDVDEVWGRTRRVD

SEQ ID NO: 24463 - protein, 470 aa, Gibberella zeae PH-1
MAPSTIADFQDVPCHQAYTPIKPIHREGALMHRSLVQHPYMVESAQGIELKLSTGQTIIDGCGGAAVALIGHGREEVIHAITEQARKVSYVHTQSYTTAPAEELANVLLQGNPYGLEKAFFVGSGSEAVESALKLARQYHYEKGGLEKVHIISRRQCYHGNTMATMSISTNIARRAPYHGFLYPNVSHVSPAFAYHYKDSSESEDQFTARLLVELEEEFLRVGPQKVAAFIAETVVGATSGCVAAPAGYFQGVRALCDKYDVVMILDEIMCGIGRTGTFFAFEQEGVVPDITTVAKGLGGGYAAIAGVLIHKRVVDVLRQGSAAFNHGHTYQAHPISCAAALAVQRIVRRDNLVERCAEMGLVLEKMLKEDLSGCRSVGDIRGRGLFWGVEFVKDRQSKQPFDPAAKFGLLVQQLAFEKGVALYPGGATIDGVKGDHILLAPPFTVTEGSGGGGKNSLLGLTTAHKNMTI

SEQ ID NO: 24464 - protein, 324 aa, Gibberella zeae PH-1
MKITSVFTAVFATLAVGSPLETRDAHIKRQAAEACSVGYCTQNGGTTGGAKGETITVTTLAALQEAAKRSGPLTIIVNGKFTGSDTIRPSSDKTIIGAAGSSLTGVGFYVRRQKNVILRNLKIAKVDASNGDAIGIDESTNVWVDHCDLSGDLSLGKDDLDGLLDISHGADWITVSNTYFHDHWKASLIGHSDNNASQDKGKLHITYANNYWKNVNSRQPLIRFATVHLVNNYWDKILLSGVNTRMGAQVLVQSSAFANSVERAIFFADSKETGYAVVDDVDLGGSVNSAPKGTLTAASLPYKVTLLGSKKVASVIPGTAGQKL

SEQ ID NO: 24465 - protein, 220 aa, Gibberella zeae PH-1
MLWRYSLLFAAQFGSVIGNGQHVLGSSGDGLNRIRDKLLEAEIIPTVIDDFPPALGFRASWKHDSADLGNTLKPKHLKKAPKVHLDRVESDDSLETILKKHATYVVVLTDPDAPSRDDPKWSEFCHWIATGRMSPSSTTSKHKLKDIIKYKAPAPPPKTGKHRYVFFAFIAANGTTEKLHLTKPKEREHWGSKDSGHGVREWALQNGLAPVVSLNKQVGN

SEQ ID NO: 24466 - protein, 505 aa, Gibberella zeae PH-1
MAHELPFKIPTLQVKQQAPSQVQPLTSSVILPSNSLTTLTTPDPGTNKPWAKVKDNSADDVDHTVQVAYDAFQTFKKTSPRLRAQWLLKWDALIREHKADLATLLVYETGKPYAEAIGEMDYSLTFTSWFAGEAERIQGTCFMPSAPNRRVFTIKQPLGVAVALVPWNFPVAMVLRKAAAALAAGCTMVVKPSPETPVTAMALAKLASEAGFPNGVLNILPTSLDNTPSLSEALCKHDLVKKVTFTGSTRVGTLVANLCSLGLKKVVLELGGNCPCLIFNDADIEAALRELVGLKWRHAGQACVTVNRFLVQSAVYDKFLQRFAEETAKYVVGHGASEGTTLGPVTKPESLDRAERLIKDAVSKGARIVTGGNRLSPKDGEGGYFFEPTILADMTHDTLISCEECFAPIAAFYKFETEEEAVRVANDTPMGLASYAFTKDADRIWRLFENLEAGMIALNTGNSSAAESPFGGIKMSGYGKEAGKDVAVNEYMIQKTGTITVDGLV

SEQ ID NO: 24467 - protein, 418 aa, Gibberella zeae PH-1
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIICGGMAFTFKKTLENVSIGNSLFDEAGSKTVGNLVEKAKQKGVKLVLPVDYITADKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSK

SEQ ID NO: 24468 - protein, 446 aa, Gibberella zeae PH-1
MAPKRFGSEVVDPSRLLEPLEYVFAGQKAPNRFLKAAMSEKLASWDANDVSARGYVTPELLTLYKNWGAGGWGSILTSNVIIDGMNLEAAGNLTIPADEPFEGRRFDGYKELAAVAKKSGNLLIAQVSHAGRQVEEWIQPNPISASDVQLVSSSPGKTYGVPRPATKEDIATVINGFAHAAEFLEKAGFDGIELHGAHGYLLAQFLSPRTNNRTDEYGGSRENRMRLVLEVIAEIKRRVSPKFIVGIKANAVEYTPGSVDVEDAKALAIELEKAKVDFLELSGGNYEKFAFAHVKEENRKRENYFLSQAEEIVKSLTRDMKVFSTGGFKSVKAMVDSLDIIDGVGLGRASAQEPRFPELLKKVSVTGTIEQCFDHDDVIKRFAAAGVHITQIANDQEPVDLSSQENTDSMWNDLLQHFQKVAADTEHKTFKWPVVTQVTQPYGVDV

SEQ ID NO: 24469 - protein, 454 aa, Gibberella zeae PH-1
MARKRTKKRTHLGASNPDVDSAGHASAKDPKSMVIRIGAGEVGSSVSQLAADVRKVMEPGTASRLKERRGNRLKDYAVMCGPLGVTHLMLFSRSETGNTNLRMALTPRGPTLNFRVEKYSLCKDVQRAQKHPKGGGKEFITPPLLVMNNFTRPDSDNKSKVPRHLESLATTVFQSLFPPINPQATPLKSIRRVLLLNRETSEEDDGTFIVNFRHYAITTKSTTVSKPLRRLNAAEQFVTSKTNRKGKMPNLGKLEDVADFLIGGEAGDGYMTDATSGSEMDTDAEVEILDSTTRKVLSAKARQAAAQNETEPEAEEENVERRAVKLVELGPRMRLRLTKVEEGLASGKVMWHEYIHKNKDEIKELEKRWEQRRQEKDARKKEQKANVERKKAAKTKDGNKGEDDDEEDEFEYDSDMDVDEFDSEGLAGDAEFKVNEKMEEDGEWEDEEEEIANS

SEQ ID NO: 24470 - protein, 500 aa, Gibberella zeae PH-1
MSDLYVNLEAPNGVKYRQPTGLFINNEFVPGSSTQKITSIDPATEKEIATVHAANADDVDKAVKAAYDAFRNPSWKKLPPPQRGVLMNKLADYIEERTKIFATSEAWDNGKVYTDAEGGDVVEVINTIRYYAGWADKITGQTITANPNKLAYTLRQPLGVVAQIIPWNYPLAMAAWKIGPALACGNTIVMKAAEQTPLSILLLGEAIKAVGFPPGVFNALNGYGSEAGPALVEHPLVDKVAFTGSTATGARIMEMASKTLKNITLETGGKSPLLVFSDSDIDEAVKWSHMGIMSNQGQICTATSRLLVQDKVYDEFVQRFIETTKTVSKVGHQWDSETYQGPQVSKQQYDRILEYIQIGKSEGATLLAGGQPVDSSKKGFFIQPTVFGDVHHQMRVFREEIFGPVVVITKFSDEAEALKLANDTTYGLGAAVFTKDVERAHRVAAEIEAGMVWINSTQDSEPYIPFGGVKQSGIGRELGEAGLEAYSNTKSIHVNLGSRL

SEQ ID NO: 24471 - protein, 494 aa, Gibberella zeae PH-1
MAENYHKEVISGLKNKSLFIQDAFINGQWVAKENKFDVFEPSTATVLGQVANCALEDFQTAIKSADVAQTKYFDSTTGASRGAMLRKWYDLVLANQEDLAKILSLENGKTYSEALGEVIYSASFISWFAEEATRSYGVTIPSSAPHTTLMTIREPVGVCGIITPWNFPAAMITRKIAPALAAGCSVVIKPPSETPYSALAFTKLAIEAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGGGLDKTTTQGPLVNKSAIDKVKEHIADATSKGAKIATGGSTPDSPGFFHQPTVLTGVTQEMAVAKDETFGPLAPVFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 24472 - protein, 148 aa, Gibberella zeae PH-1
MASGDATLFEESFTVMEYDQSKYDRVARIHCTSADSQTIMSLDINIELFPCVRGDSLHVVLTTTLALDGSKEEEKGWRDVGKGGDAPATIADLYDYVCHGKIYKFEETFDGNTINAYVSFGGLLMSLQGPVKKLTPLRVDNVYLLVKK

SEQ ID NO: 24473 - protein, 199 aa, Gibberella zeae PH-1
MIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKSFASENHLSFIETSALDASNVELAFQNILTEIYRIVSSKALDSGDSAQATIGAGTNISLSKPADDDAAKGGKCC

SEQ ID NO: 24474 - protein, 1111 aa, Gibberella zeae PH-1
MSFNFVHDSKFTSPTHNLSEMSSLTRSQLGQVQTSFPSQTQPVPIPMSATSASTGTSNSQQGSPIMSPDTAVLTTYSSVQASPEPMRGREEEAFPSSFQLPESVLSRKTSTNSLGYNAMSEVANNSKGGLIRRFSNRAQRFAGRRRPSSGAPASRDGSVGPSILRRRSDSNATAPQENSALTDTDEEFVPDDSMSMVGVDGANYTSSANSTHGSISASAGAMAGPVLPAELRNGCPVKKVSKKSRPKRITLAYETESNKLSWDPSRPQKSLHVDEIREIRTGTDIQQYIHDYGLSEQIEFYFPVWFTIIYNVPESSKTRFLHIVTDNSNTLSLWTEFLDAMLRYRQQLMTSLMSFNDRAVAQYWQTEMAKEFGDQARTPDQEEMNIAGVKRVCQNLHIYSSSSTLEVNFHLSDSRRRSKLNFREFKDFVRRMKQRNDVQRVIRNIAANPEFGLTLSEFLTFLRDDQGEDVDSNRTAWEKLFSRFCRQYRSTEADLPENVEIMTEAAFVAFLTSEDNEVIQPEPQNIVLDRPMNEYYISSSHNTYLLGRQVAGQSSVEGYISALARGCRCVEVDCWDGYNGQPEVNHGRTMTTSISFKEVMTTINKYAFVKSKFPLWISLEVHCSPAQQATMVEIIKESFGSRLVTETLEAFPDKLPTPSELMERVLIKVKKPQIKEEPIAAGNDFRGRRRGNSLNSPMMRPSVPDGTPLMPSQSLPQSPMLTPSHSSRRLVSKTRVNTITEGQVQGMLSSSTSDNESVSEQPVKKVHNKTVKVLGDLGVYCAGVKFSGFDTVDAKQYNHIFSFMESSFAKHSRAKDQKMALDIHNMRYMMRVYPDRTRITSNNFDPLNYWRRGVQMAALNWQTFDLGMQLNRAMFDGKDSSGYVLKPAELRDIQVLPYNADIAEGKKERTVISFTIDVISAQQLMRPANLPANKSMDPYVEVEVFHANDKRDKKEADSNLVLEHDTPLKYQTDVIRENGFNPLFDRTMKYTVTTKHPDLIFVRWSVKLSNDGESYNERPAVATYTAKLTNLKQGYRTLPLLNHAGDQYLFSKLFCKIKIDSVEKKFMEAPRRVQDGNKLNRLGGKVFSRMNTSPKSTIEKSSSEKTSFDSY

SEQ ID NO: 24475 - protein, 367 aa, Gibberella zeae PH-1
MVKETKLYDTLNVKPEASQDEIKKGYKKAALKWHPDKNKNSPDAAEKFKECSQAYEILSDPEKRKIYDSYGLEFLLRGGTAQPESGAGAGGNPFAAGGMPGGFNFEGGMPGGGTRTFHFNTGGGGAGGFGFSNPEDIFAEFMRNGAGGMHGGVDDEDMAGMFGGFGGGPRSRASRTRSGFDGRARETTPEVTTVERPLPLTLEELFNGVTKKMKIKRKTFDDSTQKRVQTDQILEVPIKPGLKKGSKIKFNGVGDQVEGGRQDLHFIVEEKEHPLYKREDNDLVHTVTLDLKEALTGWRRTVTTIDGRQLNLEKGGPTQPNSEERYPGLGMPISKKPGQRGDFVIKYKINFPSSLTADQKQKLREIL

SEQ ID NO: 24476 - protein, 331 aa, Gibberella zeae PH-1
MTSQRKPLVSFLGPVASYTHQAVRQAFSEDTWEFRPAVTIDDVFDQVQNGQVQAGVVPFENSTNGSVVFTLDNLADRANRYPDITVDGETYVDVHHCLVGHKCTAPIVEEATEGSGTCTPTATDPSPSRPRSKPLSSVKHIQRLYSHPQAFGQCTAFISTYLKGVEIFEVSSTSKAAEIVSKDTTGTWAAISSELAGELHGLDFLGKSIEDREDNVTRFLVIGTNAAGPKDLEKTKQAVAQKGSKSLVSFTVPHTSPGALADALSCFRAFDLNLTSINSRPSLVQPFQYIFFVEFEGHKYDDPEGRVNGALEKISRVAESWRWLGSWEKYV

SEQ ID NO: 24477 - protein, 145 aa, Gibberella zeae PH-1
MSYYFAIVGTQDNPLFEHEFGTSKQGGDGQSRFSDQVRHLNQFILHSSLDIAEEVQWSHGQMYLKCIDKFFNNYISCFVTAGNVKFLLLHQPIVPTGTSSRSSTAIGANPTSQATEEAIKMFFTEVYENWVKAIMSPFYRANMEF

SEQ ID NO: 24478 - protein, 456 aa, Gibberella zeae PH-1
MSSKSRWADTEEDARLDAKLKEEKRRKKAEKARKLEEEKKLQDTAKQSNLEADDDRPSKRRRITPEPGAKQDEKLPPAKLLRFPTGSWGKSRSVENYEKLNDIEEGTYGWVARATNKATGKVVALKRLKLEPQDRNGLPVTGLREIQILKDCQHRNIVTMEEVVVGDDVSRPDNSLFLVLEFVEHDLKSILEDMPEPFLSSEVKRLLLQLTSGIAYLHDNWILHRDLKTSNLLLNNRGQLKIADFGMARYVGDPPPKLTQLVVTLWYRAPELLLGAKTYDAAVDMWSVGCIFGELLTREPLLQGKNEVDQVSRIFELCGVPTEETWPGFRRLPNARSLRLPKTQVATGSVVRARFPSLTSAGAGLLGDLLSLNPERRPSAQEMLQNEYFRQDPKPKPESMFPTFPSKANQERRRRVEPHAPVRGGQAASLGDADLSGIFQGRDKEEKGAGFQLRMI

SEQ ID NO: 24479 - protein, 469 aa, Gibberella zeae PH-1
MAPVTKETDYLVIGGGSGGLASARMASNKFGIKATIVENKRLGGTCVNVGCVPKKVTYNAAALAEAIHDSKAYGFSVQETAPFDWSTFKTKRDAYIKRLNGIYERNLNNDKVDYVHGWARLTSKNQAEVTLDDNSKVLINAKKILVAVGGKPTIPPEIPGSEYGTNSDGFFDISTQPKKVAIVGAGYIAVEFAGMFNALGTETHLFIRHDTFLRNFDPMIQEAVTKEYERLGVKLHKRSQASKIEKDSNGKLTVTYKDDQGNESVVSDVDNLIWAIGRTPETKGIGLEEAGVKLAKSGHIIVDEYQNTDVDSIYALGDVTGEVELTPVAIAAGRRLAHRLFGGAEFSTLKLDYSNIPSVVFSHPEVGSIGLTEPEAIEKYGKDNIKVYKTSFTAMYYAMMEPEQKGPTNYKLITTGPEEKVVGLHIMGIGSGEMLQGFGVAIKMGATKADFDSCVAIHPTSAEEIVTLK

SEQ ID NO: 24480 - protein, 475 aa, Gibberella zeae PH-1
MGVPVKRVAVIGAGPAGAIAVDALAQEKTFDLIRVFERREGPGGCWIGDTTQPPTISNLEKLANRTADEQLPIPKQLPAILPKSTQPRHEESSIYPYLETNVDTSTMEYTQEPIPAIRSERSISMHGPSTPFRHWKVMRDYVAGILERNHYEDLVSYNTTVEHVEKEGDEWKVVLRKGGKKQDYWWTETFDAVVVASGHYWVPYVPAIEGLEQFEKTRPGSVVHSKHFRGRDSFHDKTVVVVGASVSAADIAVDLVSTAKAPVHCITIGHTSNVFFGDTAFDHPNIRQHPSIAKVTGRTVHLIDGTSIPDVDHIVFGTGYSWTLPFLPSLPVRNNRVPNLYQHVVYQKDPTLLFVGAVGAGLTFKIFEWQAVYAARILAGRGTVPSAEEMQKWEDDRIQERGDGPKFSVVFPDFEDYFDTVRELAGEGEPGVGRKLPKFRREWFRNFIEGTELRKGLWRRWNAIAREEVGVKARL

SEQ ID NO: 24481 - protein, 323 aa, Gibberella zeae PH-1
MDAILEILDPYVFDYGYAYLFPQQTTQPSYGNSTGFAPSSASKNFDDEYSLNFGSSLPRDDIYRQSASILMIAGFGAAFIYVISAALSYYFVFDRRLEHHPRFLKNQIKQEIQSSFFAIPIIDLLTLPFFLGEVRGHSLLYTNIDEYGWSWLAISTILYMVFNDLGIYWIHRLEHHPSIYKYVHKPHHKWIVPTPWAAIAFHPVDGYVQSVPYHVFVYLCPMQKHLYMFLFVCVQIWTILIHDGDMITGHWLERFINSPAHHTLHHMYFTCNYGQYFTWADNYWGSHRAPMPELDPIHEAIRVMQEKGLADKDGNPIEKSKSE

SEQ ID NO: 24482 - protein, 489 aa, Gibberella zeae PH-1
MSAKSILEADGKAILNYHLTRAPVIKASPLPAPTTHNPPSRLASLHFPEDANVADILNQAEVTYPWLLQPDAKFVAKPDQLIKRRGKSGLLALNKSWPEAKAWVAERAGKEQQVEHTTGVLRQFLVEPFVPHPQDTEYYININSVRDGDWILFTHEGGVDVGDVDAKAEKLLIPVDLAEYPSNEEIAATLLKKVPQGVHNVLVDFITRLYAVYVDCQFTYLEINPLVVIPNEDKTSAEVHFLDLAAKLDQTADFECGVKWAIARSPAALGLTNIAPSADGKISIDAGPPMEFPAPFGRELTKEEAYIADLDAKTGASLKLTVLNAKGRIWTLVAGGGASVVYADAIASAGFADELANYGEYSGAPTESQTYHYARTVLDLLLRAPKTEEGKVLFIGGGIANFTNVASTFKGVIRALRDFAPKLIEHKTAIWVRRAGPNYQEGLKNMKAATQELGLDAKIFGPEMHVSGIVPLALVPGKWEESKAQEFQA

SEQ ID NO: 24483 - protein, 508 aa, Gibberella zeae PH-1
MSHIDYALYESPVGYAIFKVVHQQDAVGLKLKETQAATNDLAKFGKMVQLTNFSPFRGHVEALENINLVTEGIVSDYLKSVLELNLPQTSGKKTKVVLGVSEKNLAGAIKAQFPGLECETADTSDIVGDVIRGIRLHADKLLGGLKYGDVEKAGLGMGHAYSRAKVKFSVTRNDNHIIQASATIDFQDKGVNQFYMRVREWYGWHFPELVKIVSDNYTYCKLVLAIGDKKSLNDDKLHDIAALVEEDGEKAQAIIDAAKVSMGLDIAEADFEVINSFAEAVVKQADNRKSTNLYLEKKMGDIAPNLQTLIGTPVAARLISHAGSLTNLSKYPASTLQILGAEKALFRALKTKSNTPKYGLIYHSSFIGKAGVRNKGRISRYLANKCSMASRIDNFSEEPSTRFGEALKQQVEDRLEFYATGKKPAKNADVMKDVMDIMDGGDDAGSDEEMVDAPVVEKKSKKEKKEKKEKKDKKEKKRKLDEEAPVEKEADGEKKKKKKRKSKAADDE

SEQ ID NO: 24484 - protein, 388 aa, Gibberella zeae PH-1
MAAPQIPSQQWAQIFEKTAGRIWAQSHLFQSYPAIHSSCNTPVTFQALYSHLFLTAIEYKQIPVQKPGPDEVLVNVKFSGVCHTDLHAWQGDWPLDTKLPLVGGHEGAGVVVARGELVKDVKIGEKVGIKWLNGSCLSCSYCQNADESLCAEALLSGYTVDGSFQQYAIAKAIHVARIPEECDLEAISPILCAGITVYKGIKESGVKAGQSLAIVGAGGGLGSIAVQYAKAMGIHAIAIDGGEEKEKMCMSLGAQTFIDFTKTKNIVADVKATTNDGLGPHAALLVAAAEKPFQQATQYIRSKGTVVCIGLPAGAQFSAPVFDTVVRMIQIKGSYVGNRADTAEAIDFFRRGLIKVPFKTVGLSELNEVFKLMKAGQVAGRYVVDTSR

SEQ ID NO: 24485 - protein, 202 aa, Gibberella zeae PH-1
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYSVAKEFADSLGIPFLETSAKNASNVEQAFLTMARQIKERMGTTTANNTKPSVQVGQGQGVGSSSNNSCC

SEQ ID NO: 24486 - protein, 408 aa, Gibberella zeae PH-1
MADQEGQIVEFAGLSGASPEEARQYLEAHNWNLAEASNAWFRDAEDDGRDTSTAPAPVPDNYTGPRTLDGRPAPEAARSSSQATRKSAPSQQRKTGIATLGSIGSSSHQHDHGDDDDDDSDPEDDDGRGNLFAGGEKSGLAVQDPNQQEAGPKKIISDILAKARANAARPEAENEAGPSEPSRFRGTGQTLGGDGVESRSIPDPLGPVRASNAESQERVLHIWQDGFSIDDGDLRRFDDPANQADLALIRSGRAPLHLMNVQHDQPIDVKLHQHDTPYQPQPKQYRPFGGSGQRLGAVVPGASEGSSSTTAAPAAASSSSNAPSVDDSQPTVMIRIQMPDGTRLPARFNTNHTVGDIYGFVQGASAETRSRSWVLSTTFPNKDHTNHSLVLGEMSEFKKGGTAVVKWT

SEQ ID NO: 24487 - protein, 509 aa, Gibberella zeae PH-1
MTFPSDIHTFHSGRPQPESSSKSNTFVSVDPSNAKPLATIYTTTSEQLNQTVAAAQAAFPAWSQTPAPRRAAILLKAASILRERNDELALTETLDTGKPWSETSTVDVVTGADVLEYYAHMAAGSFPGQNTRLRPDAFVLTTHEPLGVCAGIGAWNYPIQIALWKSAPCLAAGNCMVYKPSEVTPLHAETLAQIYIEAGVPPGVFNVVYGDGIAVGAPLVAHSGIAKVSFTGQVSTGSKVASQAVTDMKGVTMELGGKSPLVILPDADVEDAADTAMVANFFSTGQVCTNGTRVFVPDTLLSQVEEAIVQRCREGIRMGLPRKTETNFGPMVSAAQQEKVKMYIQHGRTVDKAKVLFNGSQEASMPQPTSDGFWVHPVVFTNCTDDMRVTREEIFGPVMCIMPYKTQGRPRQEWLSDLIARANDTPMGLAAGVVSSDVGLAQEVVQKLDAGITWINTWGESPAEMPVGGWKMSGIGLENGHEGISAYMRTKSTLIQLGRGACKGVFSKL

SEQ ID NO: 24488 - protein, 355 aa, Gibberella zeae PH-1
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 24489 - protein, 234 aa, Gibberella zeae PH-1
MADSTNAPKPSSSVKLVLLGEAAVGKSSLVLRFVNNDFQENKEPTIGAAFLTQKCNLPTRTIKFEIWDTAGQERFASLAPMYYRNAQAALVVYDLTKPTSLIKAKHWVAELQRQASPGIVIALVGNKLDLTGDSSSVAGADGEEGDDSGDARKVPTEEAQAYAEEESLLFFETSAKSGHNVTEVFTAIANAIPETSLKSARGAGASNAASRGSEEQRVNLGGPKDAGAKDSCAC

SEQ ID NO: 24490 - protein, 444 aa, Gibberella zeae PH-1
MASSTAEFWSKADSYVMTTGVPFSPVIISKALGTRLYDTNGKQILDFTSGQMSSLLGHSHPEVVEVVKHYVSELDHLLSNMITHPVVNLAERLAKFLPSPLQKSFFLNTGSESTEAAIKIAKCYTGKFEIVAFSASYHGLTQGSGSATYSAGRSRGGPTMPGSLAFPAPYGYRSPFRKADGSWDWETEMDFGWSLIDRQSVGSLAAFIMEPILSTGGILDLPTGYLKRMQDECRKREMLIIMDEAQTGVGRTGKMFAFEHEEGVVPDILALSKTLGCGLPLASVSTTSEIERGCKEAGFLWLTTHLNDPLTAAVGDKVLEIVERDNICQKASERGQQLRAGLEKLQQKYWCIGDLRGRGLLQGIEIIADPKTKAPGADLGQAISDKAMELGLSCNVVNLPGMGGVFRLAPAVTVTAEEIEQGLEILDKSFGAVLELRGQMTAAA

SEQ ID NO: 24491 - protein, 1094 aa, Gibberella zeae PH-1
MDRPAKRQRSTEFEAHAPESLQRSISPPRKRARKPVAIPSPWQLTWIQDLPESENKDAVSLRDLLGDPLISECWEFNFLHDIPFLMNAFDPDTRHLVNVHLVHGFWKHEDKNRIALENAAAKFENVNVHIAPMPEMFGTHHSKMMILFRHGDTAQVIIHTANMIPKDWTNMTNGVWKSPLLPRMSKTQTPASSPEEFLVGSGERFKIDLLNYLKFYDKRKIICKPLSDKLKQYDFSTIKAALIASVPGRHDAHDMSETSWGWAALKRCLRHVPCHQHGDSDIVVQVSSIATLGPKDDWLQKTLFDHLGRCKDTGLRRPRFKVVFPTADEIRRSLDGYASGLSIHTKIQSPQQAKQLEYLRPMFHHWANDSPGGTKLPDGPVLESGRKRAAPHIKTYVRSNKSSIDWGLLTSANISKQAWGEAARPTGEMRIASWEVGVLIWPELLEPGSVMKPPLVLFLVPSLLLHLSLISCNQRIALRRGAGVSPYGTPRGSGAHPALSSSWRVGSPLAEAALAADIAACSDEEYDDSAIDDDVSVSDLPGDPIMYRRPSGVAFGGSRPIMNPQIYDEPGLTALERKQSRNAERSLLRDNHVLPPKHGHRQQDGFFTRIYQRLFSTKIPQDEEQAPAISVQPPSETDPLLGSRVDAVSPEHLNETWEHAVAEHRIKTTWQREAKTIASYSAPLIVTFLLQYSINVTSIFAVGRIGKLELGAVSLANMTAAITCLAPFQGLATSLDTLCAQAYGSGHKHLVGLQFQRMTCFLFVLAVPVAVFYWFSEGVIRALVPEPESARLAGMYLRVMIFSIPGFILFEGGKRFTQAQGLFRATTYVLLIVAPFNVFLSWLLVWKLEWGFIGAPAAVAISTNLLPIFLFLYVRFINGRQCWGGFSRRALSNWWIMIRLALPGMIMVEAEWLAFEILTLMASRFGPEYLAAQSVVTTITTLSYEIPFPMSIAASTRIANLIGAGLVEPAKKTGVVAFAAACLIGMFNLTLYTTLRYKLPLLFTKDDDVIELVAEVMPIVSVMQVFDGLAAGAHGLLRGIGKQSIGGPANILSYYALSLPVSLALAFGLGWKLEGLWIGVTCGTISEINEKFEH

SEQ ID NO: 24492 - protein, 361 aa, Gibberella zeae PH-1
MPSTTHSEFGTNTEAIDVAKAFSDGIHGETILITGVNRGGIGFSTAQAFIKSTQDPALIIIANRTLAKANDSIDNLKAEFPNVNYRFLEVDLSSQTSVRKAAEQVISWSDVPTIDLVINSAGVMGINERTITEDGLEMHLATNHIGHWLLTCLIMPKLIKAAEDKPKGSVRIVNITSASPMRSAMRWSDMNFDKKNKDLPQEEQPVYQFLKLWGYTDVEDAAYLPLDGYNRSKVANVLFGIGATKRLFNKYGILSLSAHPGVIWGTELGRNFPQATIDAAKKMGEKGLYTLKSLGAGASTGLVAALDPKLAVDVCEGEGNHGSYLVDCQISDQANPLAVSSSEAERLWEVSEKATGSEFAW

SEQ ID NO: 24493 - protein, 127 aa, Gibberella zeae PH-1
MSKLYVGNLSWNTTDETLRQTFSEFGEVTDSIIMRDRDTGRARGFGFVTFSTEEQATAAVDALNEQELDGRRIRVNVANARPAGGNGGGFGGGRGGGYGGGRGGYGGGDRSYGGGDRSYGGGDRGGY

SEQ ID NO: 24494 - protein, 478 aa, Gibberella zeae PH-1
METSEKKELQQEQLDQHVGQVSETSNDAERKVLSKFDMFVMPQMSLLVLFAYLDRTNIGNARVFGFEEDTGMHGTQFNDVSMYFYISYVIFETPWVLAVKKFGPGRVLAIAIVSWSAITVGTGFVNSYGEVVALRVLLGFFEAGLFPSLMFVVSQIYPPACQGKRMAVLYVSIALSGALGGLIAYGIQSMGTRHGFSAWRWLFIIEGAISLVIGAACWLSLPASPETAWFLNAEEKETMNIIKERNNPFKETEEFSWKQVGMAVTDPLIWLASVALFCSSIALFGFGTFLPTLLRGLNYSSLQANYLSIPVYVLASIFTGVTTYVSDRLNRRAICLIHSPLLVAAGYAIVVGTGHKGLGFFAMFLVGSGVYSFNTLVVTWISNNVQPDYKRSVAIATIISIGNASGMAASQIYPIQDAPRYVKGNAISLGGELIALVCVGIIYGLLKYRMRQKAKLLAMGKDSNGKEDDRSLDFEYVF

SEQ ID NO: 24495 - protein, 1870 aa, Gibberella zeae PH-1
MKGSDSLRRANRPAANFDLPPVALAQAQQQTQVQAQAQAQSFQSQSQPQESITNTVTSTSPEITNASLHGQAQAKAQALTTARFRSSSRPSLQDLALVDGTSTSNNHDLPPAYALSSSSSSTGPSSFSYPPAHVHPRPSTANAAATTHTHTRPRPLGPSSSDIATAEQAQFLRIHPVSSTSSLRPRSSTTSASAVASASASTSPSHTPNSLLRQHTSPPSAVDNNSAHFVPRGGLPPAPSIMYQANQRHVSGTDPSRPYQVPPPPPPPMGGPNNGHMPNMMNLPPPPPLPRYNTAPGSNGLSLPPPPGPPPASALGQQPPWHGAFGRMYDSRSGFNIPPPPPSSQHQPYNPKLHAQIAAGQTVSIPPPPPPNEAMSATYIPQGDTYGEGVGIPAFGLEDPTLTVNSQTLRPVTTPQSGTDTNATTPMDEATRERLYAANNAQPRGTSNSSNPTPPGSIPPEIAAQWPLDTVLLWLAQNQFSKDWQETFRALNLHGAQFLELGSGHGGRGNFGMMHQQVYPRLAQECTNSRTGWDQPREREEGKRMRRLIRSIVTGRPADVSKVSTSHGRKESLNGGHGNNLPSAGTDPMDSPNTPLTAPGPGFSSRRFSQTRSTTLPNSISASNINSESNHRNILKHVDTDGARRHSPNVSESSEATFRAPAVHSASPTGSPGIPPALYTSTTTPTIAQSPSAIKAGHRSRSSMDSVASVAAIYGSGVPSDAASLLNRNMNLGDIVHGRSHDARSRHSPSDGGDRSAGGETPSSAKDSNRLLSFLSRKKKQTKDDGAYPSPEDMNGSPTSPHGSFRPVGLGVRGSNGSDTNIDLSGSTLGDDRNGSTLNMRWNKISPVRTYVLATMDYWNYRMCDITEAETATEIRQVICMHLGLGDYENSHIYLTEAGKFEHVDPLDDPSLITVRRAKGDPLGTLKFFVTPPGVAPISSLSVKAEVPIILSPSYLSPGTPVEDAQQMSRQRSSSSPPTSRSNTLTNEKNEDKIAREAKQYRAEIERKQQEYLAKRKQAAMKGSPSETLGPGIVGRNVDFDQPRESPYEDKRPEPLFPQRRPPAPPSDPSATLIKANSLSRKTGASMRASSSSLEGYPSKRYPENEMAEKTKKANKQAPPAPGIGAALAGMGRNLSAIGQSAKNGRASSPSRSSTHSIPGGKDTFSTVEPSQGRGSPSTTSSSKLTTGNVTWNKKNLGFIVPDYSPSDSSFLLSPSPTVDAKFNATVPRAMSPAEMSPNSSRSRTSFPPNQQSPTHRRASHGPEPEFEDTDVHFSKPAPAPPADDDSDDSDDGLFAIPIANQNKGKAAAANADANGHSKRPSLHVNTERSRKGLSVAFKSPKSFGSGMDSNEDSGRQNPTTPHSETWEPEEKDKESKLGRRKSFIEKDVWANRPPTDALINNLDDFFPNLDLDQPVLDEPGESGMPPSPIAESSETNIDQQAQNVAPPQPSYPQHVPPAIPPTRQPSLYNENDTLGSDESTLKALDQHRPTSVAQRSIRRSGGLGRMKSIREVARGAHEANKRTTSTNQGQAATTNIMRRKSTKMFNANIVQIRPDRRGSVVMPQIPQDTVPKRQTTFRWFKGQLIGKGTYGRVYLGMNATTGEFLAVKEVEVNPKAAGGDKNKMKELVAALDQEIDTMQHLDHINIVQYLGCERKETSISIFLEYISGGSIGSCLRKHGKFEESVVSSLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGKRPWAKEEAVGAIYKIANGERPPIPEDIQDTLGPLAVAFMMDCFQVNPFDRPTADVLLSQHPFCEVDPHYQFYDTALYHRIKSFK

SEQ ID NO: 24496 - protein, 1049 aa, Gibberella zeae PH-1
MLRARNFQERGNSYVCAFCRHKLTPRDSQLRDRHVSKVAASITSARATGLSSCHSSQIPGVRALSTTSALRGLNDGGKPGGFPSGGFPGGFGAGLGSFGAFANKPVTETAKQSVELLPHEIEARKKMGLPLKKPPSKPAPVQAKDNAKTMPAGQNTSQNQAQDNGRGLGQNQRAKGNQKFGRFNEKNNNNMKQTQTQQIQQTQPTQKQQNQDSKPPFNPLSSSILAEAFKTDRAPAPVVTPRARSTNEPPKPATPTWGAFSSRKIDTHVPLMKSQAEAKPAEKQTEVQPQTPPPSTIRGGSDAVWGQLKRSRRSIGEKVEGQEGGFWDELETRVTNIRNRPSPAPEVTDVYQSTLQGDGLLSQEGQQALEDQPRRKSRFEIEEEEERNKRDKKGKRPKNVRQNNYEDEDMDEDAIRRWESRQRKKAEKDAKKHLEVAAEAAPLPIFIPEYISVSNLASALQIRVADFLHDLESMGFEEITEETIMTGDTGALVAQEYGFDPTVDTGSQRDLRPRPAPEDPSLLPSRPPVVTIMGHVDHGKTTLLDWLRKSSIAAQEHGGITQHIGAFIVQMSSGSQITFLDTPGHAAFLSMRQRGANVTDIVVLVVAADDSVMPQTLEALKHATGAKVPIIVAINKIDKEDARVDQVKADLARHGVEIEDYGGEVQVVPVSGKTGKGMEDLEESIVTLSEILDVRAETDGMAEGWVLESSIKHTGKTATVLIKRGTLRLGDVIVAGKSWARIRGLRNEAGVDIREAPPGTPVQVLGWRELPDAGEMVLQAPDESKAKTAVEYREEMAERQESSKQLAEQEQRQREKAAAEEAAAAAEEEGVEVEPVAAEPGIIFQNFIVKADVAGSVEAVCGTVQELGSNEVQSKLLRSGVGAISEYDVDHAAASKSIIVNFNIPILPHIRQRADEAGVRIIDHSVIYHVVDDVKEALSDLLPYKITHKVLGEADVLQLFSINVRKRVSKSIAGCKIRNGAIKRTSTVKVIRRGEVVFDGKIDTLKHVKKDVMEMGKGSECGIGLEGFEDFEIDDQIQTYEEIKEKRTL

SEQ ID NO: 24497 - protein, 258 aa, Gibberella zeae PH-1
MGFIEDELKQLKDVISTIDTRIKKLEARATGGPVSTDEIRMILIGPPGAGKGTQAPKIKERFSCCHLATGDMLRSQVTKKTPLGVEAKKIMDAGGLVSDEIMIGMIKEELNNNKECQGGFILDGFPRTVPQAEGLDAMLAERKQKLQHAVELQIDDSLLVARITGRLVHPASGRSYHTTFNPPKEYMKDDITGEPLIQRSDDNADALKKRLVTYHKQTKPVVGYYQKTGIWSGLDASQEPGQVWKNMLKVLNEKRGQN

SEQ ID NO: 24498 - protein, 437 aa, Gibberella zeae PH-1
MSPHAEKTVSRFHATSTDKAIAIEEEYAAHNYHPLPVVFSRAEGVNVWDPEGNHYYDFLSAYSAVNQGHCHPELIKTLTEQAGRLTLSSRAFYNDVFPKWAEKVRSVFGYDMVLPMCTGAEAVETAIKIARKWAYKVKGVPQEKAWIFGVSENFHGRTMTAITLSVDPESRENYGPYVPNVGAINPTTGKAIRYNNIADLEEVLEAHGKETAAFICEPIQGEAGVVVPDDDYLAKVQALCTKHNVLFICDEIQTGIGRTGRMLCSEWANIKPDLVTLGKAISGGMYPVSCVLSSKEVMLVVEPGTHGSTYGGNPLGSAVSIRALEIMEEEDLTAKADKLGNMFRDGLKALNTPILKVIRGKGLLNAVVIDESAANGRTAWDLCLLLKSKGLLAKPTHGDIIRFAPPLVISEEDLKKGLNIIAEAIKELPTVEPAKHH

SEQ ID NO: 24499 - protein, 396 aa, Gibberella zeae PH-1
MKSALLTAAALLGSAQAGVHKMKLNKVPLADQLAMNSVEDHLQSLGQKYMGAARPKNAADYAFATNVPSVEGGHPVPVSNFMNAQYFSEITIGTPPQSFKVVLDTGSSNLWVPSQECGSIACYLHSKYDSSASSTYKKNGSEFEIHYGSGSLSGFVSNDVVSIGDLKIKDQDFAEATKEPGLAFAFGRFDGILGLGYDRIAVNGMVPPFYQMVNQKLLDEPVFAFYLDGQEGQSEATFGGVDKSKYTGDLEYIPLRRKAYWEVDLDAIAFGDEVAEQENTGAILDTGTSLNVLPSALAELLNKEIGAKKGYNGQYTIECDKVSSLPDITFTLAGSNYSLPSTDYILEVQGSCISTFQGMDFPEPVGPLVILGDAFLRRYYSVYDLGKNAVGLARAK

SEQ ID NO: 24500 - protein, 426 aa, Gibberella zeae PH-1
MFRPILRQCAQRAATPLRPCVTRTFASASGPSFNWEDPLASNNLLTEEERAIGDTAERYCQEQLLPRVLKAYRDESYDPKILEEMGELGLLGATIEGYDCAGASSVAGGLITRAVERVDSGYRSGMSVQSSLVMGGIYEHGSAEQKEKFLPKMAKGKMLGAFGLTEPNHGSDPGSMETVAKPHPTKKGYYSLSGAKTWITNSPIADVLMVWAKLQETGKIRGFLVERKDCPPGTLETPAIKDKNGLRASITGMIQLDNCPVPENNMFPEVEGLRGPFSCLNNARYGIAMGVMGALEDCLARARTYSLERKQFKGNPLARYQLVQKKLADASTDAAYGTLAAIQVGRLKDEGKATPEMISMVKRQNCDTALRNARLLQEIFGGNAASDEYMIGRHVANLFVTQTYEGQSDIHSLILGRAITGIQAFV

SEQ ID NO: 24501 - protein, 156 aa, Gibberella zeae PH-1
MISFFTQTRTMTTIASLKRLSAKSLSEKILQEVDATDPTFAVIDVRDNDYIGGHIKGSTNVPAHTLDSMMPTLVRRLKDKKTVVFHCALSQQRGPSAALKYLRERDGLLCSMGEDPKGESGQDVFILDQGFSGWQEVYGEDERLTEGYVKDLWENY

SEQ ID NO: 24502 - protein, 382 aa, Gibberella zeae PH-1
MKLLNLLSLAGLAAACAHDHDDKQWTKEELNELEDKWGYEWPFAGINTFAHLKHVKCLTEPTEPFDIAIVGVPFDTAVSYRPGARFGPRAIRSASARQTSMRGFNPRAGINPYQNWAKIVDCGDVSVTPIDNGIAREQMTQAFKQLGRRRTVSALAPKARLVTLGGDHSLALPALRALNEIHGKPIQVLHFDAAYPSWWGATHFNHGSMFWMANQEGLLSNSSTERSVHAGLRTRLTGTDFSDHEDDSSQGWVRFTADDIDDLGTKGIIDGILKVLGTENPVYLSVDIDVLDPAFAPGTGTPEPGGWSTREFIRIIRGLEGLNLVGADVVEVSPAYQNGGEETALAAAQVVYEIISSMVKRSLQDGGKEGNGGNAAEAKDEL

SEQ ID NO: 24503 - protein, 195 aa, Gibberella zeae PH-1
MAVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVRHHCPGVPCLIVGTQVDLRDDPSVREKLSKQKMQPVRREDGERMAKDLGAVKYVECSALTQYKLKDVFDEAIVAALEPPAPKKKSHKCLVL

SEQ ID NO: 24504 - protein, 478 aa, Gibberella zeae PH-1
MATYYDAIIIGSGQSGNPVAKAFANAGHKTAVIERTALGGTCVNVGCTPTKTMIASGRAAYMARRGKDYGVHAGNGNFEIDMARVRQRKRAIVEQWNSGSVRGLNAAGVDVIMGEGSFVGDKKLKVVLNDGGEKEVSADKIFINVGERPLRPDISGLDGVEPARVLDSTSIMELDAVPEHLVVLGGGYIGLEFGQLFRRLGSEVTVIQRAKQLVPHEDPDVAECLYDILQQDGLTVYLSSTVNSVSASTDSKMPFTVNVQTANGQTDVAGSHILLAAGRVPNTDRLNLSEVGIKTTSKGHVVVDDKLQTSASNVYALGDCHGGAAFTHISYDDSRIIRTNLLPKTMASTTPAMPTTQSSTSRVLTPYVMYTDPQLGHVGLHARDLFNSKREVKIAKMPMSYVARALETAEPRGMMKATVEAKTGEILGFTCLGLEGGEIMSIVQTAMMGNLKWWDLEAAVYAHPTLAESLNNLWGHLE

SEQ ID NO: 24505 - protein, 467 aa, Gibberella zeae PH-1
MKPTYSTLFLSLLASTEAISLHKREHGLEPRVMSVPIQRRQIDNPLAHDRKRLNRRAGTVNVGIDNEQSLYFLNASIGTPPQNFRLHLDTGSSDLWVNSVNSELCDTHANICAESGLYNANKSSTYEYVNSGFNISYADGSGASGDYVTDTFRMGEVSIKDLQFGIGYITSDNEGVIGIGYTSNEAVVDQPDPEFYKNMPARLASDGVIASNAYSLYLDDLESATGKILFGGVDEQHFIGDLVTVPIMKINDEYSEFYVKLQSINSGSEIVGEGLDLGVVLDSGSTLTYLPSSVTDSIYQLVGADYEEGQTTAYVPCDLANQGGNLTFKFTSPAEITVPLSELILDFTDITGRQMSFTNGQAACSFGIAPSTSQVSILGDTFLRSAYVVFDLDNNEISLAQSNFEATGSHILEISKGKNAVPSATGSDGPQSSGSENAAGSLSPLGSTGAVSILAGAMALTFAWFLI

SEQ ID NO: 24506 - protein, 1078 aa, Gibberella zeae PH-1
MEIIAKERVCPMKHKMNALEQMWDQVPATIQHAVELIQRVGEEYIWVDRLCIVQDDYETKQEQISQMAFIYGNAYFTIVATAAHSAEEGLKGIKDVSPSMYHNVWPERANMDHYGLVAWSPWNERGWTLQELVFSQRSLFFHKNELTWECHCAIWHERMQLADIGETSCLGTHNPNARGFRYSPWPDLQEFHQLATSYSRRQLSFSSDILPAFAGITTALAHSFPGGFLFGLPEVAFDVTLLWRSAGPASRNSKLGEASVPSWSWMVCLDQKISVDLSPWASGFAYLAGSSSEQSDEGGRRTYTPLHVAYQQEWNSRWSRKRPPAGVLDGLVTESICSWYVKEEAGERLISNDLDEFKDCSHHQSNELPMGWKRDGDLFYHLVDPQRRFKYPIPLVTNEDDIFIEKYLSFLIKTRTERAFFYNTPEPYGQAVSMLEGEAVVNICNNEQVWVGCLRVQTRTILWRLLTKKVECELVAISKGYIDSSAGGWSRLDEHEALKSRELERYEFYNVLFIEWKDGVAYRQGIGRVDKTAWEDPVSKPTSTTMMSRASVAVIGAGPTGITMLKQLLQDGFNATLFERRSQVGGLWAYDAKHGWTSALDSTTANISKYTCGFTDYPIPDRYPVHLTPADFQEFMQGYAEHFGLLKHITFDTSVKVVNRNKEDNGWDVQVENVESGQTDTRHFDKVAFCHGYQTLKKMPIFPGQDHYKGDLMHAQQYRSPESFKDKTVVILGLATTTDDIAPQVVSVAKKVFVSHRSGQIVVRRFRKGTPSDLLVSWRRRVISQWIAKNLPNTYRFLANTLAKLLSSQMAGMKLDPAWRLKDFKDLTLSLPGIIENVLPLLKDGSVTSLHGIKRFTGGKSIEFEDGTIIDDVDSVIFTTGYQCDFSPAPFVEKSIPKLPNYGGPSIHRLYMNVFPPKYADSCVMLCFSAYGKNNGFSFSDVMNMAISNIWRGVSNLPSHQEMEQWVDHHHEWLASNWAREPTVDLSMVKQYEFQPWMHKQAGTGMENLGWGWAGWKFWWKDRKMYNLMNHGVETAHMFRFFETGMRSTWDGARDEIIRQNRIVKEAFGGKKNKTRSD

SEQ ID NO: 24507 - protein, 359 aa, Gibberella zeae PH-1
MFSSMILLSGLVASAFAHPTVEPRASCTFTDAASAIKGKGSCSTIILNNIAVPAGTTLDLTKLKDGTHVIFQGKTTFGYDTWEGPLISFTGNNLLIEGADGHSIDCQGQRWWDGKGSNGGKTKPKFFSAHSLQNSNIKNLNVINTPVQAFSINGVTNLGVYNVHMDNSLGDTQGGHNTDAFDVGSSTGVYISGAVVKNQDDCLAINSGTNITFTGGNCSGGHGLSIGSVGGRSNNDVKTVRILNSSISNSDNGVRIKTVSGATGSVSDVKYDSITLSNIAKYGIVIEQDYENGSPTGTPTAGVPITDVTINKVTGSVKSSGTDIYILCASCKNWTWTNNKVTGGKTSDKCQGVPSGASC

SEQ ID NO: 24508 - protein, 322 aa, Gibberella zeae PH-1
MRLLNLVFFSGIVTAAPGTTLHARAAANDPCNIGYCTQNGGTTGGGSATQVTVKTLGELTTAANAAGPAVIFVQGSISGAAKVQVGSDKTIIGKTGSSLTGIGLTINGKKNVIIRNMKISKVEATYGDAITIQKSTNVWVDHCDLSAVRGDDKDFYDGLVDLSHAADWVTISHTYLHDHSKGSLVGHSDKNAAEDVGTLHVTYANNHFNNVRSRGPLLRFGTAHIFNGYYDTMDTGLNSRMNAQALIQSSVFTNVGKKAIFSESSSEVGYVVAEDVVLNGESQNTAPKGTLSASKIPYKFTLLGSGKVASTVPGQAGQKLSF

SEQ ID NO: 24509 - protein, 368 aa, Gibberella zeae PH-1
MAPLDNPAVPKGSVVLVTGVNGFLGSHVAKQFLEFGYKVRGTVRDPAKNSWLSTAFDNQYGQGNFELVKLADMTSEEDLKEVVKGVSVIAHTASIMSLNPDPNKVIPDAIAGALTALKVAYGEPSVKRFVLTSSSSAATISMPGKPHALVNEESWSEGAVKIAWSDPPYTMARAGAVYAASKVQSEQAIWKYHKEHQSERPDLVVNTVLPNYNWGKTIDAANQGYPSSSGLPVMLYKNKVATMHRRTAPQYFIDVDDTGRLHVAAAIFDHVKDQRIFGFAGRFNWNQVLDILRKHYPEKTFPENFADGEDANEIEPRDKAEQLLKDLGRPGWTSLEDAIIANVEDLDKDGDDVWYKDYAELESLAQPA

SEQ ID NO: 24510 - protein, 1755 aa, Gibberella zeae PH-1
MSDKTRQSSGGRSLFSRSKHKEKRLNEDLRYPADDAASFRSSRHKRESSAISFDGRPESSDGGINQMAGVITSIPYDTIGGGSRSPVPVEYLPKGEQMPVRRGEPLPHHLNQNGQDYHQYPSWDGSGQSGARSPGRQPAGFGYPNANVTMASTGRQTQYQQWGPARGSSSHSNNAPNPRYDSLMSSTARGSADNLSIQSGNSRHAHTMISRSPRTAMPSASSQSSYAASQYSNRDSHRFTKFPSGPPPGQSDPQGGFYFPKPDDDNVVEQMFLQLMQKRGWHNLPEQARRQMMAYPAQKKWTLLYQDRLTEWQGEQKRRQTARPTQYTATPDITTYSDEEGTPEWYVRRVMEDRLDTKGMGSLEVNLRTQQIGWVKRFVECQGQVALMTLLLKINRKTAQGPAQDSGRIDRGLDREYDIIKCVKALMNNKFGADDALIHQKVMVALASSLISPRLTTRKLVSEIITFLCTWGENSEGHLKVIQALDEVKVASGENGRFDAWMRLVEVTIDGRGKMGSLVGASEELRTGGIGMENLLMEYAVATLMLVNMIIDSPERDLELRIHIRAQFTACGIKRILTKMEEFQYELLDKQIERFRTNEAIDYEDMLERENSSIKDDVEGEVKDLTDPVQIADAIQQRLQGTKTQDYFISALQHLMLIRANDGEERLRMFQLVDSMLSYVAMDRRLPNMDLKQSLNFTVQSLLDKLHTDSEARQAQDEALESRQIAEAAMAERDEVKAQLELGADGLVAKLQRQLEEQARFIDAQRRQADGLKAELDSMQTMRAKEAQRYELETRELYLMLRDAQDVAASKAIKSANVTASKTAPPEDPARMQGILDRNRLMERLQMQIERQKTQYKLEGRVWGDAVGPSDRLRALREEMDDRPGTPPGGGTPPRDFTNSVLGSINRNTKIPRKPLKRRSDGEVIEEDDETEGEDGVVYEKPRIVEMKRPTIDAKQQAGLLGEIGSKVKKYDGSDSEDDTTGPSHPSMETSSPITPPGDGETPKIEVTAAGAAPPPPPPPPPPLPMPGQLSGAPPPPPPPPPPPMPGQIPGGPPPPPPPPPMPGMLGGPPPPPPPPPMPGAGGMPPPPPPPMPGGAMSGHYLSRQPAFGATPGIGLPVVRPKKKLKALHWEKVDAPETSHWAAHTPSAEAREEKYQELSKKGILDEVEKLFMAKEIKKIGMGGSSKKDDKKQIISSDLRKAYEIAFAKFSQHSVEKVVQSIIQCDSEILDNVVVMDFLQKDDLCNIPDNTSKQMAPYSKDWTGPEAKSQTRELDPTELTRQDQLYLYTAFELHHYWKSRMRALALTRSFEQEYEEINDKIRQVVTVSESLRDSVSLMNVLGLILDIGNYMNDANKQARGFKLSSLARLGMVKDDKNESTLADLVERIVRNQYPEWETFADDINGVMTVQKINIEQLQADAKRYIDNIRNIQMSLDSGNLSDPKKFHPQDRVSQVVQRIMKDARRKSEQMELYLEEMMRTYKDIMVFYGEDPADDGARRDFFAKLALFVGEWKKSRDKNVQVEETRRRNEASMKRKHTAQLKLTSNSTEAGPISPSNTGAMDSLLEKLRAAAPQARDQRDRRRRARLKDRHQVRVASGQKIPDIDEIPEAEATIKAAEAPSEDDSTVLSPGMSSPRSGGDDLADRAAALLQGMRSGDGADDENPERRETLRKARRQTAEEERRLRRRRRDRTATNQSEENAEEHKEESRPESKGGEDEAAKEQHSEAEPPTEDDVPTPKADAAGDGAVEEDHGEKA

SEQ ID NO: 24511 - protein, 348 aa, Gibberella zeae PH-1
MPSAYPKSILPPSLVAVTGANGFIAQHCIALLLSKGYRVVGTVRSATKAEQVFDLHHKNPNLSVRVVEDITSTASYLSAFGPTGPDAILHLAAPFNYDATDLEDELMIPAVKGSTAILTAARQLGSVKRIVHTNSFAGIYDASKGLQPGKIYTAKDWSPLTYEDGVTAPNAAVAYRASKTVAEQVAWKWMNDNPSAQFDLVSLNPAMVFGPWLEGAIPGSPKQLNTSNKIVYGIISAGEEGPIPPTRGPVWVSVEDVALAHLRAIQVPEAGGERYLLAAGVYCNQEIADIARKIAGKYKNKIPRGSPGLREATTHFGVDASETQKGLGIEWQSLESSTNIKPLITQVP

SEQ ID NO: 24512 - protein, 327 aa, Gibberella zeae PH-1
MSFNPNNDIPDLSGKVIIVTGASSGLGKESALQLAKHNPATIFVTARTEKRGNAAIKEIQDAVPNFKGQIKFLELDLSSFASIQKGATAFLNQSDRLDILMNNAGLMATPAGLTTDGYEVQFGSNYMGPALFTKLLLPTIVRTAQQQGDARVINLSSELFKQAPKEGVLLSRVKTPLEDISSLARYGQSKLADYYHTRSLSKYYPSVKFVAIHPGVVNTGLFDDLRKRRPWLGGLIGVMGSIFLTDVHAGAKAQLWASTAKSESVRSGGFYNQKLKEYKDAVLDDEKAVEELWDWTEKEFAIIITSIQQKRKVIVEVGYAKLPLQLS

SEQ ID NO: 24513 - protein, 499 aa, Gibberella zeae PH-1
MTTVGGIAEPKMSAWLIFSIVVISMGSIFWGYDIGILSTIYVSPGFNKALDNPSSSDKGLITSIFYAGQFIGFAFFAGPLNNRYGRRWAGFGGVCLLCVGAAIQTGSVHLAMMVVGRIVAGLGTGVVSTSVPLYLSEISPAKNRGLYVAANQVGIVSGISIAFWVGYGYSFWKTGNGVDLEWRLSNAMQFVPAVLFLVGVPFIPESPRWLVESDQIEAASRSLSKLRGLSPSEVQPELDEIHANILWHQENSITSARVFIQQKPLWSRLWRAWSLAFLQQMSGAAGIRYYLPTNFIAAGTSKELSLLASGIDGTVQVACTVAAMFFIDKIGRRHSLGVGAIIMAFCLMINGALQLAYPGQTNSHANYVNIFFIFFFTVGYSMGFGPCAWIYASEIFPANCRSKGLGISSSGASLGSIIVGQVWPVAVSRIGPRVYFIFMSFNVFSAILVYSCYPETKNKTLEELDSHFGSLNVHAEEVATPKQMLAVEEELVQARTKDA

SEQ ID NO: 24514 - protein, 328 aa, Gibberella zeae PH-1
MVKHASKATVHQLAKEYSSIIKGKTILTTGVSPGGLGALFVEAIAVAEPELAILAGRNINKLQQTADHLASKHPNLKTKLLTLDLSSLASIRSAAQQVNGWSDVHKIDVLVNNAGIMATDFKLTEDGFENQFASNHLGHFLFTNLIIDKILAAEAPRIVSVSSNGHRLGPIRWGDANFSNGDLYNRWNAYGQSKTANMLFAISLAEKLGSRGLQAYSLHPGAILETSLGDHLANLDSLVEADRAIGDPWGWVDWSTVPVTAEVGAATHVFAAFDPDLKDHNGAYLLDCRLADPFTDTVRPWATSSTEAELLWRLSEKMVGQKFPLKLQ

SEQ ID NO: 24515 - protein, 331 aa, Gibberella zeae PH-1
MPLPAKPLDAISQAFPPKPHFTESNVPDLTGKVTIVTGANTGVGREIAQVLYSKNATVWVAARNEKKGLDAIEGIKKQHPASKGSIKFLKLDLADLTTIGPSAKEFLAQETKLDILFNNAGVMTPPEGSKTEQGYELQLGVNCLGHFLFTKHLTPLLQSTAKSAPKNSVRVIWVSSSAADVLSPKNGFERDNLDYHQPRNLMHKYATSKAGNYYHNTEFARKYKNDGIVSVSLNPGNLASELDRTSPWYMYYPRMFTTYPSINGAYTELFAAFSEEITTENSGIWVVPWGRFMPIRPDVQKGALPESEGGTGMAEFFWNWSEEQIKPYFST

SEQ ID NO: 24516 - protein, 492 aa, Gibberella zeae PH-1
MAEITITGAGGRKIQIPTGLFINNRFIPSTTSETLTTENPTTNTPLGQVSAAQPSDVDAAVSSSKEALKTWKTSQPAERRRLLNRLADLIERDARELASIEAIDAGMLFNMSLGFCIVQAVETLRYFAGWADKIDGQSLEFDQGLAYTKREPIGVCAAVVPWNTPLLITAWKLGPALAAGNTLIIKTPELAPLYGQKLAQLVLEAGFPPGVVNIITGLGPVAGQALADHHQVRKISFTGSLAVGRTILVSAAKSNLKRVTLELGGKGPSIIFNDANFENALAFATAGITMHNGQICAAGSRIYVQADVYDRFVSEFAAKTRDAVMGDPLLDDTVKGPVISSTQKNRIMEYITKAKSEGIELLHGSAEPDSKGNFVPNTAFINVSPTATIMREEVFGPVASFAKFKTEEEVISLANDNEYGLAAAVFTNDISRAVRVSDQIEVGIVFVNTWGSISANSPFGGIKQSGFGRENGTDALNDWTQVKCVKINVFNL

SEQ ID NO: 24517 - protein, 241 aa, Gibberella zeae PH-1
MGESRQELVAWLNSLLQLNITKVEQCGTGAALCQVFDSIYMDVPMSKVKFNVNSEYLYIQNFKVLQNTFAKHQIDKPIPVPSLIKCKMQDNLEFLQWTKRFWDLNFPDHEYDAVSRRKGGSMPPSAAAPKPVSATTGAARRGGSTPSGGPRVAKAAGPATAALQQENATLKETVVGLERERDFYFSKLRDIELLVQTAVDEDPELEKLEDGLVKQIQTILYSTEEGFEIPAEGEVDDQETF

SEQ ID NO: 24518 - protein, 1028 aa, Gibberella zeae PH-1
MTNIIPRRLACPNDDIDRRRNTAPERFLRGSRLKSRPFYTTVFLLSILTAYSFLSHTTFAQSGSNHAADPHHLFKRSSSTDTPECNQVHDAQDKCAFVRKYCTDDDAGLVPYIELYYCAFGNVRPIAFSILVAWLGLLFTTIGIAASDFFSVNLSTIATVLGLSESLAGVTFLAFGNGSPDVFSTFAAMGSNSASMAVGELIGAASFITGVVAGSMALVREFRVDRKTYTRDICFFIFAVVFTMIFLADGHLHLWECWAMIGYYAVYVVTVVTWHWCSTRRKARQRREGEARSHVYHSGDELAGEPYRDDVDDVGSAPGTAVSTPPDISLLEAGPRIEVEGTPQLDESDMSSEDHDRMVAAEVNSSMRVLRGRGTRRNTMTPIRPSLVGALEFRSALAQLQREGNLQLSTIPGRSYSDYHIHRRRQTTATISDAARSDGRPASGHDGHAPRRNRALSSGDQPVGTASHSDLRIPSRDRGESSLSVPGSTASGTRASSPSPSHTVGGNLAAPLVGPSGTTFDAPSESVRGQIPTPELHLQIPSPSRRSSCSDRSSPNQPFPMYTDSPALLTPNYHNDPVEFFVSPGGVSPSTVVPGLGGRETPFADLQLTVDVPSRPVRWWPYAVLPPPHIVLATLFPTLQGWKEKTAWDKLVSAISVPSIFLLVITLPVVDSATTDGESSFLETIVDLANSHHGIGHMAPPVSVEHSSIEPEGETEWERYRRCSHVSQGSSYLGSAVPPSSAHAAGGEYSTAPHLSLGPPAIVTKPASDFPSSSSARGDCTGWNRWLVALQLFTGPQFAVLVLWANTLEDQESPHKTLIRMVLYTLLASLILLGGLIVFTLEDRPPRYHYMLCFMGFIISIAWISTIAGEVVGVLKTVGVILNISEALLGLTIFAAGNSVGDLVADITVARLGYPVMALSACFGGPMLNILLGIGIGGVMMMVKKANKKHHKNPSLPIKYKPYRIQVNGTLMISAITLLVTLVGLLIVVPMNKWILSRKIGWGLITLWAVSTVVNVIIEVTGAWGEVA

SEQ ID NO: 24519 - protein, 481 aa, Gibberella zeae PH-1
MASLPRNFKLGFATASYQIEGAVAEDGRGPSIWDTFCHLEPTRTKGANGDIACDHYHRLDEDLDLLKRYGSDMYRFSISWSRVIPLGGRHDPINEAGIAFYDRVIDGCLARGITPWVTLYHWDLPQALHERYGGWLDVEESQLDFERYARLCYERFGDRVKHWITLNEPWIVSIFGYATGGNAPGRSSINPQSTEGDTSTEPWIVGKALIMSHARAVAAYNKDFRQSQNGSIGISLNGDYYEPWDKNDPQDSEAAERRMQFHIGWFANPIFLGQGYPQCMRDQLKGRLPAFTPDDMQLLRSAETDFYGMNYYTSQFARHRSSPALDTDFIGNLDELQTNKAGEPVGLESGLHWLRSCPDLFRKHLTRVYRLYGKPIIITENGCPCPGEEMMSREESVQDEYRIKYFEDHLDAIGKSVTEDGSVIQGYFAWSLMDNLEWSDGYGPRFGVTFTDYKTLERTPKKSALVLRQIIDRQKGEQLKL

SEQ ID NO: 24520 - protein, 328 aa, Gibberella zeae PH-1
MKFLGLLNLAALASAVPTPTVQQVGKTLGKRAAITDAANIGYATENGGTTGGAGGATVTVSSLAEFSKAAESDEKQVIYVKGQLTGNNKIRVKSDKTIVGAAGASLENIGLYINKQKNVIVRNLAIKNVVAANGDAIGIQKSTNVWVDHCELSSDFSKDKDFFDGLLDVTHASDWVTISNTYFHDHHKASLVGHSDSNAAEDTGALHVTYANNHWTNIGSRAPSVRFGTVHVFNNYYEDISVTGVNSRMGAQVLVESSAFSNAKKALISKDSKQTGSISVNDVDLGGSTNDAPKGTISKSDIPYKYSLVGSSKVKAAVVGVAGNTLKL

SEQ ID NO: 24521 - protein, 360 aa, Gibberella zeae PH-1
MSVPDKFQGFQSPSAEHWTDFQKNSFEPRPFGEYDVDIKVECCGVCASDRHTISGDWGACPYPLAVGHEVVGKVLRVGDKVTLAKVGDRVGAGAQVWSCMDCRQCKNDNETYCKDQIDAYGADYLDTGFKTQGGYSSHSRVHEYWVYPIPEALSSTQAAPMLCAGITVYSPLKRLGAGPGKKVGIVGIGGLGHYGVIFAKALGAEVWAISRSRAKEEDARKMGADGFLATGEKNWTEGHKMTFDIIINTATSFDGFALSEYLSLLDIHGHWNSVGLPGGDGIEIRNQDFITNGCYIGTSHLGSRREMLEMLQLAADKGLKSWIEEIPISTKGLQQAMQALEKSSVRYRSCMTNYDEAFGA

SEQ ID NO: 24522 - protein, 328 aa, Gibberella zeae PH-1
MDGDPAVDPGLDSFSLTFPLPYRVGFIATLAYLAVLIAMFVVPLRNLPSGGRRRFLATLRRVSIGGLAEPQDGKFGDILLADVLTSYAKVFGDLFITLCMFFTAQGSSTQRPDRNCGGTVLVPFIMGVPSLIRFRQCLIEYFRVRRAPYKESTGWGGQHLANALKYSTAFPVLITSAWQRSVEDPESKAALHKAWLVAVVINSAYSFYWDVAKDWDMTLFSSRQDRESPTHFFGLRDRLVFRTPNLYYLVIAMDLMLRSTWSMKLSSRLDKFSDLEGGIFLIEFLEVFRRWVWIFLRVETEWLRNNSTGLGVDDILLGNYQGKDDEDD

SEQ ID NO: 24523 - protein, 473 aa, Gibberella zeae PH-1
MEKLSETTPNGTSPRTFALNHSRPRSSFKGCSRISDYELLGKLGEGTFGEVHRARLRKTGALVALKKIIMHHEKDGFPITALREIKLLKLLSHKNILRLEDMAIEHPTRQTDKRKKPIVYMATPYMDHDLSGLLDNPSVQFKEPQIKCYMLQLLEGLRYLHDSRILHRDMKAANLLINNKGILQIADFGLARHYDGRTPESGVPMGEGKRDYTGLVVTRWYRPPELLLQLRQYTPAIDVWGVGCVFGEMLYGKPILAGESDAAQLDIIWDLMGSPNEENMPRWKSLPGADHLTPRPRTGNLETRFRQYGSGAVSLLKELLRLDWRTRINAVDALQHPWFKMQPLPLEPHEIPTYEESHELDRRKFHDRKAALPPAPKGGTVGVGPDANGATAGFNSNEPYGNGRNGVNGGRRRDDRPPPPRDDRPPPRDDRRRRNSREDRRFDRDRGTMSRSRSPRHDRSRDRDRPDHNGYRR

SEQ ID NO: 24524 - protein, 247 aa, Gibberella zeae PH-1
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLKPAFVDIINATKQ

SEQ ID NO: 24525 - protein, 370 aa, Gibberella zeae PH-1
MAEFVRAQIFGTTFEITSSPPFIAILTRLARRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLSPYHDPTDEPVAEEKFDWSFNDADLPVDTWKIMMYSEILDYHNVEAGVTNMEEQFNGQ

SEQ ID NO: 24526 - protein, 470 aa, Gibberella zeae PH-1
MGSLTQSSSFDVNKVAIIGAGPTGIAAAKYLIAQGIRDITIFEQQDHVGGIWHYHGFAAGTCPVPQEDPYHPPDEPLKWDSTSPPIFTSPMYENLHANIPKEVMNFSDQPFPEDAKLFPERPMIEDYLIKYSEDIKPLIQFCQRVERVSLKQQDGRDKWEVEAKSTMTGNDGITQAFDAVVVGNGHYSTPFVPDMRNIKEFNEAYPGVITHSKQYRTPCTFKDRKVVVVGNGPSGLDIALQINQECRKPAFLSVRHPTPPDRLHHCGCEEMAEIDEFMVEQKGLRFKDGRVETDIDAVIFCTGFLYSYPFLQDLDHKLVTTGRGVRGLYQHVFDIRHPTLVFPGLNMKAAPWPLAESQAALFAAVWSNNLELPSRGVMEAWNMELEKREGEALHMFGPNGDGLYINELHDWVMTAKRPGKEPPHWDRELMWQRSVFIDAKVKFEQLGCKARTMKEVGFCYEPDNTQTSTA

SEQ ID NO: 24527 - protein, 490 aa, Gibberella zeae PH-1
MASPKLSDPSLIKNACYVNGQWVAAKSGKDFSVENPASLEKLGSCPEFDANDTEAAIAAADAAYKTYRKTPARQRARYLRRWYDLMMENADDIARLITLENGKVWSDAKTEAVYAANFFEWFSEEAPRIYGETIEASNPSCRLSTIKQPVGVCGLIAPWNFPAAMITRKAGPALAAGCTVVIKAPAEAPLTALALAELAHRAGIPAGVVNIITALDNTAEVGKVLTTHPKIKKVSFTGSTGVGRLLMNQSSSTVKKLSFELGGNAPFIVFEDADLEKAVKGIITSKFRNSGQTCVCANRIFVHRSIYDKFVQMVLDVVKTFVIGDGFGEKTTHGPLIHGRAVAKTAEHVEDAISKGAKLIHGGERLADLGPNFFGLTMLTDMTPDMKIFSEETFGPVAAFFAFDTEEEVIELANDSEVGLGGYFFSENVNRCYRVAEALEVGMIGVNCGVLSDPAAPFGGIKQSGFGREGSKYGIDEFTVTKMVMTNIDP

SEQ ID NO: 24528 - protein, 505 aa, Gibberella zeae PH-1
MALPPKWYQFLVSVFASLGSLLYGYDLGVIAEVIASGNFKSKFGDDPNATGAVVSVFTGGAFFGAMFAGYAGDRLGRKWTIMIGALIFILGGSLQTAADHINYLYAGRCLAGLGVGFLVMIVPVYQGELCHPDIRGRVTALQQFMLGVGALIATAIGYGTYTSIDDSNSGQWRIPLGIQNLPAVILAALILFFPESPRWLIDHGREEEGLKTLAKLHANGDVNDTWVRAEFDQIQERLALEHEASAKSYSELFTDKSCFRRLWLAISVQVAAQMTGVSAIQYYSVAIYAKIGIQGDETLRYQMISSVIALVAQFLCMLFIDRTGRRWPLIGGNILNCITFIIATVLLASFPPGSNNGGGAAGWGFIVVTWIYNFSFSATCGPLSWIIPAEIFDMKTRAKGVSLATMMSFAFNTMIGQTTSVALDDKTGIGWRWYILFIVCNFTNAVYFWAILPETANRPLEEMRYLFTEAPLFVPLMDTAKFAAGQDLERRVEKAEQKQELEHHD

SEQ ID NO: 24529 - protein, 464 aa, Gibberella zeae PH-1
MKVSGFLATLSLFAGVIAEAIDLPAGVPRSVEEFRAKHPYESPVKRSHRKVVTIRHSKNDRDDISTEFYKGLKKANNGGTLHLPKGQTFVIGKPLDLTFLNDVHVHLDGEIKFTNDTAYWQKNAFTHPFQNSIMFWKWGGKSIKIYGKGVLNGNGQRWWNEFAGKEILDKDNAYLRPILFYAQNATGLDIQGIHFKDSPCWTNFVVTSKDISFKDVVCTAVSNNATSLPKNTDFFDSLNVEHVKVERAWVDIGDDCFSPKSNATDVHVDTMYCNGTHGQSIGSLGQYKGEMSFVKDVVIENLWMLNGQHASRLKTWAGPDVGYGFIDNVTFRNFYGGNNEYNAFIDSCYFNINATTCNQYPSKMNISNILFENFSGYSSGKYGDAVARLTCSSSKDAVCENIKFKNYNIKTPCGGKPVFLCDGVKDIGVDCVSATSTEGKAALANKCQAPAASVSPFKVRKFDD

SEQ ID NO: 24530 - protein, 445 aa, Gibberella zeae PH-1
MTSTTPPKLNALEILDLRSSPPAFTTPSKRINEGSDVARFLTSLAYRDIGVFILQLNRALCPRNQSSSPLPRTFPLNSKPATTPSVQTLQALLAKIGSFIDEAPPDPGPRRFGNVSFRKWHAIFEERLSELLDEGLLGETLKVGDGKAKEEVSLYLLGGFGSVQRLDYGTGHELSFVAFLGCLWKLGFFKDGEQGGEIEREIVLKIIEPYLNVVRKLILTYTLEPAGSHGVWGLDDHSFMPYIFGSAQLTRPINENEPMPLEGSVKGAPKPSDVTKAVVVEDQRQVNMYFSAIGFINDVKKGPFWEHSPILFDISGIRDGWGKINKGMIKMFNAEVLSKFPVVQHFPFGSLFSWDVDPDATTPTQSVHMVNQPAMAAPTPSGPGTSAPWAQATRMPPSGPGIPYSRMPPPGPNSGSLARPPRNTSGTGSTDAQITVTKAPWARDS

SEQ ID NO: 24531 - protein, 447 aa, Gibberella zeae PH-1
MPPKRMTANPTKPARYRAGKPTGVESDSDSDASENEEPTEPALPPPPKAASAGKISSGNLGKVDLDARRKEAQAVEERRIAKEKAERLTVEEGFVTEEEEESEEEEEDDDDEEESESEEESSEDEAPRRKMMQLKFVPKNKRGNGKDPEQEAEEARQAEEEARKKAADELVEEQIKKDLAARAAGKTHWVDDDAEASDVDTTDGLDPEAEEAAWRVRELKRLKRARAVIEEREKELAEVERRRNLTEEERQAEDEEFLAKQKEEKEGKGTMAFKQRYLHKGAFYQEEMKEAGLDKRDIMGSRIQDDVRNREALPEYLQLRDMSKLGRKGGTKYKDMRTEDTGRWGDIGDGRKRGGGRYEDDERFRPDDDRFRRDERSAGGANAIPLGDRKRDDRRQRDDGHSRPRSRSRSRSPRRDTDRDDYRRRKRSTSRDDERYDSDKRRRVDDR

SEQ ID NO: 24532 - protein, 436 aa, Gibberella zeae PH-1
MSARPTTPASPKNVRVKSPVPGLPMFGCDVDSRSGCLYCQICDDYIWDPTLEELRVRKIGTGSFSGRKRKHDELFTGSFKDDPRFISSNTNTASCRANGLRGIYNAGATCYQNVVLQSFLHNPLLRNFYLSDGHQSSDCQVSHCLSCAMDDMFQDFYALETTNGYTAANILSGFWISEKKAFENLVTTKEQDAHEFFQFLAEELHERNGDGKKPEIGSEHSCNCIMHQTFYGKMQTTTTCQNCSGQSNSIQSFLDLSLGLDNVVQKKSKRTGQKKPTVSLQDCLDEEYIKYDKCEYRCNNCNGTQQAKRHTSIKRLPNVLSIQLKRFEYKHGRHDRAASKVDNEVKFPLQLNMMPYTNRIRNHDSRESLELERSCTYDLLSVVVHVGELDTGHYTSYCRVGDQWFKFNDHKVELASLSDVLGAQAYLLFYIIRSLA

SEQ ID NO: 24533 - protein, 404 aa, Gibberella zeae PH-1
MHSFNILLSSSLFALTQAHSVILGAQGLDSSPNSVGFQVDPEIARNCITINPCQQDATIIRDAEITANIVNQCGRTEISGNIDVGENTENAIAAKQVTQVEAGGELTVTIHQVNADGAGPYVCDLDESSNTNTNIQNLTVTNNIPGTNGLSQAKTQAFNITVKMPDDLNCFGASTGNICTVRCRNNALAGPFGGCFAVQQADTDKKTNTPQNIKTTQTLNGINAQILQNQKDFEDSVAANENATSDEAAQNKAAVDALLGATVVTSAFATETPTVDLGRPPVATPDPNEGKDGQAGDNNGGNNGGNNGGNNGGNNGGNNGGNGGNNGGNNGGNGGNGGQGNNGQGGQGNNQGGNGGNGGNRGGNRGGNGGNPFGGNGGNPFAGGNGQKAKRGFSIRRMSKRTVF

SEQ ID NO: 24534 - protein, 340 aa, Gibberella zeae PH-1
MSSLPQTYKACVIEKANAPFTLKDVPLKHPSKGQILVKVLACGVCFSDVGVSEGHMGDVFPRVPGHEIIGDVVEVGEDVDNFKNGDRVGGPWHGGHDRTCRQCQRAQFQMCDHKEVNGVSRDGGFAEYVLLRSEAVVRVPKEIEPADAAPLLCAGVTVFNGIRKMHVEQGRIVAVQGLGGLGHLAVQYAYKMGYEVAVLSSTDDKADFAKKLGAHHYINTKTSDVGEELNKLGGASIIVQTAPNPKAISPLIQGLAPEGKLLNLAPVGGAEFDTVALVLKGASVVGWPSGHALDSEEALRFSLTHGVKCMVEKYPLEKVQDAVDSLKAGKPRFRNVLVME

SEQ ID NO: 24535 - protein, 368 aa, Gibberella zeae PH-1
MSFAGMLNRLHGQPESYDKKAKYKFGRTLGAGTYGVVREADGPTGKVAVKIILKRNVKGNEQMVYDELEMLQKLKHPHIVKFVDWFESRDKFYIVTQLATGGELFDRICEQGKFTEKDAAETIKQVLLAVDFLHKNNIVHRDLKPENLLYLNRDPESDLVLADFGIAKMLDGKGESLKTMAGSFGYAAPEVMRKEGHGKPVDMWSMGVITYTLLCGYSPFRSENLQDLIRECTDNSVVFHERYWKDVSNDAKDFILKLIDPDADKRWTSEEALGHIWLTGENATDYNLLPEIKSFRARSRFRRIIEKIKLQARIEKLKAMEEDPDNSDLSAIFSEVARAKLADEKEEREVLRITQEVEKEVKRRSFQA

SEQ ID NO: 24536 - protein, 336 aa, Gibberella zeae PH-1
MVSNTELPSRMRAAYIAQHNKPYALGDRPLPFIRDTDILVRVHAAGFCHSDLQALRGEFEKPAPIGLVPSHEIAGTIAKIGSSYRGDLKVGDRVGILNFKHACGSCVGCRLTTRKGEKLDPRFCNDRETAGFLHDGGFADYASADPETTVRLPDSISFQQAAPLTCAGATVWASLEAATSGLSKGETVAIVGIGGLGHLGVQFAKALGFRTIAVDSRQAGRKLAEEVENHKLKPDLVVDSSDTDCASNIIYDFTKGEGVAAAVVCTPSLEANRWALTILRIKGTLGILGLPQNPWQFDAAPLVFKELSIKSNYVAGKEATDRMMRILYRLTGSPAL

SEQ ID NO: 24537 - protein, 1150 aa, Gibberella zeae PH-1
MGTRTASSAVADASLRGPGRTHSTRSSRSSRVPSFPPPSPSASAAPAAPAPATSTGTGANYNQSHTRQLSHSHSQSQSRSQSQSLSQAQSQAYASRSHSHSHSHSHSRSASNAANSHPPPHHSQHQRTSSSARTTSQNDHESSRLAANPKHHRTSSKDDRHPPPTRGPDPSRAHRRSSSSRSKNNNHNPPPEMAPSASAPSNGTSHASAAPPTNHADAPPRASTSKHARSRTVIPTQSGKWMLGKTIGAGSMGKVKLARKEDGSEQVACKIIPRGSTDDGHQSRADKERADQSKEIRTAREAAISTLLNHPHICALHDVVRTNHHWYMLFEYVNGGQMLDYIISHGKLKEKQARKFSRQIASALDYLHRNSIVHRDLKIENILISKTGDIKIIDFGLSNLFAPRGHLKTFCGSLYFAAPELLQARAYTGPEVDVWSFGIVLYVLVCGKVPFDDQSMPALHAKIKRGLVDYPAWLSSECKHLLSRMLVTDPKQRATMQEVLTHPWMAKGFNGPPDNYLPNREPLTTPLEPEVILAMQGFNFGTPESINAQLTKIIESDEYQRAIKLYQREKELPQPTKDAEKKRAFGFDFYKRRNSGNSRDTLSAPSSEALQMGNDPMNAFSPLLSVYYLVKEKQDRDHADMVPPAASQSREKEKEKEREREREREEKREREREREKEREREREREREAREKEKAREPELPEIAAPQAAHTNSSAYEMPGEKPTGGRSRPRARTHGEDDMPELPKQTPAPPPEPRVEQIQKKEGTAAGILRRFSTRKRREPERLDRDRSHPPVVQVHSPAEPSPLAPRKSFSIRRGRRDREDASDTQIRSSSNQGQHGELLSPPMSSGGNREGRRGSALGRSTSVNSAEMRRRKDHPATNESDQSVGNEESSSSRRAHGHSRSVSLRAKSIGHARRESIQQRRQRRDAAQEANVPEETDQELEQSGVSTERLDDTELSKPVFLKGLFSVSTTSGKSVPAIRTDIKRVLKQLNVDYTEIKGGFRCRHSPSIDLNKVQDPPMSPGNTPGHKRRFSFGGLIRGDDRDRDDFRDSDRPPTTPRTPGRSDRDRSFSNSETSFDSNSGRNAGPSRQVPGETSTQVQSDLGGSMVLEFEIFIVKVPLLSLHGIQFKRMAGNTWQYKSMADHILRELRL

SEQ ID NO: 24538 - protein, 246 aa, Gibberella zeae PH-1
MEKDETGEKKTGPSATTTLVEKYGKCQEVVGRGAFGIVRISHKKIGGSNEKLFAVKEFRRRPEETEKKYSKRLTAEFCISSSLRHPNVIHTLDLLKDAKGDYCEVMEFCAGGDLYTLVLSSGKLEVQEADCFFKQMMRGVEYLHEMGVAHRDLKPENLLLTTRGALKITDFGNGECFRMAWETDAHMVSGLCGSAPYIAPEEYTDKEFDARAVDVWACGVIFMAMRTGRHLWRLAKKDEDELAVAT

SEQ ID NO: 24539 - protein, 491 aa, Gibberella zeae PH-1
MASSTPKPTNSLLYKNFQKHPAALIESTEGIFLNTSDGRRILDATSGAAVACLGYNNKDVQQAVVEQLVNVPYCHPGFYKTKAAEDLADFLVESTNGLMSKAVLCGSGSEAVEVALKLAKTHFSHLAIPQPERSHFIARVGAWHGATLGALTLGDFKVRKDPFVQLISQNSSQVSACSEYRGRKEGEDDEAYVQRLAQELDDEFQRIGPEKVCAFVAETVGGSASGCAMPIKGYFPAMKAVCEKYNALLILDEVMCGMGRTGTLHAWEQEDVVPDILVVGKGLGAGYAPVSAVMLNAKLVESFQKSGKGFAHGQTYMAHPQAAAAGLKVQQIIRDENLLAHVQTMGEYLGSRLKERFLPMPFVGDIRGRGLFWAIEFVTDKKTKMPFPYSLGLNSTLHSRGMSAGYEIALFNANGGYDGYSGDHFLICPPFIVTKADVDDIVERTARVVEDTFAELVNSAVWEKVTLQMGIDNKCEVNAVNAPPAVGVAAQ

SEQ ID NO: 24540 - protein, 334 aa, Gibberella zeae PH-1
MQSILQKATGIGPQVIKPENLQGRVAIVTGGALGIGYEVSRALAHAGCKVIMVNRKEEQGTSAIEAVKNEKHDADIDWKECDMGNLSQIREVFGGFRESLDRLDFLVLSAGINTNQFGLDSDGIERHFGVNFLGHFYVCNQLWPLLRKTSKMENVSPPRVVFEASEMHRLAQLSNVQFKTKEEINDPDLDPTARYNRTKLAMILFAKYGLAGKVIAENKDKIYALSVHPGAVNTAMQQQWKDAYPGLTGKLLSWTMQAIGRDVEQGSYSALWALTSSRIEEENLNGYYFVDPDKEGEETSQASNPELASNLWDLSTSFIKEKLGEDALADWNGS

SEQ ID NO: 24541 - protein, 1066 aa, Gibberella zeae PH-1
MAIKDGGKKSGQIPGPKGLPVLGNLFDLDLSDSLTSLINIGQKYAPIFSLELGGHREVMICSRDLLDELCDETRFHKIVTGGVDKLRPLAGDGLFTAQHGNHDWGIAHRILMPLFGPLKIREMFDDMQDVSEQLCLKWARLGPSATIDVANDFTRLTLDTIALCTMGYRFNSFYSNDKMHPFVDSMVAALIDADKQSMFPDFIGACRVKALSAFRKHAAIMKGTCNELIQERRKNPIEGTDLLTAMMEGKDPKTGEGMSDDLIVQNLITFLIAGHETTSGLLSFAFYYLLENPHTLEKARAEVDEVVGDQALNVDHLTKMPYVNMILRETLRLMPTAPGFFVTPHKDEIIGGKYAVPANESLFCFLHLIHRDPKVWGADAEEFRPERMADEFFEALPKNAWKPFGNGMRGCIGREFAWQEAKLITVMILQNFELSKADPSYKLKIKQSLTIKPDGFNMHAKLRNDRKVSGLFKAPSLSSQQPSLSSRQSINAINAKDLKPISIFYGSNTGTCEALAQKLSADCVASGFMPSKPLPLDMATKNLSKDGPNILLAASYDGRPSDNAEEFTKWAESLKPGELEGVQFAVFGCGHKDWVSTYFKIPKILDKCLADAGAERLVEIGLTDASTGRLYSDFDDWENQKLFTELSKRQGVTPTDDSHLELNVTVIQPQNNDMGGNFKRAEVVENTLLTYPGVSRKHSLLLKLPKDMEYTPGDHVLVLPKNPPQLVEQAMSCFGVDSDTALTISSKRPTFLPTDTPILISSLLSSLVELSQTVSRTSLKRLADFADDDDTKACVERIAGDDYTVEVEEQRMSLLDILRKYPGINMPLSTFLSMLPQMRPRTYSFASAPEWKQGHGMLLFSVVEAEEGTVSRPGGLATNYMAQLRQGDSILVEPRPCRPELRTTMMLPEPKVPIIMIAVGAGLAPFLGYLQKRFLQAQSQRTALPPCTLLFGCRGAKMDDICRAQLDEYSRAGVVSVHRAYSRDPDSQCKYVQGLVTKHSETLAKQWAQGAIVMVCSGKKVSDGVMNVLSPILFAEEKRSGMTGADSVDVWRQNVPKERMILEVFG

SEQ ID NO: 24542 - protein, 451 aa, Gibberella zeae PH-1
MPSIALRQSRRCRLIDPRAYLTNTPRFSYTDIQSRAATNASWRPVSILDDWVAKEARPISLRQLMVFGRSLTESRLISSANYVRTELPTRIAHRIRDMQRLPYVVTTNNHIKEVYDLYYHAFDTFRKVKEVKTLDDNDKLCELISHNLKSHLTVIPQLAMGILECGGLMSPVDLDKFMNTILRSRISRRVIAEQHLSLTETYNSPNFSPGAKLSESDFIGEVFIKCYAKDVVERCSKAITALARTTNGPDVQIPDITVDGHLDASFPYILSHLEYIIGELLRNSVQAVIDRHQKTHPDPNNVKPPPVEITICENQQHVIIRICDRGGGIPRAELPHLWSFSKGPQSQRRLNNLAQVPKMAATMQELHVEEELGRADLKVPPYQSSLSSLTSRPPNLRLGMGLPLSRVYAEYWAGNLDLHSLEGYGTDMFLQISRLGNKNEQLTTRASMDAL

SEQ ID NO: 24543 - protein, 267 aa, Gibberella zeae PH-1
METEIPPHEVPLPIQAQDDTMGGIEESPHPGSSNGFHHQQSTSFDQGLASPQRDDPSSRYTPPVQPAPPLSRPASGLSNPAHQAYNDYRQGAGEPSSNGRNHVVIKVGMVGDAQIGKTSLMVKYVEGSWDEDYIQTLGVNFMEKTISIRNTEITFSIWDLGGQREFVNMLPLVCNDAVAILFMFDLTRKSTLNSIKEWYRQGRGFNKTAIPILVGTKYDHFVNFPPQDQEEISNQIFKIVLSKAFDLKCTIPEIENVGEPLLLYQSV

SEQ ID NO: 24544 - protein, 360 aa, Gibberella zeae PH-1
MGYPDTFEGFCVDSPKSWNKFEKQTLTPKTWGDRDIDVEIECCGVCGSDVHTVTGGWGDFEGPLCVGHEVVGKAVRVGDKVSEIKVGDRVGVGAQVSSCLKCKLCNNKNENYCPDMVDTYNCKYPDGSVAHGGFASHIRAHEYFTFKIPDALKSEQVAPLLCAGITTYSPLVRAGVGPGKVVAVLGIGGLGHMGVQWAKALGAEVYAMTHSPSKVEDAKKLGAKEVIVTSEEGWADKYKFTFDFILNCADMTHKFDMNAYMGTLNIGGEFHNVGLPDEPLPQFTAGTFAGNAGKITGSHLGNNQEMNAMLKLAAEKNIVAWVETIDISEKGCAEAIERVKENKVRYRFTLTGFEKVFKKD

SEQ ID NO: 24545 - protein, 218 aa, Gibberella zeae PH-1
MTTGAFSLDQLMELAGLAVSQAVYRLQPLESGRRVLVACGPGNNGGDGLVAARHLRQYGYNPTVFYPKRSKNDLYQRLAKQLEDLEVPFVDDFPSALKSTDHIIDAIFGFSFSGEVREPFPAVIQALQETKLPITSVDAPSSWDIENGPPKSGLGSSFMPTALISLTAPKPLVKHFKGRHFIGGRFVTPSIAKKFDFEVPEYKGIDQVVEVEVSEQKL

SEQ ID NO: 24546 - protein, 491 aa, Gibberella zeae PH-1
MSLPADFKWGFATASYQIEGAIDKDGRGPANWDTFCAQAGKIADGSSGVTACDSYNRTAEDISLLKSLGSKAYRFSICWSRIIPLGGRNDPINQAGIDHYRKFVDDLLDAGITPFITLFHWDVPDELDRRYGGLMNREEFPLDYERYARVMFEAIPRCKNWITHNEPWCSAILGYSTGSNAPGRCSDRNKSDVGDSSTEPWIVGHNLLVAHGRAVKIYREEFKPKNGGEIGITLNGDATYPWDPKDPRDIEAAERKIEFAISWFADPIYFGDYPASMRAQLGDRLPTFTPEEKALVLGSNDFYGMNHYTANYVKHREGEAAPEDFVGNLELHFWNHRGDCIGEETQSTWLRPCAQGFRDLLVWISKRYGFPRMYVTENGTSIKGENDMPREKILQDDFRVQYYDDYVRAMADASRLDGVDIHGYFAWSLLDNFEWAEGYETRFGVTYVDYENDQKRYPKKSAQHLKPLFDSLIKKEENGLNGVGKVKAGQT

SEQ ID NO: 24547 - protein, 371 aa, Gibberella zeae PH-1
MFRPTARRLAASAAKAAAAPTSHTLNVARAQGVSRGLTGAIGNTPLIRLNRLSDETGCEVLGKAEFMNPGGSVKDRAALYVVKDAEERGLLKPGGTVVEGTAGNTGIGLAHVCRSRGYKLVIYMPNTQSQGKIDLLRLLGAEVYPVPAVAFDNPENYNHQARRHAERLDNAVWTNQFDNTANRRAHIETTGPEIWAQTDGKVDAFTCATGTAGTLAGITRYLKDVSNGRVKSFLADPPGSVLHSYVSSGGKLNERTGSSITEGIGQGRITDNLQPDIGLVDGSLHISDEKSIKMVYRCLDEEGLYLGASSSLNVVAAKEVAEKLGKGHTVVTVLCDGAYRYADRLFSRKWLTDKKLLGAIPKHLEKYIVLP

SEQ ID NO: 24548 - protein, 362 aa, Gibberella zeae PH-1
MANHPPPPQKMKALRLLEYNKGYKLCDDAPVPIPKPDEVLVRVATAGFCHSDLMVHHGLTQVPLPFIGSHEPAGTIVNRGSDVPEGWHVGDRVGVTNFMDPCDNCKGCKWATQTIGSLDPRFCDNRTMCGILRRDGAFAEYMTSWHGALVHLPDSMSFEQAAPLMCAGATVWHAINQADVQAGQTVAIVGIGGLGVLGIQFAKARGYRVAAIDNHETGLRLATEVPSHLKPDLILKYDDPETIRKISDFTDEIGLKAAVICNSDDDANDWAAHQLQPRGVLVAAGFPDNGLRFDPMNLVLREIVVKGIVHCSMEETREMMKFVTDHGIRSRLSLLTMEEAEDIIAKTQAHTLIGRPVVMIEG

SEQ ID NO: 24549 - protein, 332 aa, Gibberella zeae PH-1
MPFDKSSSQEYRPPRWIPTTGLATTCLVEPRHLWDSLYSQEQIAAWKAITDAVHAKGGYIFCQLWALGRVANPNVVPNIWSAGSKPFEAKGAASLPKLTTMTEADIDRFVGHYRQAALNAIEAGFDGVELHGANGYLIDQFLQTNSNDRTDSYGGSLENRFRFPLRVLNAVCDAIGPERVGIRMSPFSRFQGMREADPLSVFVPWAKAIVKAQPSLAFIHAVEPRIEGGSDSPDSHLKTDDTLSPVRDVVSSSNVKFIVAGGFTPETAVKHANQTDDLVGFGRYFILPANPDLPARIKNGWPLTKYDRSLFYTPDRKGYTDYPAYNPDASRL

SEQ ID NO: 24550 - protein, 305 aa, Gibberella zeae PH-1
MDALNATSFASFNQTKDYFVVLEEVSKYNVQLNMVEKLWAAWYLWMQNDTLATGIMSFVLHELVYFGRCIPFMLMDFIPYFQQFRIQKQKIPTIKEQWDCAAIVLISHFTAELPQIWFFHPIATYFGMDYGVPFPPVWKMALQIAICFVMEDAWHYWFHRALHYGPLYKAIHKMHHTYSAPFGLAAEYASPIETALLGIGVVGCPIVLLAVTGELHLFTMYTWIVLRLFQAIDSHSGYDFPWSLRHILPVWAGAHHHDLHHEKFIGNYASSFTWWDYCLDTEAGADAHKRRREKKLAAIKAQKQQ

SEQ ID NO: 24551 - protein, 491 aa, Gibberella zeae PH-1
MRRLIWRTALHQARSRWIQPNFVAEEKDLVVIGGGVAGYVAAIKAGQEGMKVTCIEKRGSLGGTCLNVGCIPSKSLLNNSHLYHQILHDTKHRGIEVSDVKLNLANFMKAKETSVSGLTKGIEYLFKKNGVEYIKGAGSFVNEHEVKVDLNEGGETSVRGKNILIATGSEATPFPGLEIDEKRVITSTGAIALEKVPETMTVIGGGIIGLEMASVWSRLGSKVTIVEFLGQIGGPGMDSEIAKNTQKILKKQGLEFKLNTKVVSGDKSGDKVKLEVDSAKGGKVESIESDVVLVAIGRRPYTAGLGLENIGLEADDRGRVVIDSEYRTKIPHIRCVGDCTFGPMLAHKAEEEAVAVVEYIKKGYGHVNYGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 24552 - protein, 426 aa, Gibberella zeae PH-1
MAETMPKCEANGHHKIIINKEAPDVPFYTPIQDPPAGTPYDVQPEGSLFSPLKLRNLTLHNRIFVSPMCQYSAKDGVMTPWHRQHLGSFAARGPGLIVTEVNAVSPEGRISPEDAGIYDDGQLGPLQDIVDFVHSQGAKIAIQMGHAGRKASTVVPWLDRKNTAFKEVNLRATCANGWPDEVVAPSAIPYSPESVVPKEMTKDDISKFKQDWVNAVKRALKVGFDAIEVHAAHGYLINSFLSPTSNQRTDDYGGSFENRIRLLVEIVQLTREIVPQEYPVFARIPGTDYLDFDPSLPQWHIQEAALLAKILADNGVDLLDVTGGGLDSRQRINSGPGYQVPWADAVRKAVKGTGTVVTSVGMITSGKQAQGYLDDGSIDAVFVGRGFLKDPNLVWHWADELDIDIHVAAQYGWGFGITRTHRPSKH

SEQ ID NO: 24553 - protein, 400 aa, Gibberella zeae PH-1
MASELSPVDVRVIAVIQQVCSVLSIIGCLFIIGTFCLCDAFHKPINRLVFYASFGNMIASICFILADSFVKVPEGTGCQAQAFLIHTFVAADAMWTFAMSVNVYLAFYHRFDAQRLRRMELPYLLACYGVPFLPAFIFIFIKDENGFGVYGNAVQWCWIAPKWGNLRIATFYGPIWFVIIITLGIYIRSGGTIYRKRRQLLKAHASGSGSGSGSGSRSGNLSYNDQRTTNYMKTTEVTVIHEPIDKPEAVLLHILRPKASIRVFKPTIAGNAACPSAEAQPNIPRPPTRSGSDVYKATWAYTKVAMLFFAVILITWIPSSANRMYSFIHPHQVSKPLQFMSATVLPLQGFWNAVIYAVTSKDACKAILEERGLRMEKTRLNEPTWDDEQREQQRNRNMVV

SEQ ID NO: 24554 - protein, 336 aa, Gibberella zeae PH-1
MKLSSALCCVFATLTVAFPSDYLKIATWGVEGYAKDNPIGVTTGGKGGKTVTVTTAEQLVEAVKGNAPKIVKLKGKIVLPARLAVGSNTSLIGVGLSAHITGKGLNIYNGDNVIVQNLKITEILDNDCITIRNSTRVWIDHNEFSSDIDGGPDKYDGQVDIIRASDFITVSWNYFHDHWKSSLVGNDATFRDLDLGHLHVTYHHNYWRHMGTRGPAGRFGHQHIYNNLYEDFLYQAIHSRSDNQVLVEGNVFRGNTSEALSTYGLVIPMDSPNTCVCGDEELDGYANLGAKNDWGHAGVNITQKGNFYKADYKFKLTPLPLVPAVVKLGAGIGRIW

SEQ ID NO: 24555 - protein, 408 aa, Gibberella zeae PH-1
MGDIFDAGSNSKLFTPLDIANGKIHLKHRIVHAPLTRNRGTPLNPESTPENPNRVWIPNDLITEYYSQRATNGGLIISEGLPPSLEGNGMPGVPGIFLPEQVQGWKKVVDAVHAKGGYIYAQLWHSGRANIPQLTGTPILAPSATPWDDPNETFAYPPPHTSTPVKLADYPPVEMTVEKIKSTIADYVNAAKNALEAGFDGVEVHGGNGYLPEQFLSSNINKRTDHYGGSEEKRCNFVLELMDELAKAVGQDNLAIRLTPFGLFNQARGEKRVETWGHLCRELKSKFPQLSYVSFVEPRFEQIFSEAEKQQFLGSWGLPTVDLSLFRNIFAGTPFFSAGGFNDVNSWGVVESGKCDGVLYGRYFISNPDLVERLRNGWPLQPYDRSTFYGPFKDNAAGYTDYPFYNGE

SEQ ID NO: 24556 - protein, 302 aa, Gibberella zeae PH-1
MVLYNGFDSITDVPDLLGKVILVTGGTSGLGRSAITTLAAHNPSHIYFTGRSSSAAESLIKDISPIPSTFLECDLTSIANMHAAAKKFRHDRLDLFIANAGVMAVDGLTKDRLELQFGVNHVGNATLFMALLPIMLKTAEEPNSDVRFVSLTSLGYRGHPKNGIEFDTLQSKQEDMSFGTWGRYGQSKLANIVFAKEIQRRHPKITSVVVHPGVIATGLVTELSFWKRMFVYVTNPRMMTVEQGGLNTVWAATSGDVKKGDEKVAFYEPVGKGNAGDEMCFSQELGKKLWEWTEEKINSTKM

SEQ ID NO: 24557 - protein, 268 aa, Gibberella zeae PH-1
MNLNKAARVILFGAPGVGKGTQSERLLSRFPQLNQISTGDLLRRNVKDRTPLGIKVENTMKSGGLVADDLILRLISNEFYTRGWLAKNGPPNVMTLSSEATALEHSFNSNAGVESFINAPFLDGHRPSDSSNDPSASFILDGFPRTASQAGPLDKLIPINLVVSLKTPVSVILERILGRWVHEPSGRVYNTSFNAPKIHGMDDITGEPLIQRPDDSEEVYRARYKKFQETSEPVLNHYAQKGVLVEIEGMSSDEISPKLFAEFERRFV

SEQ ID NO: 24558 - protein, 1644 aa, Gibberella zeae PH-1
MGLGVLMQELCDLPTGNIAQSPQFQSIHAMTLDKADLLASLPTTGEPSTSPLHLLYTLLKDISGPWPVFPLVKCLTRVYKHLPEDVKTGNDAESALLLKQTSDLVKASYTSLSQFISNENKPALRASSGGHVITHHELLQFVNNFQLPVESPGRKPIVSIALPNGPLLAATCIAVTTYYTASPINPAAGPEQFRADILQARSNFILTTREEYTKLQLDASWVSDNNIRVYVIDWVAGDGISVETLDGKSVPTGIVERVANTADDISLILFTSGTSGTKKVVPLTTHSIVTGVVAVIESWGLTSEDICLNMMPLYHVGGLVRNIFAPIFANGSTVCCPSFDANLFWDVAETIQPTWYYASPSMHSVIVAEAAARPEALQKSRIRLACNAAGGLLPSLAYQLRDTFNCVVLPSYGMTECMPISTPPLDYRLDREGTSGISTGPELTILDWSEDQVPINTVGRICVRGDPIFPGYLKADGSYDKSPFNASGWFDTGDLGYMDSDGYLYITGRSKEVINRGGELISPFEVENAIMTASKSEESPIYGRVSQTLAFSATHDVLQEVVGVILVTPSGVPRVDLRTLHAALKASLQQAKWPVVIAYMDDVPKNNNKVLRINLGKRMDLPCLTDDTPHMGRHWDATCPPADTPLSASIGSSPCQVDYHILSTHIQGIVPDYVDVFCLQGSDGAPQVVLAPKTNDVAVEDTSLTTTIRHELGHLVDNYMVPSEIHIFDRPLPRSSSGEVDVDLLQAQLDELLTASMKQLEASTEGLVTKAFADVLSLPPADIPRDIDFFSLGGDSLRAGRLLAALRSEFSIHLPITIVFNEGTVSALATHIDKMLEGKREGHEEVDTVEGCTKTHSSTNPFLMLLQLVPLVIVYPLRRAFQWTCFFVALAYSQKLPTNRSVPGRFVNLVVSMIISRVVTQFVSPFVGILAKWLIIGRYREGMYPMWGSYHTRWWLVQKIVAVCGRGFFETNDMTLRIYHRLMGASIGKNVKLNESFIGEWDLVKIGDDANITGCICRPFAAEGNTSMYLGRITIGEKCTVGFSSIVVPGTTMPANTCLGFNSSTWEMQDASEEYRDQLPSARKGPHWLLSILFTLPLMGLSHFVAALPWAGGLVGMVLKKASPRIEPLRSSVEWFCQPKRIGYHYLARVAGCVLGPFFLFAFIVLVKATLDCVFGKLRSGSKQETSTVAAWRAGLMRDIYPVKTLHRLTSLFGQHYEATSIALRALGAKVGQRVYWPGTGPSIGDYHLIEVGNDVVFGSRSHLVTSDGIGSEKVTIQDRAMIADRVTLLPGVSVGERVTMGSGALTRRRGNYSDGTYVGSKGGDAVCLTTSREGSRDGSAQSSMLDMSFDEKKFQSDTDPSQTSGSITGEGPDKDDLSPFGRAFYLKMAPYYVLGPFAIFCYSTFIAIFTSIYWDAPSISSIQLVRVVLIHVLGPGHPWWKDLAAIFCTMLVSIAVLTTIQSVLALAIIIMSKWVLMGRRQPGNYDWDKSSYCQRWQIFLGIERLRRGCYNGNGILNLLTGTSWIVLYFRLLGAKIGKDCALFANGTPSLMFTEPELISLGDRVVVDDASVVAHINTRGKFDLNRVDIGDRCVLRTGSRLLSGARMENDSCLLEHTLIMGGDVVEEKSTMQGWPAERFTRKRV

SEQ ID NO: 24559 - protein, 452 aa, Gibberella zeae PH-1
MAAYLTKRITHPHHGIPVSRPETPAPAKTEKCSHPIPNVAAKGVPFFTPEQDPPAGLAIKPDDGRPVPRLFQPLKIRGVTMQNRIWVSPMCQYSCHEGFMTPWHITHYGGMAQRGPGLMMLEATAVQANGRITPESRDAGIWLDAHVDTLRKNVDFAHSQNTNIAIQLAHAGRKASCVAPWLSAGATATEEVNGWPDDVVGPSTEPFNEHHPTPRSMSIQEINQLKKDFVKAANRAVTAGFDVIELHFAHGYLVSSFLTPSVNKRTDQYGGSFENRTRLALELVEEVRAVIPETMPLFVRISATDWLDTNSEYNGESWTVDQAARLTQLFAERGVDVIDVSSGGNHPMQKVQGGPGYQAKFAKYIKKEVGDKILVSTVGSIKTGTLAEEIISGEDGVPLDLVAAGRMFQKNPGLVWAWADDLDIEIQLAHQIGWGFGGRATKKGDHVKMSIP

SEQ ID NO: 24560 - protein, 481 aa, Gibberella zeae PH-1
MAVGSSKQINFTEFYNLIDGKLETTKETLQNTNPSTLEKNHPAPVATQEDVDRAVEAAKKASESWSEVPWEERQALVTKYAEGIDALKDEFAHLLVKEQGKSLAMAHFEIMLSVQFLKGYASLPDPQRVIEDKPDCKVVTKYVPLGVAVGIVPWNFPIFLTTAKIGPALIAGNSFILKPSPFTPYCGLKLAELASQYFPSGVVQALSGDDNLGPWLTAHPGVDKISFTGSTATGKKVVASAAPTLKRVTLELGGNDPSIVCDDVDVKEVAPKIAFAALMNSGQLCMAIKRVYVHESIYDDFVKELAAAVNSFTVGDGMDEKTSLGPVQNQMQFDRVKNLLADIESNGYKLAAGSTSASTAGKGYFITPTIVENPPDESRIVVEEPFGPVFPVLKWTDEADVLRRANDTDMGLSASVWTKDMEKAERLSSKIKAGTVWVNNHVQLNPAVPFGGAKHSGHGAEHGIEGIKAYCTTKSLYFNKA

SEQ ID NO: 24561 - protein, 495 aa, Gibberella zeae PH-1
MGNFEVKSIAVVGAGAAGAITAATLKAENYFDRIRVFERRETPGGTWIYDADPSVATIQPGALPTEIDKPLVIPEDLPTTTTPNQQERYAHTPIYQNLTTNVPQIAMSFSDMSFSYGPFVPHYVPRQYIESYFSFHKTDGYLSLNTTVEDISQLPLTSRDGLNLWRLTLRKYDPLRRVDVWWQEDFDAVILANGHYAVPWVPPIRGLEAYVEKFPGRVIHSKFYRSPWIYAGKKVLVIGNSASGHDISVDLLQAVQLPLYQSRRSRGRLDGDEPPAGVEWKTVIKEYRLDGTIVFEDDSELADIDHVLYCTGYLPSYPFWNTQANGRPLFDYKKKKLINNYWHTFFQDIPNLAIVGMPRVLTFRSFEYQAIAIARLFSGRSAVPLPSKETQKKWELDRESRCRQEGRRFHEIEWENGETFRWLDGFFQISGLGTLHGDGRIPPVLGKDIIWAIEHVRKYPVPGKDKHQESGGSLEYKEGEWTLVHRPKKDPLLFI

SEQ ID NO: 24562 - protein, 500 aa, Gibberella zeae PH-1
MAELQQEEKTEDINRVGSNTPGEMDNVNDLRRDFKPRHVFMFSIACAIGTGLVIGTGSALSRGGPGSLLIAYILIGCTVFFVMTAIGEMATFLPMNKGFGGYATRMVDPAFGFATGWNYVLKYIVATPTNLTAAGLVLQFWRPDLNVAIWITVFGIAIVTINVLHVNSFGETEFWLGCAKILIMCVLILSTFVVAMGGGPNHDRSGFRYWRDPGAFAEYLLEGSLGRFLGFWACCCQACFGFTGTEVVGMTFGETPNPRKNVPRAVKQTFWRIACFYIIGVLVLGMAVPYDNEQLIGATKQATSGVLQAQVPILDTHGVNPSLMVADIYCASRSLYGLAKDGQAPRLFAKVRDNGNPIYAVGFASVFIAMGYLNASKSSSAVFGYFVSLVTVFAVLNWVAVLITHIRFRHALKAQGIAVTELPYVGFLQPFGSYFSLTVSLSVIIFNGYDAFIPHFKPETFVLKYLGTLIFVINVCWWKIRNKTTFWRLTDIDLVTGRRE

SEQ ID NO: 24563 - protein, 444 aa, Gibberella zeae PH-1
MLSRRTTSSTSKARNDFWSKHPSVKIIILQWVDMCGVLRARLVPVSTFKKIVEANGYLNCAPLDTCVTTTAEFIPKLMPFFVDSGKIWPDVSSLKVANHNARGYTNAAVCFGHVEFQNTDARHILKTLVEKTKVHHGLEFLVGMELEFCLLLPGTLDPAEPGSAGVSHTSKLLRSKIWPLLNEIITALDGAGIEVEQAVKEYGASAYEVALSPLPPVEAIDAYVYTIEVIKNIAYKSDLVATFYPTPFAGETGQKSGQHIHISATSTNKDKSWDPDTAMAGLLSHIPALTALGLAQIDSYERVGIGKMCTGGLVGWGDNNRDMPVRRVTKNHWEVRINDATSNSYAMVAGIIGALLDPKPLKIQGATKFTMFYSAEEREKMGLTEPVPASLEEAVKELENDLDWAIHILGREYVEWFVALKKAEIVASSKMETKERRLFLLDTF

SEQ ID NO: 24564 - protein, 348 aa, Gibberella zeae PH-1
MESHHRAAVVTRSDTGFKFDIQNVPIPKPQPWEILVKLSATGVCGTDMTLAGGYLGPCRDILGHEGVGRVVQIGSGVDPSTIKVGDRIGIAWVRDACGQCSCCREPGGEVRCLEQQNSGRKWDGTFADHCIVPSRYVLTLPDDPKLPDEIVAPILCGGVTAYKALKACEATPGDWVAIVGAGGGVGGLGIQYAKAMGYRVAAVDVGPAEDFCLKMGADAYFDGSSPDTPAKLKKLTPNGAGAKTVIVTAGSGRAYQNALDLVAVFGTLVCVGIPPPDQAMNLHPLTLIDRGIKLLGTLVGTRTETLEALEFVRRGVVEPIVQTVNFNEIEDLAARFLTLPVSRYYVDY

SEQ ID NO: 24565 - protein, 382 aa, Gibberella zeae PH-1
MSRTTTALVAPNLDGQFKLEQVHLYSLQPDEALVEIHASGVCHTDLACASGKLPCGKNAVLGHEGGGVVIETGSSVTNVTTGDKVLLSFSSCGTCPGCVSSHPAYCYEFNLYNFGGRRADGSATMFTMKEGRKRPMHSRFFGQSSFARHTIVHRTSIVKVPQETPLELFAPLGCGIQTGVGAIFNTLNVKPGSSVAVFGVGSVGLAAIMGAKARKAKTIIAIDLQTQRLELAKELGATHVVLGPDQDHIIDSIQDICPPIGVDFAVDCTGVPAIIETMVAALGMRGRAATVGAPGGMATAKIDIMSHLTYGKEYVGCSEGDSNPEVLIPELIDMHSRGELPLEKLVKQYHIEDYEKAFADMASGSVIKPVLTWEGLKRTSHM

SEQ ID NO: 24566 - protein, 335 aa, Capsicum chinense
MVHEKQVIDEVSGWLRVFDDGSVDRTWTGPPEVKFMSEPVKPHDDFIDGIAVKDVVADDKSGSRLRIYLPEQNGGSVDKLPVVVHFHGGGFCISQADWFMYYTVYTRLARVANAIIVSVFLPLAPEHSLPAACDSGFAALLYLRDLSRQKINEPWLSNFADFNRVFLIGDSSGGNIVHHVAARAGEEDLSPMKLAGAIPIHPGFVRSKRSKSELEQEQTPFLTLDMVDKFLGFALPMGSNKDHPITCPMGDAAPAVEELKLPPYLYCVADKDLIKDTEMEFYEALKKAKKDVELCISYGVGHSFYLNKIAVEMDPVTGSATEKLFEAIAEFINKH

SEQ ID NO: 24567 - protein, 115 aa, uncultured crenarchaeote
MLVKIQDEFIDKLDFVKRDGLIPVVVQDIKTKDILMLAYANRVAIENTVKTGNAWFWSVSRNKLWMKGEESGNVQEVKDILVDCDQDSVLYLVDSKNPACHTGNRTCFHNRLYPN

SEQ ID NO: 24568 - protein, 341 aa, uncultured crenarchaeote
MRAVPIYSHGDLNVLRYEQDFPTPIPNPSEILIRVKYCGLNHLDIWTRLGIPGITIGFPHICGSDIVGSVEEEYAEIPKGSRVLVYPGICCNDCDNCRNGTETLCRDFSIIGGLSKYNGGYAEYVTVPKTNIISLPREISDEQAATLSISYLTAWNIIKKLHLKENDTVLIYGASGGLGMAMIQISKALGIRTISTISDDSKLNFAYDIGSDYVINRKKKEIALEIEKITRGIGVDAVVDNAGQKTLNTSINSVRKGGKIALCGTTSGSEANFQIRTFYSKQIQLFGILIGSKLELLELINFVNEKNIVPKIDSVLPLAQVRQAHDKLEKGEQQGKILIKI

SEQ ID NO: 24569 - protein, 473 aa, Moorella thermoacetica
MAKEYDVVILGGGTGGYVAAIRASQLGLKTAVVEKGKLGGTCLHAGCIPSKALLRSAEVYAQTKNSEAFGVIVGDVRLDFAKVQARKATIVDQLHKGVQHLMKKGKIDVYAGIGRLLGPSIFSPLPGTVSVEMNDGSENEMLVPKFVVIATGSRPRTLPGLEPDGEFVMTSDEALQMEVLPSSILIVGGGVIGMEWASMLNDFGVEVTVLEYADRILPTEDEDVSKEMEKLLLRRGVNIVTGARVLAETLEKGNGVTIQAEHQGERKTFAADKMLVSIGRQANIEGIGLENTEIVVENGYIQTNEFGQTKESHIYAIGDVIGGLQLAHVAAHEGIVAIEHLAGRNPAPIDYSMVPRCIYTRPEAAAVGLTEQEAKAKGYDVKIGKFLFKAIGKALVFGEAEGFVKLIADRNTDDLLGVHMVGPHVTDLISEAGLARVLDAAPWEVAHAIHPHPTLSEAMAEAALAVDGKAIHF

SEQ ID NO: 24570 - protein, 476 aa, Geobacillus thermocatenulatus
MAKEYDVVILGGGTGGYVAAIRASQLGLKTAVVEKGKLGGTCLHAGCIPSKALLRSAEVYAQTKNGEAFGVIADGVRLDFAKVQARKAAIVDQLHKGVQHLMKKGKIDVFAGIGRLLGPSIFSPLPGTVSVEMNDGSENEMLVPKFVVIATGSRPRTLPGLEPDGEFVMTSDEALQMETLPSSILIVGGGVIGMEWASMLNDFGVEVTVLEYADRILPTEDEDVSKEMEKLLRRRGVNIVTGARVLAETLEKGNGVTIQAEHQGERKTFAADKMLVSVGRQANIEGIGLENTEIVVEKGYIQTNEFGQTKESHIYAIGDVIGGHASLPHVAAHEGIVAIEHLAGRNPAPIDYTMVPRCIYTRPEAAAVGLTEQEAKAKGYDVKVGKFPFKAIGKALVFGEAEGFVKLIADRNTDDLLGVHMVGPHVTDLISEAGLARVLDAAPWEVAHAIHPHPTLSEAMAEAALAVDGKRFIFKF

SEQ ID NO: 24571 - protein, 407 aa, Phaseolus vulgaris
MYLVESKGGAIGCMFLALFFLGTWPALLTMLERRGRLPQHTYLDYSITNFFAALLIAFTFGEIGKGKPDEPNFLAQLAQDNWPSVLFAMGGGVVLSLGNLSSQYAFAFVGLSVTEVITASITVVIGTTVNYFLDDKINKAEILFPGVGCFLIAVFLGSAVHSSNASDNKAKLNNYSNDYKEAAISSKERDLVKSKDLERGSSSADNVEAGTAVFLIELEERRAIKVFGKSTLIGLSLTFSAGLCFSMFSPAFNLATNDQWHTLEKGIPHLTVYTAFFYFSISCFVIAIILNITFLYHPVLNLPKSSLKAYLADSDGRMWALLAGLLCGFGNGLQFMGGQAAGYAAADAVQALPLVSTFWGVVLFGEYRRSSRRTYALLGSMLFMFIVAVGVLMASSGHRSSSHTAKE

SEQ ID NO: 24572 - protein, 480 aa, Arthrobacter aurescens
MPEAAPDFDLAVIGSGGGAFAAAIRATNLGKRVVMIERSTVGGTCVNTGCVPSKALLAAADARHVALDGTGRFPGISTTAAPVDMGALIDGKRSLVEGMRSDKYVDLAAEYGWDLRQGSAVFAGTPQEPALEITRPDGGRDSLTAAHYLVATGSAPWAPPVPGLEEVDYLTSTTAMELGEVPESLIVFGGGYVALEQAQLFARLGSKVTLLARSRLASHEEPEASRALMGVFADEGIRVIRRATVTSIRANASGEEVTVTATVAGGHEEFRAAKLLVATGRRAVTNGLNLDAVGVKTGNTGQILVENTLASSNPRIWAAGDVTGHREFVYVASAHGTLMVENAFNDAGREVDYRHLPRVTFTSPALAAVGMTDKEANEAGIRCECRVLPLEYVPRALVNRDTRGFIKIVANNSTGRIVGITAVGKEAGDLAAAGVYILEAGMTVDQVANLWSPYLTMAEGIKIAAQSFTTDVSKLSCCAS

SEQ ID NO: 24573 - protein, 320 aa, Mycoplasma mycoides subsp. mycoides SC str. PG1
MKIFDYDDVQLIPEMCIVNSRKECETTATLGKHTFKLPVVPANMATIINEELAEKLARNDYFYIMHRFNVDQLKFIKNMKDKNLITSISLGVKPDEYKLVDQMVQQNLIPDYITIDIAHGHALSVKNMISYIREKMKDQVFIIAGNVTTPKAVRDLELWGADATKIEIGPGKVCITKLKTGFGTGGWQLSALKYCAKTASKPIIADGGLRVHGDIAKSIRMGASFCMIVSLFAAHLESPGKEVEINNCIYKEYYGSASEYNKSEKRYVEGKKELIKIRGSIFDTLKEMTEDLQSSISYAGGKDLQAIKRVDYVLLGDYKD

SEQ ID NO: 24574 - protein, 351 aa, Mycoplasma mycoides subsp. mycoides SC str. PG1
MENNILELRNVTKEYDGQVVLKGISFNVKEGEFITLLGPSGCGKTTILKIIGGSQKPNSGEILFEDKNLIPIPINKRQFNTIFQSYALFPHLNVFDNVAFGLTIKKTKKDIIEREVMRQIRQVGLEGYENKKIDELSGGQKQRIAIARALVMKPKVLLLDEPMAALDVKLRKTMQEELKRLQQDIGITFIMVSHDQEEALSMSDRIVVMNQGTIQQIGTPEEIYNEPENAWVANFIGSSNIITDGIFLEDNKIKFDGKVFECIDTNFGENESSIDIIIRPEDIIIKNPNNGFFNAKVIKTTFKGIHWEIVVETSKKRQWIIHTINEYDVDQQVSIKWKPANVHVMWKEVDN

SEQ ID NO: 24575 - protein, 451 aa, Mycoplasma mycoides subsp. mycoides SC str. PG1
MSRIERIFAREILDSRGTPTVEVEVWTEFGGYGCAKAPSGASTGVNEALELRDGDKARYNGKGVLKAVKNVNEIIAPKLIGVDALDQLTVDRIMLDLDGTEFKTKLGANGILAVSLAVAKSAASELDIPLYKYLGGVQAKKLPVPMLNVINGGEHADSAIDFQEFMIMPVGAKSFSEALRWSSETFQALKSLLKSKKDITAVGDEGGFAPNFEWAYEKHDLKSFKAKTPAEIALDLLVEAIKKAGYKPGKDGIMIAMDCASSELYLEDKKYHFKKIEKVTNQEWSLTTDEMISYLEKLVDNYPIISIEDGLAETDWEGFTKLTQKIGDKVQIVGDDLFTTNPKFIKQGINKKAANSTLIKLNQIGTLSETVEAITMTQKAGWTAVVSHRSGETEDTTIADLAVAFNTGQIKTGSMSRSDRIAKYNRLLQIESELDKNAVYDGLEAFYNLKK

SEQ ID NO: 24576 - protein, 190 aa, Mycoplasma mycoides subsp. mycoides SC str. PG1
MQKLHPLVKEVLFTRDQIQKRTKEIAKEVESYYKDKPLKDNSLLVVGLLKGCVPFYTDFCMVCDLTMEMDFMVVSSYHGSTSSNSAPKINLDLNTDVKDRDILIVEDIIDTGFTLKYVKEYLLNKGAKSVKILTMLDKPSGRKIDLTADWVCFTIDPCFVIGYGLDYQEKIRNLPYVAVCDTTKLDDWKW

SEQ ID NO: 24577 - protein, 478 aa, Mycoplasma mycoides subsp. mycoides SC str. PG1
MTKEKLQKRMKRTKVITTIGPSTHSAEAIKELFNNGMTTIRLNFSHGSYEEHGYRIKAAKKISKALNKPISIMLDTKGPEIRLGKFKDNKQEVVKGQAITIYTDNYSYLNKECVQGEMTVAYDMSVDLKPEDMILIDDGKLELTVDSVEPQIIKATAFNHHIVKTNKRVNLPGIDFSLPFLSEKDEKDILFGCEQDVDYIAASFVNTAENVRQIKEILTKANANHIQIISKIESQVGLDNIDEIIEESDGIMIARGDLGLEIPYYDVPYWEKIIIRKCREKGKIVIVATQMLETMTENPSPTRAEVTDVYYATELGADATMLSGESAAGDYPFLTVHTMSTINKRAEVEFYNKIYYQVQLDNARNSTSGPRAEIADLLATKTKDGEYKYAIVLSKTGELLKTISKFRPNVTILGVSPDKKLWTSFGVWHSIFMNKVDTLDNLDNNVEKLSEIAKSWGAKFGEKVLVVRSTAIKEIEVI

SEQ ID NO: 24578 - protein, 454 aa, Mycoplasma mycoides subsp. mycoides SC str. PG1
MKVIVLGTNHAGTTAVRTLKRLDPTCEVTTYDKNDAISFLGCGIALWVKGEVKDPNMLFYATPEILRSEGVNVFMNHEVLSVDDKAKTVTVKDLKTGEVKTDNYDKLIVATGTWPLIPPIPGIDLEGVQICKNYHHAKKILEHNLDKSYKKIAVVGAGYIGVELVEAFNEYGKDVTLIDVANRIMPVYYDQEFTDLMQEKMTKAGVKLSLGAKVIEFKGENGKVTQVVTDKGNIDVDYVIFSVGVRPQSAILEGICDLDDRKAIVTNDFMQTTNPDIYAIGDCAQVYNKAMNKNVPIQLATTAVRTGVIAAFNVIKGNGLKSPGFTGANGISVFGLHMASVGISVEAAKRMGYDVDFINFKDLDRPEFMSTANEVLFKVVWDKKTRKIIGAQVASEKNHTEVMYMLALGIQKDLTIDELPLVDIFFLPHFNKPFNFISLAGLEVLGLNYFKKEK

SEQ ID NO: 24579 - protein, 225 aa, Mycoplasma mycoides subsp. mycoides SC str. PG1
MKKYIIAPSVLSANFMDLKNELELCKKNNINWIHYDVMDFDFVPNLTFGSKILHDIKKNIDINVDVHFMVSVKTKQFEDFFSDYIKAKPEMMTMHIESLKDNNTIIKFIDLCKKNNILASLAISPKTDVSLVYPYLDKLDNVLVMSVEPGFGGQKFISSSLEKIQILDQLRKEKKYKYIIEVDGGINEQTSVLVKQAGVDMIVAGSYLFGSGDFTKRAKGLFDEL

SEQ ID NO: 24580 - protein, 218 aa, Mycoplasma mycoides subsp. mycoides SC str. PG1
MKIVPSIYCANLIDLKTEITNLTKAQINQIHFDVMDGVFVKNYALSNKLVDEIKQQFPNLIIEVHIMGIDLLDKISLFKNADYLTFHYNAINDLNQAKLWINEIKKYNLKPGIALDLNNEINDIKKILNEIEVVTFMSIKPGFTGQKFEESSWTKLNLIKELKLKYPHLKFQIDGGVRWENIKKLIDCQLDWIVVGSLLFNENDYLKVVSRIKQLETN

SEQ ID NO: 24581 - protein, 427 aa, Mycoplasma mycoides subsp. mycoides SC str. PG1
MIKVNLDHTNIDINKVVDLNKVKQIHQMIINKTGKGNDYLGWLNWPNDYNKTEYEQMKQVANKLRSEIEVLVVIGIGGSYLGCRAADEMIRGLYHQDKVELIYAGNTMSSTYIYQLVEYLKNKNFGICVISKSGTTTEPGISFRVFEKLLVDKVGLNKAKDLIVAITDKNKGALKQLADKKGYQTFVIPNDIGGRFSVLTPVGIFPLLVSGINTDNIFNGALKAKNELINDDLSNQAYKYAVIRNYLYNQGYKTDALISYELQLQMLTEWWKQLFGESEGKDNKGLLPSSMIFSTDLHSLGQWVQEGPRNVMFETIIKIEKPNYDLNVPIDEDNYDGLNYLTKNSFHQINQTALKGAIQAHSVTGNMPNIVLEFEKMDDEQFGYLVYFFELALTMSAYLLDVNPFNQPGVEVYKYNMFKLLNKPGIK

SEQ ID NO: 24582 - protein, 471 aa, Mycoplasma mycoides subsp. mycoides SC str. PG1
MYKFKALLDGKLFDNNRILEIINPVDFSVAGQVVSLTKQDINDAFIAAKSSQKAWENTDLEKRISILDKWKQLIDQNKEELAQIIMSETAKPYKDCLTEVIRSVEYIDQTFYEVRNLKTLIIDGAKYGAKNKIGTFMRVAKGVGVAISPFNYPINLAVSKIFPCLVTGNTIVFKPATQGSLIGAKLGELAYQANLPKGIFNVVTGRGREIGDDIITNKLADFISFTGSVEVGKRLLEISSTKDVVLELGGKDPAIVLDDLDLEKYAKEIISGAFSYSGQRCTAIKRVITTDKIADQLVPLLKEKINKLTVGLPKDNCDITPLIDQKTADFVYGLIDDAKKKGAKIIIGDKQEKNLIYPTLVDHVTSDMRLAWEEPFGPVLPIIRTNSVDQMIELANKSNFGLQASVYTKNLDQALTIAQKLEVGTVNINGKSQRGPDVFPFLGVKDSGFGVQGIVDTLLFLTRYKGIVINN

SEQ ID NO: 24583 - protein, 392 aa, Mycoplasma mycoides subsp. mycoides SC str. PG1
MNKYKKLFEPFELNGFKLENRFVLSPMTLSLATLDGKITTQEADYVKRRAHSAPLQITGGVYFDEFGQLFEYGISAKSDDDISSLTSLYQAMKTDSNCVILQLAHAGKFSKTSLKKYGYLYGPSYEKNHTPIEHEVLELPKEKIKQIIQDYKDATLRVIKAGFNGVEISMAQRLLMQTFFSQIINKRTDEYSTTTFENRSRFCLEVVKAIREVIDKHAPKNFIFGFRATPEETYGDILGYTIEDFIQLVDKIIEIGKISYLAIASWGHDIYLNKVRSNTKYKNQLVNKVIYDVYKNKLPVISSGGINTPDKCLEALKYSDLVGLSSVFVADPEFVLKIKNEQIDQINLSVKHDQLKDLKIPESSFQDVVNMFSFCETIPSETIKTFENNSKE

SEQ ID NO: 24584 - protein, 452 aa, Mycoplasma mycoides subsp. mycoides SC str. PG1
MQKFDVVVLGAGPGGYSLANILSLNNKKVALIEKEDLGGTCINKGCVPTKTLIKSAKVFELVKNSQKFGINADNISFDFKKMQQRRLDNKKFFNNSIKNQIDLNQISFFKGVGEVLDQNSIKVNDQIISFDKLVLATGTRAKIINFDGLEQSRKNGYLLDSDQALFLENVPSSLTIIGDGPISLEFAYLYNTLGSKVTILTNTDFLLRFDIDIQKSVRQYFDEKQIKVIENANIIKIDNNKVFYDQTSIESEKILLAVGRVPNNESFTKLDIKKDKNGFVIVDEFMKTNFDNIYAIGDITGLTLLSSVAYKTGDIVARNILKTDSEKFDKNLVTWAIYLNPEIAGIGLTEQQLKEQNIEFESIMINSKALPRAHADGIVNEYSFIKFLVSKQTEEILGCFMMIENANILINQIGLFMQQKLSFSTLQKTVYTHPTIGEALYYTSRVKGIKTN

SEQ ID NO: 24585 - protein, 404 aa, Mycoplasma mycoides subsp. mycoides SC str. PG1
MNYNNKKTLKDIDVKNKTVLVRVDFNVPIQNGVITDDNRIIAAFPTINYLLENDAKIVLFSHLSRIKSKEDKLKKSLAPVAKRLEELLNKQVKFINQTRGQELEKAISSLQSKEIILVENTRFEDVLDDQVVKYESKNNSELGKYWASLGEVFVNDAFGTAHRAHASNVGIASNIKVSAIGFLVEKELKMLFQAVNEPKKPFIAILGGAKVSDKIGVIENLLPKVDKLLIGGGMSYTFLKALGKTIGKSLLEEDKIDLAKHYLEIGKDKIVVPVDTACAKEFADVSPTIFEGNIPDEWDGLDAGPKTIELFKQEIKKAKTIVWNGPVGVFEFKNFENGTKSVCQAIAEQTQNGAFTLIGGGDSASAAINMGFKDKFSWISTGGGASLEFMEGKELLGISAIQDK

SEQ ID NO: 24586 - protein, 213 aa, Mycoplasma mycoides subsp. mycoides SC str. PG1
MNIMLLGAPGCGKGTQAEQLVNKLNFIQVSTGDLMRKEISLNTRLGLKCQEYMNAGKYVPDQIVNQIVSQFLKNTNDKLIFDGYPRTLEQAKSLEQMLDLYNKKIDYVFYIDVNDQILIKRITNRLVCPLCKASFNLETRKPKQEGLCDFDNTKLVKRSDDSLDKVQIRLQTYKEQTLPLIDYFKTNSKFIEIKADDLSAEQVFNQIKGELKI

SEQ ID NO: 24587 - protein, 469 aa, Mycoplasma mycoides subsp. mycoides SC str. PG1
MFGSMTDFNNLVNQAKKRNIYIMMDMIFNHCSTEHEWFLKALTNKKYQKRFIFVDNKNKLPNNWTSKLGGSVWEYNKTLDKYYLHLFDKTQADLNWKNKALRNDIFKIINYWLDKGVKGLRFDVINLISKPKTFKDDLIGDGRKYYTDRPLVHKYIKEMASKTYSLKSDVITVGELSSTSLKQAILYTKKESKELDMAFLFHHLKVDYLNNDKWQLDKYDPKKLVKVLKTQQIAFQKNNAWCANFLNNHDQPRAISRFGDYKNYYYQSATSLASVVLLLKGTPYLYQGEEFGMLNNNYSNINQLKDVESINYYKILKNKGLEKEEILNIISNRSRDNARTVMQWDDSLYAGFSSHKPWIDVNNNYLDINFKKDYSKSQSIFKAYQKLIRLRKKHLAFSYGDIEFINLNPNVLSFYRTYLNEKYLVIINLSDLKISSNKLNQFKNLRIVFNNYKNFKQIQPYQTLVLKCN

SEQ ID NO: 24588 - protein, 248 aa, Mycoplasma mycoides subsp. mycoides SC str. PG1
MKKKVIFGNWKMNGTNESLTDFLNQVDNKIDSSKIIAGLAVPYVMLQTGLKLAKNVKIAAQNVHYKDKGAYTGEISTTMLKEVGVEYVIIGHSERREMFNETDLDVNKKAKVLLENNITPIICCGETLQTKESGKTIEFVNNQINIMFEGIKKEDAIKAIIAYEPIWAIGTGKTATSSDAEEVCKQIRNNLSKIYDKNTAEQIIIQYGGSVKPSNIQEYLKMPNIDGALVGGASLLASDYLGLVNYNE

SEQ ID NO: 24589 - protein, 478 aa, Mycoplasma mycoides subsp. mycoides SC str. PG1
MMLIFMELIFYIKRIYMFKFKKDFWWGAASSGCQTESDKDKPNLNIMDYWYKQTPTDFYDNKGPNITCDTYSNYKTDVKLMSEIGLNSFRTSIQWTRLIKNLYTGEVDLKQVEFYRNYFLEIKKNNIKLIVNLFHFDTPIELENIGGWTNKKTVELYFLYAKQCFKYFSDLVDYWTTFNEPVVLVDGCYLNKWYYPKISNLKLAVQAAYNTILAHCKVANYFHSYFKNDQNKKISIILNLTPTIPKNSELKHLKAAKIRDELLNKSFLNAVIKGQFSTFLIKFLNENNLMPEYDQLELNEIKKTRIDFLAVNYYQPARVQAPLNNLTSSTELKLENWFLPYTNKNIRINPYRGWEIHPQTLYDIAIDIKNNYDNIPWIVSENGIGVSDENRFLNKQGYIDDQYRIDFIKEHLIYLYKAIEQGSNCFGYQMWTLIDNWSWANGFKNRYGFISLDTKTLKRTIKKSGYWIKQVIKDQGFE

SEQ ID NO: 24590 - protein, 183 aa, Mycoplasma mycoides subsp. mycoides SC str. PG1
MYDLKNIKKVLFTKEQINERIKQVANQVKQYYLDHPPVNGPLITIGLLKGCVIFNTEFVLNFDYPIQMDFMAVSSYNGMQSTGAIKIKLDTSLDLTNRDVLIVEDMVDTGLTLSKVKEHIIYKGANSVKVVTLVDKKDFHTVDFTPDWNCFNIDDYYIVGYGFDCNEDYRNLPYIALYQPDNN

SEQ ID NO: 24591 - protein, 471 aa, Mycoplasma mycoides subsp. mycoides SC str. PG1
MCKNREFLFFIFNNFNSIFIGKASMKIVIIGGAASGMTVASRLKKADKKAQIIVIQKEKYVSLGACGLPYFVANPSLKSTDLLARTVEQFIEQDILVYSESVVKKIDAENQKVWYEKNDQLLELDYDKLVISTGAKPIVPPIKGIDLPNIFTLTRLEDATELKEKLKDKNIKKVAVIGSGFIGLECCEMLEHFNKEIVLIEKTSRLNQRVFDQEITDLLEQNLIKNNVEIIKENGLKSITQTKDKRLSLTLDQNEEIEVDLIILAIGFRPATEFLKDTKLEMLGNGAIVVDKHGRTNLKNIWSCGDCATVYHKITNQITYTPLATVARKFAKVVADDILNVNSEFVGTLQTAILKVFESELVSTGINETLAKELGYDIKTIFIKDADHPSYYPNPTPLALKLILNKKTNTLIGAQMYGSNLSVLRINFLISLIWNQIEINQELTQVDLPYSPPFSRVVDIIHIALEKLIKN

SEQ ID NO: 24592 - protein, 471 aa, Mycoplasma mycoides subsp. mycoides SC str. PG1
MCKNREFLFFIFNNFNSIFIGKASMKIVIIGGAASGMTVASRLKKADKKAQIIVIQKEKYVSLGACGLPYFVANPSLKSTDLLARTVEQFIEQDILVYSESVVKKIDAENQKVWYEKNDQLLELDYDKLVISTGAKPIVPPIKGIDLPNIFTLTRLEDATELKEKLKDKNIKKVAVIGSGFIGLECCEMLEHFNKEIVLIEKTSRLNQRVFDQEITDLLEQNLIKNNVEIIKENGLKSITQTKDKRLSLTLDQNEEIEVDLIILAIGFRPATEFLKDTKLEMLGNGAIVVDKHGRTNLKNIWSCGDCATVYHKITNQITYTPLATVARKFAKVVADDILNVNSEFVRTLQTAILKVFESELVSTGINETLAKELGYDIKTIFIKDADHPSYYPNPTPLALKLILNKKTNTLIGAQMYGSNLSVLRINFLISLIWNQIEINQELTQVDLPYSPPFSRVVDIIHIALEKLIKN

SEQ ID NO: 24593 - protein, 459 aa, Arabidopsis thaliana
MAPARTRVNSLNVAVIGAGAAGLVAARELRRENHTVVVFERDSKVGGLWVYTPNSEPDPLSLDPNRTIVHSSVYDSLRTNLPRECMGYRDFPFVPRPEDDESRDSRRYPSHREVLAYLEDFAREFKLVEMVRFKTEVVLVEPEDKKWRVQSKNSDGISKDEIFDAVVVCNGHYTEPRVAHVPGIDSWPGKQIHSHNYRVPDQFKDQVVVVIGNFASGADISRDITGVAKEVHIASRSNPSKTYSKLPGSNNLWLHSMIESVHEDGTIVFQNGKVVQADTIVHCTGYKYHFPFLNTNGYITVEDNCVGPLYEHVFPPALAPGLSFIGLPWMTLQFFMFELQSKWVAAALSGRVTLPSEEKMMEDVTAYYAKREAFGQPKRYTHRLGGGQVDYLNWIAEQIGAPPGEQWRYQEINGGYYRLATQSDTFRDKWDDDHLIVEAYEDFLRQKLISSLPSQLLES

SEQ ID NO: 24594 - protein, 262 aa, Arabidopsis thaliana
MLNRASIYNIVQFTKEVHDFVKVRHKNLVSLIGYCDDGEHLALIYEFVANGDLNDQLSGKFGNVPSWETRLKIIIGVAQGLEYLHSELRILHRYVKPTNILLGENFEAKLADFGLSRSSPTNPDIQASNKIYVKPGRDPYLHHQYFNSNRLNQTSDIYSFGIVMLEMITNQPVVDNKRESPHISKWVDLKVAKGDTLEIVDLRLNNDFERDSVRKAMDIACSCAARAHNRPSMSQVVIELNECLALEMARSNGRTGETTQTQ

SEQ ID NO: 24595 - protein, 396 aa, Arabidopsis thaliana
MQFQLSKPANNKQRRNMETQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 24596 - protein, 332 aa, Arabidopsis thaliana
MATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 24597 - protein, 386 aa, Arabidopsis thaliana
MKKIFATKLLRPQVLENSRGVRAEELKRFYRRILDKARKNENIEISKESAMLMNNILCRMSMGRSFSEENGEAERVRGLVGESYALVKKIFFAATLRRLLEKLRIPLFRKEIMGVSDRFDELLERIIVEHKDKLEKEHQVMDMMDVLLAAYRDKNAEYKITRNHIKSFFVDLFVGGTDTSVQTTQWTMAEIINNPNILQTLRKEIDSVVGKSRLIHETDIPNLPYLQAVVKEGLRLHPPGPLLIRTFQERCEMKGFYIPEKTTLVINAYAVMRDPDSWEDPDEFKPERFLSYSRSGQEDEKEQTLKYLSFGGGRRGCPGVNLGYIFVGTAIGMMVQCFDWKIEGDKVNMEETYGGMNLTMVNPLKCTPVPRTQPFSFTSNLEILSS

SEQ ID NO: 24598 - protein, 435 aa, Arabidopsis thaliana
MLLKFGSIPTVVVSSSETAKQALKIHDLNCCSRPSLAGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 24599 - protein, 184 aa, Clover phyllody phytoplasma
MTLNKKTNNENSSKTTPKLSKETDLQNDFASKNYVFNPQDKVFQIAQVFGITSAVLIKKLLQLGLKSDVNQTLEKDIVELLAKDYNIKVSEPQKEKTSTQLQPQTPPLTKSKPQIQPNQKINLQKTPPIVIIMGHVDHGKTTLLDAIRKTRVVDKEFGGITQHIGAYQVEYQGNKITFIDTPGH

SEQ ID NO: 24600 - protein, 232 aa, Hyacinthus orientalis
ESFRSDYVLGEGGFGTVYKGYTDENARVGSKSLPVAVKVLNKDGLQGHREWLTEVNFLGQLRHPNLVKLVGYCCEDDHRLLVYEFMFRGSLENHLFRKTAAPLPWATRMMIALGAAKGLAFLHNAERPVIYRDFKTSNILLDSDYTAKLSDFGLAKAGPHGDETPCVNSSNGHIWICSSRSMQRLVIRRRGAMSTAFGVVLLQLLTGPGVGGQDPAPATEQSPPRLGPPPSL

SEQ ID NO: 24601 - protein, 479 aa, Arabidopsis thaliana
MNLFWNTGFCVIVLVVARVGHWWYQWSNPKSNGKLPPGSMGFPIIGETLDFFKPYGFYEISPYLKKKMLRYGPLFRTNILGVKTVVSTDKDVNMEILRQENKSFILSYPDGLMKPLGKDSLFLKIGNIHKHIKQITLHLLSSEGLKRKILKDMDRVTREHLSSKAKTGRLDVKDAVSKLIIAHLTPKMMSNLKPQTQAKLMGIFKAFTFDWFRTSYLISAGKGLYNTLWACREGMREIKDIYTMRKTSEEKYDDFLNTAIEESEKAGELLNENAIITLIFTLSCVTQDTTSKAICLAVKFLLENPKVLAELKKEHEVILESREDKEGGVTWEEYRHKMTFTNMVINESLRITNLAPMLFRKAVKDVEIKGYTIPAGWIVMIIPSVVHFDPEIYENPFEFNPWRWEGKELRAGSKTFMVFGTGLRQCAGAEFARLQISVFLHHLVTTYNFSLHQDCEVLRVPAAHLPNGISINISKCPKK

SEQ ID NO: 24602 - protein, 331 aa, Arabidopsis thaliana
MSNSESYPPEFRPLMSEKSTETGLDRSKDIDIPVIDMEHLDMEKLREACKDWGIFHLENTGIPLTFMSQVKEITESVLSLPFEEKRTLFGVNSPLSYYWGTHTVSPSGKAVTRAPQESSGHLFEGINIPLASLSRLLALSCTDPKLESFRVVMEEYGKHVTRIIVTLFEAIIETLSLELSGDQKMGYLSESTGVIRVQRYPQCTESPGLEAHTDSSVISIINQDDVGGLEFMKDGEWFNVKPLASSFVVGLGDMMQVISDEEYKSVLHKVGKRMRKKERYSIVNFVFPDKDCMFNSTRYKPFKFSEFEAQVKLDVETHGSKVGLSRFLSNP

SEQ ID NO: 24603 - protein, 456 aa, Arabidopsis thaliana
MISPTMEQGESLRIRVVMGKDRISELPDGLLLKILSSLPTNIVVATSVLSKQWRSLWKLVPNLEFDSDDYESEHYTFSEIVCKSFLSHKAPVLESFRLKFVNFNPVDIGLWVGIAFSRHLRELVLDFYPAELGKGVTFTFPSSLCTCNTLETLKLVLCILVDIPSPVLMKSLRTLHLEFVRYKDESSVRNLLSGCPGLEELRLYRGDDSDIKVFTIEVPSLQRLTIHDNNDGPEFWGYVINAPFLKYLLIEELRCPEFCLNAPELVEANIAEVTSITIEKFLGSFTSVSRLLLNLSPLKITYPTGSMFYQLVSLEMYTREAEWWNLLTLMLENSPKLQVLKLTDRSQNFHKDGLVSGKWNEPKDVPECLLSQLETFVWRRFDWGREEEKEIATYILKNGRRLKKATFSTNPIESEELNKLKERRKVLNGLDGVVRASNSCQLVFKFDPSYLGSDSP

SEQ ID NO: 24604 - protein, 359 aa, Arabidopsis thaliana
MKSMVKKLKQSLRSGSLEKRKEKEKDIQEEKWFLDNGSIFLKELIADCNGKSIPIRNFSSDQILKATSNFGSSCFVTAEGFYVWYKGIIEDRSYMIKRFSEYKVTQYRVAEVYNEIVLSARMSNHNNFLKLIGFCLEFSLPVLVFEYAEHGVLNHRGGVIVNGEEVILPLSLRLKIGKEIANAVTYLHMAFPKILIHRHIKPRNVFLDENWTPKLSDFSISINLPEGKSRIEVECVQGTIGYLDPVYYTTKMVTEYTDVYSFGVFLMVILTGKPALASTSSDGDYKHIASYVKGFHENGQLDGVIDPKVMEDITSAQKVHVEACVVLALRCCELRDENRPKMIQIAKELKQIETLFRRS

SEQ ID NO: 24605 - protein, 400 aa, Arabidopsis thaliana
METDEAYQKKERAALVAIVVLACLALSSLFVAFSYYCYIRNKVSKRHRISKRFDCEEKGDCQKVQDVTENGLQIFTFKQLHSATGGFSKSNVVGNGGFGLVYRGVLNDGRKVAIKLMDHAGKQGEEEFKMEVELLSRLRSPYLLALLGYCSDNSHKLLVYEFMANGGLQEHLYLPNRSGSVPPRLDWETRMRIAVEAAKGLEYLHEQVSPPVIHRDFKSSNILLDRNFNAKVSDFGLAKVGSDKAGGHVSTRVLGTQGYVAPEYALTGHLTTKSDVYSYGVVLLELLTGRVPVDMKRATGEGVLVSWALPQLADRDKVVDIMDPTLEGQYSTKEVVQVAAIAAMCVQAEADYRPLMADVVQSLVPLVRNRRSASKLSGCSSSFSLARSPNSPGKASIGSQ

SEQ ID NO: 24606 - protein, 491 aa, Arabidopsis thaliana
MDRVGSLPDELLSHILSFLTTKEAALTSLLSKRWRYLIAFVPNLAFDDIVFLHPEEGKPERDEIRQSFMDFVDRVLALQAESPIKKFSLKCRIGVDSDRVDGWISNVLNRGVSELDLLIILGMTMEDSYRLSPKGFASKTLVKLEIGCGIDISWVAGSIFLPMLKTLVLDSVWFYVDKFETLLLALPALEELVLVDVNWLDSDVTISNASLKTLTIDSDGHLGTFSFDTPSLVYFCYSDYAAEDYPVVKMENLREARIFLLVTDNEIERVRLPINDGLEDAMDNVVLRFGHVGKLMNGIRNVEYLELSADTLEVLSLCCESMPVFKNLKSLAIKSTEGRGWQAMPVLLRNCPHLEFLLIEGLLHHVTDKCGDACDCVPREDKGRSLTSCPVNMLEIHGFRGTKKEMQMIKHFLDYFPSLKEMDIYADEDGPTNLEAPGMFEQITQLFTLYDEFYTCDVQFMVRGSLYKKLTAQCCVFKEENLPHRLVRTLG

SEQ ID NO: 24607 - protein, 509 aa, Arabidopsis thaliana
MFIVFSFSHTRKTCEFCDRIQLSISQGFENPNLSMEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQVMKETA

SEQ ID NO: 24608 - protein, 388 aa, Arabidopsis thaliana
MSSKRMDSGSKDIISNLPDALLCHVLSFLPTTEAASTSVLAKRWRFLLAFVPNLDLDNMIYDRPKMGRRKRLELRKSFKLFVDRVMALQGNAPLKKFSLRCKIGSDPSRVNGWVLKVLDRGVEELDLYIASEYEYPLPPKVLMTKTLVSLKVSGTDEFTIDVGEFFLPKLKTLHLSAISFGDEGGPPFAKLISACHALEELVMIKMMWDYWEFCSVSSPSLKRVSIDCENIDENPKSVSFDTPNLVYLEFTDTVAVKYPKVNFDSLVEASIGLRMTPDQVFDARDLVNRHHGYKRCKGANAADFMMGVCNVKTMYLSSEALEVLTFCCKKAIPVFNNLIHLTVETDERVDWESLPILLKNCPNLETLIFEVPSHILFLHDLTHFFSNT

SEQ ID NO: 24609 - protein, 409 aa, Arabidopsis thaliana
MDRISGLPDEVLVKILSFVPTKVAVSTSILSKRWEFLWMWLTKLKFGSKRYSESEFKRLQCFLDRNLPLHRAPVIESFRLVLSDSHFKPEDIRMWVVVAVSRYIRELKIYSSHYGEKQNILPSSLYTCKSLVILKLDGGVLLDVPRMVCLPSLKTLELKGVRYFKQGSLQRLLCNCPVLEDLVVNLSHHDNMGKLTVIVPSLQRLSLSTPSSREFVIDTPSLLSFQLVDRNDNSHTFLIENMPKLREAYINVPFADIKSLIGSITSVKRLAISSEVGYGEGFIFNHLEELTLWNKYSSNLLVWFLKNSPNLRELMLVSETDDHENLGMLSWNQPSIVPECMLSSLQKFTWFKYLGRPQDRDIAVYILKNACRLRTATIKSDTRLFTKLEMITELRLSSQASSTCELNFS

SEQ ID NO: 24610 - protein, 350 aa, Arabidopsis thaliana
MMISERDDFSLTGPLHLTSIDWANEHHRRSVAGSLVQGIYVAERDRQLQREGPELALSPIWSEFFHFRLIRKFVDDADNSIFGGIYEYKLPQQLSQTVKSMEFSPRFVIAFRGTVTKVDSISRDIEHDIHVIRNGLHTTTRFEIAIQAVRNIVASVGGSSVWLAGHSLGASMALLTGKTIARTGFFPECFAFNPPFLSAPIEKIKDKRIKHGIRIAGSVITAGLALAKKATQHYSQNDRALPAPPDPFEALSDWFPRLYVNPGDHLCSEYVGYFEHRNKMEEIGIGFVERVATQHSLGGMLLGGQEPVHLIPSSVLTVNLSSSRDFKQAHGIHQWWREDNKFETKVYQYK

SEQ ID NO: 24611 - protein, 497 aa, Arabidopsis thaliana
MEMILITLCLTTLLALLLKSILKRTATKNFNLPPSPWRLPVIGNLHQLSLHTHRSLRSLSLRYGPLMLLHFGRTPVLIVSSADVAHDVMKTHDLVCANRPKTKVVDKILSGGRDVAFAPYGEYWRQMKSICIQNLLNNKMVRSYEKIREEEIKRMIEKLEKASCSSSPSPVNLSQILMTLTNDIICRVALGRKYSGKKDGIDVENIVRTFAALLGEFPVGEYIPSLSWIDRIRGLDHKMEVVDKRFDEFLERVVKEHEEADKETRSDLVDKLLTIQSDKTGQFELEKSALKLIIWDMFLAGTATTLSFLEWAMTELMRNPKVMKKLQEEIRSSSPQDLFVTEKEAEKMNYLQAVIKEALRLRPPAPLLVPRVLSEDVKLKGYNIPAGTQVIVNAWAIQRDTTTWGTDAEEFKPERHLDTNLDFQGQDFKFIPFGSGKRICPGIGFTSALIGVTLANIVKRFNWRMDVEPQRVQHDLTEATGLVVFRKFPLIAIPSSA

SEQ ID NO: 24612 - protein, 435 aa, Arabidopsis thaliana
MAYEIFKAHDVNVSSRGIIALDESLMFGASGILNAPYGDYWKFMKKLMATKLLRPQVLERSRGVRVEELHRFYRSILDKATKNESVEIGKEAMKLMNNTLCKLIMGRSFSEDNGESNRVRGLVDETYALSEKIFLAAILRRPLAKLRISLFKKEIMGVSNKFDELLERILQERKENLEEKNNEGMDMMDVLLEAYGDENAEYKITWKHIKAFFVEFFIGGTDTSVQTTQWAMAEMINNANVLERLREEIVSVVGETRLIQETDLPNLPYLQAVVKEVLRLHPPSPVLIRKFQEKCEVKGFYIPEKTTLIVNVYAIMRDSDSWEDPEKFKPERFLTSSRSGEEDEKELKFLPFGSGRRGCPGANLGSIFVGTAIGVMVQCFDWKIKEDKVNMEETFEGMTLKMVHPLTCTPFFEPNLYLLLLISKFPCLILSFGAC

SEQ ID NO: 24613 - protein, 415 aa, Arabidopsis thaliana
MDRINGLSDDIICHILSLLSFKEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKGPLSADRYEREYGLSCPVKVLEITEYGGKYEELEQMEHFLKKLPCLELVKVRASAINDKEKSRITKDLLMVPRSSNCNIKLKFC

SEQ ID NO: 24614 - protein, 1262 aa, Arabidopsis thaliana
MVSDADASTSSSSIDIMPSANIQNDVPEPSVHTSHRRTRKPAYLQDYYCHSVASLTIHDISQFLSYEKVSPLYHSFLVCIAKAKEPSTYNEAKEFLVWCGAMDDEIGAMETTHTWEICTLPPNKKPIGCKWVYKIKYNSDGTIERYKARLVAKGYTQQEGIDFIETFSPVCKLTSVKLILAISAIYNFTLHQLDISNAFLNGDLDEEIYMKLPPGYAARQGDSLPPNAVCYLKKSIYGLKQASRQWFLKFSVTLIGFGFVQSHSDHTYFLKITATLFLCVLVYVDDIIICSNNDAAVDELKSQLKSCFKLRDLGPLKYFLGLEIARSAAGINICQRKYALDLLDETGLLGCKPSSVPMDPSVTFSAHSGGDFVDAKAYRRLIGRLMYLQITRLDISFAVNKLSQFSEAPRLAHQQAVMKILHYIKGTVGQGLFYSSQAEMQLQVFSDASFQSCKDTRRSTNGYCMFLGTSLISWKSKKQQVVSKSSAEAEYRALSFATDEMMWLAQFFRELQLPLSKPTLLFCDNTAAIHIATNAVFHERTKHIESDCHSVRERSVYQATLSYSFQAYDEQDGFTEYLSPILRGTIMYIVSMFGLAGLEALICFIFLFLFSFLTSFKASAQNPFYLNHDCPNRTTYSSNSTYSTNLKTLLSSFASRNASYSTGFQNIRAGQTPDRVTGLFLCRGDLSPEVCSNCVAFSVNESLTRCPNQREAVFYYEECILRYSHKNFLSTVTYEGELIMRNPNNISSIQNQRDQFIDLVQSNMNQAANEAANSSRKFSTIKTELTSLQTLYGLVQCTPDLARQDCFSCLTSSINRMMPLFRIGARQFWPSCNSRYELYAFYNETAIGTPSPPPLFPGSTPPLTSPSIPGKSGNSTVLVVAIVVLAVLLFIALVGYCFLAQRTKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQTQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFDESDGAQDLLTHTWRLWTNRTALDLVDPLIANNCQNSEVVRCIHIGLLCVQEDPAKRPTISTVFMMLTSNTVTLPVPRQPGFFIQSSPVKDPTDSDQSTTTKSTPASIDDELITDLYPR

SEQ ID NO: 24615 - protein, 484 aa, Arabidopsis thaliana
MEAMKETVEESLREMRETFASGRTRSLKWRKAQIGAIYEMVKDNEDKICNALFQDLGKHSTEAFRDELGVVLRTATVAINCLDKWAVPKHSKLPLLFYPAKGKVISEPYGTVLVLSSWNFPISLSLDPLIGAIAAGNTVLLKSSELSPNASAFLAKTIPAYLDTKAIKVIEGGPDVATILLQHQWDKIFFTGSPKIGRIIMAAAAQHLTPVTLELGGKCPTIVDHHTISKNIKSVVKRIAGGKWGSCNGQACISVDYVLIEKSFAPTLIDMLKPTIKSFFGENPKESGCLSRIANKHHVQRLSRLLSDPRVQASIVYGGSIDEDKLYVEPTILLDPPLDSEIMNEEIFGPILPIITVRDIQESIGIINTKPKPLAIYAFTNDENLKTRILSETSSGSVTFNDVMIQYMCDALPFGGVGESGIGRYHGKYSFDCFSHEKAIMEGSLGMDLEARYPPWNNFKLTFIRLAFREAYFKLILLMLGLKR

SEQ ID NO: 24616 - protein, 491 aa, Arabidopsis thaliana
MNKSKKGKSKTVWVCESCGHSEGQWWGSCRACHKVGTMKRFSEGSESSASGGGGNGTGLGFTEGKGLSWLPEQATVQPHRLTDVIHGITQQQWRISLPGLFGNEVARVLGGGLAPGSLILIGGDPGIGKSTLLLQIASIIAEGSELAEPAPVLYISGEESVEQIGSRADRMRIQTEELYLFSSSDLQDILNKAHRLSPRALIIDSIQTVYLKDVTGSAGGLTQVKECTSTLLRFAKKSNIPVFLVGHVTKAGDIAGPRVLEHIVDVVLYLEGEESSTYRLLRSVKNRFGSTDELGVFEMANSGLEVVSNPSGIYLSQQNPDSDVLAGLAVAVVMDGSRSFLIEVQALCSPGSTVSRHVNGVQASRADMIIAVLMKQAGLRIQENGIFLNVANGMALSETAGDLAIAAAICSSFLEFPIPHGVAFIGEIGLGGEVRTVPRMEKRVSTVAKLGFNKCVVPKSVEESLKALSLKEIEIIGCKNLKELINAVFKG

SEQ ID NO: 24617 - protein, 439 aa, Arabidopsis thaliana
MDRISHLADEILSKILSFLGTKDVMQTMLLSKRFKSQWLLVPKLEFDDSTHLPETWGYQEPDYGNFRRFVDRSLLSREGRVLQTLFLKLGRQCSYDDIAIWVGIAVKRGLMELKLKYTDSYYPKRSSLPRSLYTCETLVVLKLKKGYLDVPDLVCLRSLKTLSLRDMNYSNASCLLRLLASCPVLEELFIQQGYYDSCALSFKIILPCLKKLSYLPKRKKKYSGIDRSEVSGGISGLVLDAPSLKYLHIVDRSGLFSVSEIININAVVKATLEVNASRPEKLLYSLVSVEHIRLCLSATEVVYPVGLGSSFHKLKRLEVCTCKSEWLDLFIHLLEDSPSLQDIKINQCHPVTNPRPQWNQPGSVPRCLSSSLETLEWVEYGGTHEEKELSTYLFKTAVCFKKASFTAKWSGGDANKKLQMLQELALSPRVSPTCELVFN

SEQ ID NO: 24618 - protein, 461 aa, Arabidopsis thaliana
MNSASVSGESSLSDMIQTVHFSSGNPRIGETRGVMHLISDNAVSSSSSSSSSNLPIGRNPLVCVLGVPNHMTYADFCQFCGSFIQHILDMRTVRNDDIENRYSILIRFDSQESTDTFFQHFRGKQFNSLDEDVCRLLFALDVQFTGYSGSIDHTQPSAAGPIEQPTCPVCLERLDQDTGGILTTMCNHSFHCSCISNWPDSSCPVCRYCQQQPENSVCCVCQTTENLWMCVICGVVGCGRYKEGHARRHWEETEHCYSLELETQRVWDYAGDNYVHRLIQSKTDGKLVELNSHGSLSKDGCGSCEYSDSGMTDALLNSKVDMYFEKLLQNVKEETEQKISEAASKAISQRLQKLQTRFDRCVKEKQFLEDLNENLVKNKDVWSTKITEMKEREKKAVRAKDEKIQGLEEQLGNLMAQMDGESEVSETKEVQDATVSTTNTSSSGAGNVIHANKKKSNRRKG

SEQ ID NO: 24619 - protein, 423 aa, Arabidopsis thaliana
MKMGFVEKVKSNVFLYANYVFGCCIGASPKYMSSEANDSLGSKSSSVSIRTNPRTEGEILQSPNLKSFTFAELKAATRNFRPDSVLGEGGFGSVFKGWIDEQTLTASKPGTGVVIAVKKLNQDGWQGHQEWLAEVNYLGQFSHPNLVKLIGYCLEDEHRLLVYEFMPRGSLENHLFRRGSYFQPLSWTLRLKVALGAAKGLAFLHNAETSVIYRDFKTSNILLDSEYNAKLSDFGLAKDGPTGDKSHVSTRIMGTYGYAAPEYLATGHLTTKSDVYSYGVVLLEVLSGRRAVDKNRPPGEQKLVEWARPLLANKRKLFRVIDNRLQDQYSMEEACKVATLALRCLTFEIKLRPNMNEVVSHLEHIQTLNEAGGRNIDMVQRRMRRRSDSVAINQKPNAGFARQTAVGVIATAYPRPSDSPLFV

SEQ ID NO: 24620 - protein, 503 aa, Arabidopsis thaliana
MSNIQEMEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 24621 - protein, 488 aa, Arabidopsis thaliana
MKMMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 24622 - protein, 439 aa, Arabidopsis thaliana
MNRPKVQRRVGKYEVGKTLGQGTFAKVRCAVNTETGERVALKILDKEKVLKHKMAEQIRREICTMKLINHPNVVRLYEVLASKTKIYIVLEFGTGGELFDKIVHDGRLKEENARKYFQQLINAVDYCHSRGVYHRDLKPENLLLDAQGNLKVSDFGLSALSRQVRGDGLLHTACGTPNYAAPEVLNDQGYDGATADLWSCGVILFVLLAGYLPFEDSNLMTLYKKIIAGEYHCPPWLSPGAKNLIVRILDPNPMTRITIPEVLGDAWFKKNYKPAVFEEKEEANLDDVDAVFKDSEEHHVTEKKEEQPTSMNAFELISMSRALDLGNLFEEEEGFKRETRFAAKGAANDLVQKIEEASKPLGFDIQKKNYKMRLENVTAGRKGNLRVATEIFQVSPSLHMIEVRKTKGDTLEFHKFYKKLSTSLNDVVWKSGESSGLSK

SEQ ID NO: 24623 - protein, 378 aa, Arabidopsis thaliana
MAVVDVHRFAESITCHAWSPDLSMVALCPNNTEVHIYKSLSQDHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKYAHYLNGAFFLLKQQILQLDLSYSWAFGVKWSPSGNTLAYVGHSSMIYFVDDVGPSPLAQSVAFRDLPLRDVLFISEKMVIGVGYDSNPMVFASDDTGIWSFIRYIGEKKAASSNSSYSSQFSEAFGKFYGSQSKSTTANDASESRGGVHDNCINSIVSLSKAGSPKVMRFSTSGLDGKVAIWDLENMEQELGNQF

SEQ ID NO: 24624 - protein, 262 aa, Arabidopsis thaliana
MAIARTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENCQGGEWFHYTCVGLTPETRFKGKWYCPTCRLLPQSH

SEQ ID NO: 24625 - protein, 226 aa, Arabidopsis thaliana
MATSKKMITREEWEKKLNAVKLRKEDMNTLVMNFLVTEGYVEAAEKFQRESGTKPEIDLATITDRMAVKKAVQNGNVEDAIEKVNDLNPEILDTNPELFFHLQQQRLIELIRQGKTEEALEFAQEELAPRGEENQAFLEELEKTVALLVFDDASTCPVKELLDLSHRLKTASEVNAAILTSQSHEKDPKLPSLLKMLIWAQTQLDEKAVYPHINDLSTGKLEDPSE

SEQ ID NO: 24626 - protein, 461 aa, Arabidopsis thaliana
MYSLILHGKRLVQLKKCRHLSVPVNLLEKASPFSNSFSYANATDASLRAGRKGLSFSVSYLVDSLGLPKKVAESISKKVSFEDKGNPDSVLSLLRSHGFTDSQISSIITDYPQLLVADAEKSIGPKLQFLQSRGASRSELTHIVSTVPEILGKRGDKTISIYYDFVKEIIEADKSSKFEKLCHSLPEGSKQENKIRNVLVLRELGVPQRLLFPLLISDHQPVCGKENFEESLKKVVEMGFDPTTSKFVKALRVVYRFRDKTIEAKVNVCKSLGFSVGDVWAMFKKCPSFLNFSENKIVQTWETLKKCGLLEDDVLSVLKKFPQCINASEQKIMNSIETFLGLGFSRDEVAMIAKRFPQCLILSAETVKKKTEFLVKKMNWPLKAVVSTPAVLGYSLEKRTIPRCNVIKALMSKGSLGSELPGMSSVLVCTNEEFLCRYVKNHDDKKIVPELMAIFTGDRVS

SEQ ID NO: 24627 - protein, 136 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFDTDLCTVSTVTHPDTMMDGTGQCGSFPCSVAPTPLKC

SEQ ID NO: 24628 - protein, 397 aa, Arabidopsis thaliana
MENGEAKQSVPLLTPYKMGRFNLSHRVVLAPLTRQRSYGNVPQPHAAIYYSQRTTPGGFLITEATGVSDTAQGYQDTPGIWTKEHVEAWKPIVDAVHAKGGIFFCQIWHVGRVSNSGFQPNGKAPISCSDKPLMPQIRSNGIDEALFTPPRRLGIEEIPGIVNDFRLAARNAMEAGKHILDLEFKKLKPFKILICVLVVAGFDGVEIHGANGYLIDQFMKDTVNDRTDEYGGSLQNRCKFPLEIVDAVAKEIGPDRVGIRLSPFADYMESGDTNPGALGLYMAESLNKYGILYCHVIEARMKTMGEVHACPHTLMPMRKAFKGTFISAGGFTREDGNEAVSKGRTDLVAYGRWFLANPDLPKRFQVDAPLNKYDRPTFYTSDPVVGYTDYPFLESTA

SEQ ID NO: 24629 - protein, 386 aa, Arabidopsis thaliana
MKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVVGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 24630 - protein, 307 aa, Arabidopsis thaliana
MHLLIVFEDLEIGYVWILDDGPGTLREGGRRKEPLWIVFAVSGTINLNSYLSVSSYKTIDGRGQRIKLTGKGIRLKECEHIIICNLEFEGGRGHDVDGIQIKPKSRHIWIDRCSLRDYDDGLIDITRQSTDITVSRCYFAQHDKTMLIGADPSHVEDRCIRVTIHHCFFDGTRQRQPRLRFGKVHLYNNYTRNWGIYAVCASVEAQVFSQCNIYEAGVKKKTFEYYSEKAADKEEARTGLVRSENDLFLNGAQPSLMTGASEECVFHPSEHYPTWTVEPPSETLKQIMQICTGWQSLSRPSDHGVPK

SEQ ID NO: 24631 - protein, 363 aa, Arabidopsis thaliana
MGFDLKEIRTKKTLIGLGLGQLLSLLATSNGFTSSELARKGINVPTSQCFLNYVLLAIVYGSIMLYRRSDIKAKWYYYFLLAFVDVEANFLVVKAYQYTSLTSVMLLDCWAIPCVLVLTWFYLKTKYRLMKISGVFICIVGVFMVVFSDVHAGDRAGGSNPVKGDFLVLAGATLYAVSNTSEEFLVKNADTVELMTFLGFFGAIISAIQVSILERDELKAIHWSTGAVGFLAMAISILTSANQRRHILVYLLHFSRFQVFPFLRFTLTMFLFYPLVPVLLKTNGATMFNLSLLTSDMWAVLIRTFGYHEKVDWLYFLAFATTATGLIIYSMKEKDQEEHRFEEVGDEAAMQRKLLGEDDEPGT

SEQ ID NO: 24632 - protein, 407 aa, Arabidopsis thaliana
MGVISPTETLFLKSQHRLLQPRNYSYALAFHSTRRVANFPRNSFSSLGSCSVDFPLRSNPISQNSKSIHPWRRYVSESDSNELYHKKVSSIMETLKQAYSFIPHGILLSTILALVYPPSFTWFKPRYFVPGLGFMMFAVGINSNERDFLEALKRPDAIFAGYIGQYLIKPLLGYIFGVIAVSLFNLPTSIGAGIMLVSCVSGAQLSNYTTFLTDPSLAALSIVMTSISTATAVLVTPMLSLLLIGKKLPVDVFGMISSILQVVITPIAAGLLLNRLFPRLSNAIKPFLPALTVIDMSCCIGAPLALNIDSILSPFGATILFLVITFHLLAFVAGYFFTGFFFSKAPDVKALQRTISYETGMQSSLLALALATKFFQDPLVGVPPAISTVVMSLMGVSLVTIWKNRKE

SEQ ID NO: 24633 - protein, 484 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYRFGQLLERATGFSMGHSRFPKTDCPLCWPGSRRSKCRMTELPLAFLYLERGD

SEQ ID NO: 24634 - protein, 332 aa, Arabidopsis thaliana
MDRINGLSDDIICHILSLLSFKEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKV

SEQ ID NO: 24635 - protein, 390 aa, Arabidopsis thaliana
MTKLLEINHIQTLCFAKGFSPARLNVATSPFRISRRGGGGYCSNACIPYRLKFTCYATLSAVVKEQASDFSGKEAALLVDELRSNFNSGRTKSYEWRISQLQNIARMIDEKEKCITEALYQDLSKPELEAFLAEISNTKSSCMLAIKELKNWMAPETVKTSVTTFPSSAQIVSEPLGVVLVISAWNFPFLLSVEPVIGAIAAGNAVVLKPSEIAPAASSLLAKLFSEYLDNTTIRVIEGGVPETTALLDQKWDKIFFTGGARVARIIMAAAARNLTPVVLELGGKCPALVDSDVNLQVAARRIIAGKWACNSGQACIGVDYVITTKDFASKLIDALKTELETFFGQNALESKDLSRIVNSFHFKRLESMLKENGVANKIVHGGRITEDKL

SEQ ID NO: 24636 - protein, 352 aa, Arabidopsis thaliana
MEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 24637 - protein, 358 aa, Arabidopsis thaliana
MILSLITGLELSKPTSFRLPGFSVIGHRGIGMNVLQSSDRRARGVKENSILSFNSAAKYPIDFIEFDVQVTKDDCPVIFHDDFIYSEENGIVNESRVTDLSLSEFLLYGPQKETEKIGKTLMRKSKEGKVLKWDVDLDDSLCTLQEAFEQVEQTLGFNIELKFDDQTVYEREFLVHILRSVLQVVSNYAKDRPVIFSSFQPDAAKLVRELQSTYPVFFLTDAGNEIHNDERRNSLEEAIQVCLEGGLQGIVSEVKGVFRNPAAISKIKESNLSLLTYGKLNNVGEAVYMQYVMGIDGVIVDFVEEIIESTTRMMIRPPPSSSPLPSPSKDDDVAITRPEFSQKEISFLLKLLSQLIQH

SEQ ID NO: 24638 - protein, 354 aa, Petroselinum crispum
MKKGNLGPGLKLSLPPPDEDSLTKFLTQSGTFMDGDLLVNRDGVRIVSQTDVQAAPPIQATDNQLSLADFDAIKVVGKGSGGIVRLVQHKWTGQFFALKVIQMNIQESARKQIAQELKINQSSQCLNVVVCYQSFYDNGAISIILEYMDGGSLADFLKIVKNIPEPYLAAIFKQVLKGLWYLHHEKHIIHRDLKPSNLLINHRGEVKITDFGVSAILATTSGQANTFVGTYNYMSPERISGGQHGYSSDIWSLGLVLLECATGYFPYSPPEQDEGWSNVFELMDTIVNQAPPCAPPDEFSPEFCSFVSACVQKDPRKRPSANELLRHPFINMYEHLNIDLAGYFTEAGSPLATL

SEQ ID NO: 24639 - protein, 204 aa, Arabidopsis thaliana
MVVQTSYGDIEFGFYPTVAPKTVDHIFKLVRLGGYNTNHFFRVDKGFVAQVADVASGRSAPMNEEQRKEAEKKIVGEFSDVKHVRGTLSMGRYDDPNSAQSSFSMLLGNAPHLDRQIGGIQQYAVFGKVTKGDETLSKLEEVPTRREGIFVMPTERITILSTYYYDTKMESCEEERSVLKRRLQASFVEVERQNEVLPVNEVNT

SEQ ID NO: 24640 - protein, 357 aa, Colletotrichum lagenarium
MAEFIRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALSHDYLAPYHDPTDEPVAEEKFDWSFNDADLPVDTWKIMMYSEILDYHNVDASAQQIEEQFNGQ

SEQ ID NO: 24641 - protein, 396 aa, Haemophilus influenzae R2846
MQTKYDLSTMFIHSGRQKRFSQGSVNPVLQRASSLLFDSIEDKKHATQHRAKGELFYGRRGTLTHFALQDLMCEMEGGAGCYLYPCGTAAVTNSILSFVKTGDHVLMSGAAYEPTQYFCNIVLKKMQIDITYYDPLIGADIATLIQPNTKVLFLEAPSSITMEIPDIPTIVKAARKVNPNIVIMIDNTWSAGVLFKALEHDIDISIQAGTKYLVGHSDIMIGTAVANARTWDQLREHSYLMGQMVDADSAYTTARGIRTLGVRLKQHQESSIKVAKWLSEQPEVRTVYHPALPSCPGHEFFLRDFSGSSGLFSFELTQRLTSEQVSKFMDHFQLFAMAYSWGGFESLILCNQPEEIAHIRPNIKRNLTGSLIRVHIGFENVDELIADLKAGFERIA

SEQ ID NO: 24642 - protein, 378 aa, Haemophilus influenzae R2846
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGNHVIPLYTAECGECEFCLSGKTNLCVSVRDTQGKGLMPDGTTRFSCQGKPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKLIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 24643 - protein, 456 aa, Haemophilus influenzae R2846
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGAKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCAIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 24644 - protein, 188 aa, Haemophilus influenzae R2846
MAGTSAAMLGFAPANVLAAPREYKLLRAFESRNTCTYCAVSCGMLLYSTGKPYNSLSSHTGTNTRSKLFHIEGDPDHPVSRGALCPKGAGALDYVNSESRSLYPQYRAPGSDKWERISWKDAIKRIARLMKDDRDANFVEKDASGKTVNRWATTGIMTASAMSNEAALLTQKWIRMLGMVPVCNQANT

SEQ ID NO: 24645 - protein, 474 aa, Haemophilus influenzae R2846
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLAAFTDPHTLVVRDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVAAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHCVLGGAIVGSNGGELLGEIGLAIEMGCDAEDIALTIHAHPTLHESVGLAAEVFEGSITDLPNAKAKKK

SEQ ID NO: 24646 - protein, 268 aa, Haemophilus influenzae R2846
MSRFETQFATLKAKNEGAFVPFVTLCDPTFDRSFEIICTLVDNGADALELGFPFSDPLLDGPVIQAANNRALTAGHSSEDSFKLLEKVRSKYPEIPISLLLCANLIFAKGLDDFYQRCAEVGVDAVLVADIPLLAKEDYVQAAKKHGIQPVFICPPNADEKTIQGVAENSEGYTYLVSRAGVTSAENQAHAANLDTLVEQLKAHNAPPILQGFGIAQPAQVKEALALGAAGAISGSATVKIIERNLDNHEQCLAELAEFVQTMKAATK

SEQ ID NO: 24647 - protein, 465 aa, Haemophilus influenzae R2846
MGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLTSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 24648 - protein, 488 aa, Haemophilus influenzae R2846
MSLRIKQEALTFDDVLLVPAHSTVLPNTANLSTQLTKEIRLNIPMLSAAMDTVTETKLAISLAQEGGIGFIHKNMTIERQADRVRKVKKFESGIVSEPVTVLPNLTLAELAEMVKKNGFAGYPVVDEENNLIGIITGRDTRFVKDLSKTVSQVMTKKEDLVTVKEGASREEILELMHQHRVEKVLVVNDSFKLKGMITVKDFQKAEQKPNACKDEFGRLRVGAAVGAGAGNEERIDALVKAGVDVLLIDSSHGHSEGVLQRVRETRAKYPNLPIVAGNVATAEGAIALADAGASAVKVGIGPGSICTTRIVTGVGVPQITAIADAAAALKDRGIPVIADGGIRFSGDIAKAIAAGASCVMVGSMFAGTEEAPGEIELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 24649 - protein, 273 aa, Haemophilus influenzae R2846
MTAIAIGALNAAPAPLANTAGIIPATIAMVVIKIGRTRSEYGTYGEIVNMPVHAVVKHPENLTMEQAAASWMMFVTAYGGLIEFGKVQKGDFVVLGGATSSVGIAAIQIAKMQGANVIALSRTHAKGDVLLQKGADFVIATKEDDVTAKLLEITNGKGVNLVFDPLGDKEAAKIINAMTQDGKYIIYGALSHDDIAVPVFPILGKHLTVRGYELFEITTVPEKLAQAKKFVFDGLASGQLKPEIDKVFAFDEMAEAHRYMESNAQIGKILVKV

SEQ ID NO: 24650 - protein, 404 aa, Haemophilus influenzae R2846
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIRSDEKMVLDLLRQEKVLLVHGKGFNWHSPDHFRVVTLPYVNQLEEAITKLARFLSDYRQ

SEQ ID NO: 24651 - protein, 241 aa, Haemophilus influenzae R2846
MLKIQKLSIAALMVSAVISSQVFAEDNTFDEKAASYAVGTLMGSQMKDLVDSHKEVIKYDNVRILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 24652 - protein, 264 aa, Haemophilus influenzae R2846
MNQNLIEVKNLTFKRGDRVIYDNLNLQVKKGKITAIMGPSGIGKTTLLKLIGGQLMPEQGEILFDGQDICRLSNRELYEVRKRMGMLFQSGALFTDISTFDNVAFPIREHTHLPESLIRQIVLMKLEAVGLRGAAALMPSELSGGMARRAALARAIALDPDLIMFDEPFTGQDPISMGVILSLIKRLNEALNLTSIVVSHDVEEVLSIADYAYIIADQKVIAEGTSEQLLQSQDPRVVQFLKGESDGPVRFKYPAQDYMKELFE

SEQ ID NO: 24653 - protein, 454 aa, Haemophilus influenzae R2846
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGKMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVVDALKVVRS

SEQ ID NO: 24654 - protein, 227 aa, Haemophilus influenzae R2846
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 24655 - protein, 349 aa, Haemophilus influenzae R2866
MSNNDFLVLKNITKAFGKVVVIDNLDLTIKRGTMVTLLGPSGCGKTTVLRLVAGLENPTSGQIFIDGEDVTKSSIQNRDICIVFQSYALFPHMSIGDNVGYGLKMQGIGKEERAQRVKEALELVDLAGFEDRFVDQISGGQQQRVALARALVLKPKVLLFDEPLSNLDANLRRSMREKIRELQQRLGITSLYVTHDQTEAFAVSDEVIVMHKGKIMQKAPAKELYLRPNSLFLANFMGESSIFDGKLENGVADINGYSVPLKDAAQFNLPDGECLVGIRPEAIYLAVEGNDAQRCEIKSAVYMGNHWEVVANWAGKDLLVNCKPEDFNANLKQAYVNLSDHGIFLLKKE

SEQ ID NO: 24656 - protein, 395 aa, Haemophilus influenzae R2866
MQQHNLSTTFVHAGRQKRFSQGSVNPVLQRASSLLFDSIEDKKHATQRRAKGELFYGRRGTLTHFALQDLMCEMEGGAGCYLYPCGTAAVTNSILSFVKTGDHVLMSGAAYEPTQYFCNIVLKKMQIDITYYDPLIGEDIATLIQPNTKVLFLEAPSSITMEIPDIPTIVKAARKVNPNIVIMIDNTWSAGVLFKALEHDIDISIQAGTKYLVGHSDIMIGTAVANARTWDQLREHSYLMGQMVDADSAYTTARGIRTLGVRLKQHQESSIKVAKWLSEQPEVKTVYHPALPSCPGHEFFLRDFSGSSGLFSFELTQRLTSEQVSKFMDHFQLFAMAYSWGGFESLILCNQPEEIAHIRPNIKRNLTGSLIRVHIGFENVDELIADLKAGFERIA

SEQ ID NO: 24657 - protein, 452 aa, Haemophilus influenzae R2866
MYPWQDFAIQPDFSDKIALRTTQGDVLTWIELTTKINQTVAFLQKKGVNAESVVAFVGKNSEKILFLYLATIQLGAKVLGINPAFPQEKIAKLCEFYQIDFCFYDKDLLNLQEIGVLTQKADFFRPATMTLTSGSTGLPKAVVHNVQAHLDNAKGVCNLMKFDCNQSWLLSLPLYHVSGQGIVWRWLYCGAQLHFPEDDFYASLLKTTHVSLVPTQLQRLLDYLQENPSISFSTRHILLGGTHIPTELTQNMVKYGIETYSGYGMTEMASTVFAKKSDGKQGVGQPLLGREYCLVNDEIWLKGAGLAMGYWKDRQIVPLTNNQGWIQTKDKGIWQEGELVIIGRLDNMFISGGENIQPEEIEQVIIQHSSVNQVFVLPQKNKEFGQRPVALVDFNEPFSKSAVENLMFFLQDKLARFKQPIAYYPLPLMLEKGIKISRKQLADWLAKRDEIN

SEQ ID NO: 24658 - protein, 488 aa, Haemophilus influenzae R2866
MSLRIKQEALTFDDVLLVPAHSTVLPNTANLSTQLTKEIRLNIPMLSAAMDTVTETKLAISLAQEGGIGFIHKNMTIERQADRVRKVKKFESGIVSEPVTVSPDLSLAKLAELVKKNGFAGYPVVDSENNLIGIITGRDTRFVKDLSKTVSQVMTKKDRLVTVKEGATREEILALMHQHRVEKVLMVNDSFKLKGMITVKDFQKAEQKPNACKDEFGRLRVGAAVGAGPGNEERIDALVKAGVDVLLIDSSHGHSEGVLQRVRETRAKYPNLPIVAGNVATAEGAIALADAGASAVKVGIGPGSICTTRIVTGVGVPQITAIADAAAALKDRGIPVIADGGIRFSGDIAKAIAAGASCVMVGSMFAGTEEAPGEIELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVTITKEAPNYRMG

SEQ ID NO: 24659 - protein, 404 aa, Haemophilus influenzae R2866
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 24660 - protein, 162 aa, Haemophilus influenzae R2866
MFIDTSELCDLYAEQVDVVEPIFSSFGGVSHFYGKVTTVKCFESNGLIAEVLEENGEGRVLVIDGGGAVRRGLIDAELAQLAVDNGWEGIIVYGAVRQIQQLENLDIGIHALAPIPVSADESSAGESDIPVNFGGVTFFPEDYIYADLTGIILSQEPLDLED

SEQ ID NO: 24661 - protein, 241 aa, Haemophilus influenzae R2866
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAEAIAKQAKEEGDKFRAEFAKGKDVKTTQSGLIYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 24662 - protein, 480 aa, Haemophilus influenzae R2866
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGSIVSIWNTAHNIGGMVPGAMVLLASAIFFSTHGIEAQAKDVWQQSLYFPGIAAMICAIPVYFVMRDTPQSCGLPSIEKWRNDYPDDYNEKTYENDLTAKEIFVTYVLKNKLLWYIALANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYQNPYQLTDFVLMTLIGFLIYGPVMLIGLHALELAPKKAAGTAAGFTGLFGYLGGTVSASAVIGWAAQHYGWDGGFFVMIGGGVLAVLLLLIVMVEEGKHKAKLGDTYGTK

SEQ ID NO: 24663 - protein, 264 aa, Haemophilus influenzae R2866
MDKSLKANCIGEFLGTALLIFFGVGCVAALKVAGASFGLWEISIMWGMGVALAVYATAGLSGAHLNPAVTIALWKFACFDGKKVIPYIISQMLGAFFAAALVYALYRNVFIDYETAHNIVRGTQESLSLAGTFSTYPHPSLSIGGAFAVEFVITAILMALIMALTDDGNGVPRGPLAPLLIGILIAVIGGAMGPLTGFAMNPARDFGPKFFAYLAGWGELALTGGREIPYFIVPMVAPVLGALAGAWLYKKAIGGNLPCNCGCE

SEQ ID NO: 24664 - protein, 472 aa, Haemophilus influenzae R2866
MPNANAIANVFKLIEENNVKFVLLRFTDIKGKEHGVSIPVSLVDEEMFEDGKMFDGSSVEGWKTINKADMLLMPMAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 24665 - protein, 196 aa, Haemophilus influenzae R2866
MIDFDGYRPNVGIVICNRKGQVLWAKRCGQNSWQFPQGGINDNESAEQAMYRELHEEVGLQPKDVRLLYVSKHWLRYKLPKRLLRYDSKPMCIGQKQRWFLLQLVSDEKNINMQTTKSPEFDGWRWVSFWYPVRQVVSFKRDVYRKVMKEFASILFTDNPLIFSASREANSQHYSANKKYSQTKYTKRHFYKSRGQ

SEQ ID NO: 24666 - protein, 316 aa, Haemophilus influenzae R2866
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLLGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 24667 - protein, 407 aa, Haemophilus influenzae R2866
MTDKVNSYGWKALIGSAVGYAMDGFDLLILGFMLSAISADLNLTPAQGGSLVTWTLIGAVFGGILFGALSDKYGRVRVLTWTILLFAVFTGLCALAQGYWDLLIYRTIAGIGLGGEFGIGMALAAEAWPARHRAKAASYVALGWQVGVLGAALLTPLLLPHIGWRGMFLVGIFPAFVAWFLRSHLHEPEIFTQKQTALSTQSSFTDKLRSFQLLIKDKATSKISLGIVVLTSVQNFGYYGIMIWLPNFLSKQLGFSLTKSGLWTAVTVCGMMAGIWIFGQLADRIGRKPSFLLFQLGAVISIVVYSQLTDPDIMLLAGAFLGMFVNGMLGGYGALMAEAYPTEARATAQNVLFNIGRAVGGFGPVVVGAVVLAYSFQTAIALLAIIYVIDMLATIFLIPELKGKALD

SEQ ID NO: 24668 - protein, 179 aa, Haemophilus influenzae R2866
MKKHYVDVLISENDVHARIAELGAQITKFYQEKQIDSLVVVGLLRGSFMFMADIVRQINLPVEIEFMTTSSYGTGMTTNHDVRITKDLDGDIKGKHVLIVEDIIDTGYTLEKVRDILNLREPASLTICTLLDKPSRREVEVPVEWVGFQIPDEFVVGYGIDYAQRHRNLGYIGKVVLEE

SEQ ID NO: 24669 - protein, 464 aa, Haemophilus influenzae R2866
MNFRLLSQYHADIKKLIKISLPILLAQIAQNSMGLADTIMAGRVSSTDMAAISIGASIWMPLMLFGQGLLLALPPTISYLNGSGQRHRIAHQVRQGIWLVLGVSIPLGLLIYFCEIPLQYMQMESKMSDLARDYLYAMLWGLPAYLMLINFRCLNDGIAKTKPAMVITFLGLLINIPLNYIFIYGKFGIPAFGAVGCGIATAIVNWAMCLMMIFYSYTNTQERSLKVFSQLIEMPNLKTLKKLLRLGLPIAIAICCEVALFALTSLMLSPLGATIVASHQITLNTSSFIFMFPMSIGMAATILVGQALGTGSPQNAKKIGYAALLLGLTVTIITALITIFFRYEIASIFVTDEIVIAMAANLLLFAALYQFSDTIQMVVGGILRGYKDTKMILYITLFSYWVIGVPLGYTLGRTDWLIPHIDAKGFWIAFVVSLTFAAFLLSLRMKKMQAMSDNAILQRLEKLK

SEQ ID NO: 24670 - protein, 458 aa, Haemophilus influenzae R2866
MAKAPKTAYVCNDCGAEFSRWQGQCSACKAWNTITEVRLISTAKSKNDRFSGYAGETQAKIQTLSEISLQETPRFSSGFNELDRVLGGGIVPGSAILIGGHPGAGKSTLLLQVMCGLAKNMTALYVTGEESLQQVAMRASRLGLPNDQLKMLSETSVEQICNLADQLKPQIIVVDSIQVMHLADIQSSPGSVAQVRECASFLTRYAKTRQVAIIMVGHVTKDGTLAGPKVLEHAIDCSLLLEGEADSRYRTLRSHKNRFGAVNELGVFGMTEQGLREVKNPSAIFLSRGDEITSGSSVMVLWEGTRPLLVEIQALVDHSMLANPRRVAVGLEQNRLALLLAVLHRHGGLQMADQDVFVNVVGGVKVSETSADLALLLALISSFRNRPLPQDLVIFGEVGLAGEIRPVPSGQERISEAAKHGFKRAIVPFGNKPKSAVENMQVFTVKKLTDALAVLDNL

SEQ ID NO: 24671 - protein, 315 aa, Haemophilus influenzae R2866
MKIVFLDSTAIPKHISIPRPSFEHTWTEYDHTSSAETIERAKDADIVITSKVIFDRETLKQLPKLKLIAITATGTNNVDLVAAKEMGIAVRNVTGYSSTTVPEHVIGLIFSLKHSLAGWLRDQREAKWAESKQFCYFDYPITDVRGSTLGVFGKGCLGTEVGRLANAVGMKVLYAEHKDATVCREGYTPFDEVLKQADIVTLHCPLTETTKNLINAETLSKMKKGAFLINTGRGPLIDELALVDALKTGHLGGAALDVMVKEPPEKDNPLILAAKTMPNLIITPHIAWASDSAVTTLVGKVMQNIEEFVQQLNQK

SEQ ID NO: 24672 - protein, 430 aa, Haemophilus influenzae R2866
MMDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCVIEPLADLLKKKGSEIAALILEPVVQGAGGMYFYSPTYLVKAQALCKQYGVLLIFDEIATGFGRTGKLFAAEHAGISPDIMCIGKALTGGYLTLSASITTTEIAQTICSGEAKCFMHGPTFMANPLACAIATESIRLLLESPWQQNIQRIEHYLKQQLSPLSEKDYVKEVRVLGAIGVVEMKSAVNMKTLVPRFVEQGVWIRPFGKLVYVMPPFVIKDDELQKLTEGMILALIQEYEH

SEQ ID NO: 24673 - protein, 268 aa, Haemophilus influenzae R2866
MSRFETQFATLNAKNEGAFVPFVTLCDPTFDHSFEIICTLVDNGADALELGFPFSDPLLDGPVIQAANNRALTAGHSSEDSFKLLEKVRSKYPEIPISLLLCANLIFAKGLDAFYQRCAEVGVDAVLVADIPLLAKGDYVQTAKKHGIQPVFICPPNADEETIQGVAKNSEGYTYLVSRAGVTSAENQAHAANLDTLVEQLKAHNAPPILQGFGIAQPEQVKEALSLGAAGAISGSATVKIIERNLDNHEQCLTELAEFVQTMKAATK

SEQ ID NO: 24674 - protein, 474 aa, Haemophilus influenzae R2866
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRVLGGAIVGSNGGELLGEIGLAIEMGCDAEDIALTIHAHPTLHESVGLAAEVFEGSITDLPNAKAKKK

SEQ ID NO: 24675 - protein, 188 aa, Haemophilus influenzae R2866
MAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDANGKTVNRWATTGIMTASAMSNEAALLTQKWIRMLGMVPVCNQANT

SEQ ID NO: 24676 - protein, 316 aa, Pisum sativum
MWPFSSKKGVSGFSGSSTAEQVTHGIDATGLTAIVTGASSGIGAETTRVLALRGAHVIMGVRNMVAAKDVKDTILKDIPSAKVDAIELDLSSLDSVKKFASEFNSSGRPLNILINNAGIMACPFKLSKDNIELQFATNHIGHFLLTNLLLDTMKKTTRESKKEGRIVNVASEAHRFAYPEGIRFDKINDQSSYNNWRAYGQSKLANVLHANQLTKHLKEDGVNITANSLHPGTIVTNLFRHNSAVNGLINVIGKLVLKNVQQGAATTCYVALHPQVKGVSGEYFSDSNVYKTTPHGKDVDLAKKLWDFSINLVKQK

SEQ ID NO: 24677 - protein, 189 aa, Oryza sativa (japonica cultivar-group)
NSIGLESRVKLETRLRVLEGKELGRSAGSTKGKPKIEVYEKDRKKGAGALITPAKTYNPAADLVLGQSTEETPKKPEGASKKRKHQETEPAPAEKTTKEDGDQEGEKKKKKKKSKESEESPAADADGGKKKKKTSKESEEPPVATTEGEKKEKKKKKKSDSQDAEDVAMETEESGKKEKKKKKKHHSDE

SEQ ID NO: 24678 - protein, 280 aa, Hordeum lechleri
GTRAPVPVPVAAGDRGLSVSQAMSKVMEKGKTAFIPYITAGDPDLATTAAALRLLDALGADVVELGMPFSDASADGAVIKASAARALAAGATVDAIMAMLKEVTPELSCPVVIFSYFSPIAQRGTASFAAAVKEAGVKGLIVPDLPYAETSAFRDEAIKNELELVLLTTPSTPPERMKEITEASGGFVYLVSVDGVRGARATVNPRVESLLKKIKQVTDKAVAVGFGISTPDHVKQIAEWGADGVIIGSAMVKQLGEAASPEEGLKRLEVYARSLKDALP

SEQ ID NO: 24679 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 24680 - protein, 131 aa, Clostridium difficile
EVKYKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 24681 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 24682 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCRVQVEKALENVLK

SEQ ID NO: 24683 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLE

SEQ ID NO: 24684 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 24685 - protein, 216 aa, Bacillus cereus ATCC 10987
MNLILMGLPGAGKGTQAEQIVAKYNIPHISTGDMFRAAMKAETEMGLQAKSFIDKGALVPDEVTIGIVRERLSQEDCVRGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYEELGYLQSINGEQDINKVFADIDVLIGGLA

SEQ ID NO: 24686 - protein, 297 aa, Bacillus cereus ATCC 10987
MKKEISVIGVPMDLGQMRRGVDMGPSAIRYAGVIERIEEIGYDVKDMGDICIEREKEVDVNTSLRNLTQVATVCNELASKVDHIIEEGRFPLVLGGDHSIAIGTLAGVAKHYKNLGVIWYDAHGDLNTEETSPSGNIHGMSLAASLGYGHPALVDLYGAYPKVKKENVVIIGARALDEGEKDFIRNEGIKVFSMHEIDRMGMTAVMEETIAYLSHTDGVHLSLDLDGLDPHDAPGVGTPVIGGLSYRESHLAMEMLAEADIVTSAEFVEVNTILDERNRTATTAVALMGSLFGEKLK

SEQ ID NO: 24687 - protein, 441 aa, Bacillus cereus ATCC 10987
MKRYFQFDELGTNYKTEFIAGLTTFLSMAYVLFVNPATLSLGNVKGLPAGTGMDPGAVFVATALAAAIGSLIMGIFAKYPIALAPGMGINAFFAYTAVLTMGIPWQTAIAGTLMSGIIFIILTASGIREKIINAIPSELKFAVAAGIGLFIAFLGFQNAGIIVKNDAVLVGLGDLTKGTTLLAIFGVVTTIIFMIKKVNGAVFYGMILTAILGVATGLIDTPKAVVGAIPSLEPTFGAALTHFGDIFTVQMGIVIITFFFIDFFDTAGTLVAVANQAGLMKNNKLPRAGKALFADAIATVIGAILGTSTTTSYIESSAGVAAGGRSGFTAVVTAGFFLLALFFSPLLSVVTPAVTAPALIIVGILMVSSLGEIDWKKFEIAVPAFFTIISMPLTYSIATGIAIGFIFYPITMVVSGRRKEVHPIMYVMGVLFVLYFIYVRK

SEQ ID NO: 24688 - protein, 511 aa, Bacillus cereus ATCC 10987
MKKRALVSVSDKTGVVEFVKGLLEQGIEVISTGGTKKLLEENGLQVIGISEVTGFPEIMDGRVKTLHPNIHGGLLAVRDNETHVAQMNELGIEPIDFVIVNLYPFKETIAKPDVTFADAIENIDIGGPTMIRSAAKNHKFVSVIVDPVDYDVVLAELEENGEVKEETKRKLAAKVFRHTAAYDALISNYLTEQMGEESPETLTVTFEKKQDLRYGENPHQKATFYKAPFAATSSVAYAEQLHGKELSYNNINDADAALSIVKEFTEPAVVAVKHMNPCGVGVGTDIHEAYTRAYEADPVSIFGGIIAANREIDKSTAEKLHEIFLEIIIAPSFSKEALEVLQNKKNLRLLTVNIEKSTSASKKLTSVQGGLLVQEEDTLSLDESTISIPTKREPSEQEWKDLKLAWKVVKHVKSNAIVLAKDDMTIGVGAGQMNRVGSAKIAITQAGEKAQGSALASDAFFPMPDTLEEAAKAGITAIIQPGGSIRDEDSIKVADTYGIAMVFTGVRHFKH

SEQ ID NO: 24689 - protein, 339 aa, Bacillus cereus ATCC 10987
MISFNNVSKVYETGGQSVHAVEDVTLSVEKGEIFGIIGFSGAGKSTLLRLVNMLERPTAGTISIDDKEITSLSTKELRKLRQRIGMIFQSFNLFNSRTVFGNIAYPLKLAKVPKNEIKERVNELLKFVGLEDKANNYPEQLSGGQKQRVGIARALATSPDILICDEATSALDPETTTEILNLLKKVNREYNLTILLITHEMHVVKEICHRVAVMEKGKVIEEGKLFDVFTQPKTKTTQNFVRSVINDHLPESVLAKIQNGGQIYRLTFTGEETGQPVLSYIAKNYNVDVNVLYGNIIELQNVLFGNLLVELQGEQREIQKALQHLRLQVQLKEVEAHAS

SEQ ID NO: 24690 - protein, 468 aa, Bacillus cereus ATCC 10987
MKRENNVKKRMGYVMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDNFMIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVINRFEEMKNKYNCIGDVRGLGAMCAFELVQDRKTKAPDKTLTANLCAEANKRGLLLLSAGTYGNVIRVLMPLVITDEQLEEGLTIIEESLQVCYEKANIARV

SEQ ID NO: 24691 - protein, 483 aa, Bacillus cereus ATCC 10987
MDKKATFVNVEKKAMYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKVVEAVIGSKFRNAGQTCICTNRVFVQEEVYEVFAEKFQKSVGQLKVGDGFGDGTTVGPLIDENAVSKVQEHIADAIQKGGTVLYGGQKVAELDGHFMQPTVIGLANDTMLCMNEETFGPVAPVAKFKTVEEVIERANNTPYGLAAYIFTKDISQAFQISEALEYGIIGLNDGLPSVAQAPFGGFKESGIGREGGHFGIEEYLEIKYISLGL

SEQ ID NO: 24692 - protein, 433 aa, Bacillus cereus ATCC 10987
MQPSAPPHLESTETIFSSSITKLVVFICWLAILADGYDLGIYGAVLPKLLEDKSWALSPAHAGTIASYALFGMFIGAILVGTITDLIGRKWTLICCLALFSITMGLAALAPSPELFGLSRFIGGIGLGGVIPTASALTVEYSPKKRQSFIYALMFTGYPLGIVLGAILSMFMLEGFGWRTMFGIGMIPLLLIPFIIRYLPESIQFLLSRNRQKEVDQILNRFEIEFYVKDETHQPSSNMRKRNGFLTLFSKEYRKATLLFWITYIMGMFLIYGLNTWLPQMMRQAGYPLGSSLSFLLMLNITAAIGALFAGAIADRIGAKIVISISYLMAAICIGLLTIKPSVTIIYLLIGLAGIGSVGITQILNAYVTQYFPSHIRATSLGWGLGLGRVGAITGPILVGIIMTMQYDLAWNFYLFSFAGLLAAISVFFIPTK

SEQ ID NO: 24693 - protein, 240 aa, Bacillus cereus ATCC 10987
MIQVRNLVKSFGSLDVLKGIDLEVQEKEVVVLIGASGSGKSTLLRCLNFLEMYDEGEIHLQGERIDPKHSNLNKVRENVGMVFQHFNLFPHMTSLENIIEAPIHVKKLEAANAKEIGNQLLQKVGLQDKADVTPHLLSGGQKQRIAIARALAMNPKIMLFDEPTSALDPELVGEVLQVMKELAEEGMTMVIVTHEMNFARDVADRVIFMDDGKIVEDAPPAQFFSAPSHERAKQFLRNVL

SEQ ID NO: 24694 - protein, 284 aa, Bacillus cereus ATCC 10987
MTKIFILASTLSLSFFSGLNIGNAATENFSPVTNAIVQNNDHFAEGNSKDNNKPPGNDGSQDDSDSGGNGSDGSGSGDNGSGGNGSGGNGSGDNGSGGNGSGGNGSGGNGSGGNGSGGNGSGGNGSGGNGSSGNGSDGSGSGGNGSGGNDSGGNGSGGNGSGGSGSDGNGSGGSDSGGSGSSGNGSGGSGSDGNGSGGSGSGGNRGKGDSSSQGGNDSHGGNRGKGDSSSQGGNGSQGGNVKDNAKKQGDKLPNTATHYPASILMGLSTFLIGMLLFIRRKNAK

SEQ ID NO: 24695 - protein, 473 aa, Bacillus cereus ATCC 10987
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 24696 - protein, 434 aa, Bacillus cereus ATCC 10987
MVVKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKTGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAEKHNIDITLNRLKGALTVYFTTNTIEDYDAAQDTDGEMFGKFFKLMLQEGINLAPSKYEAWFLTTEHTKEDIEYTIEAVGRAFAALANNK

SEQ ID NO: 24697 - protein, 255 aa, Bacillus cereus ATCC 10987
MTAPLLQLQNIYKSYDDNPVLRDVSLQVSSGEVIVILGPSGCGKSTLLRCLNGLEDIQSGKMLFHNAPLPKNDGNWQKLRQKIGMVFQSYHLFPHMTVLENILLGPLKVQKRNKNEALKQAEQLLRKVGLLEKKDAYPRELSGGQQQRIAIVRTLCMNPEVILFDEVTAALDPEMVKEVLEVIMSLAKQGMTMLIVTHEMGFAKAVADRIIFMDEGEICETGDPTTFFTSPQTERAQHFLNQFFYIETVKGRDII

SEQ ID NO: 24698 - protein, 487 aa, Bacillus cereus ATCC 10987
MTYYKDDSYALHTDLYQINMAYTYWKDGIHNRRSVFDLYFRKLPFENGYAVFAGLEKIVEYIENFSFTESDIAYLAELQFEEEFLQYLQNMKFTGTIRSMQEGEVVFNNEPLLRVDAPLGEAQIIETALLNIVNYQTLIATKAARMKHAANNDELLEFGTRRAHEFDAALWGTRAAFIGGFSSTSNVRAGKRFGIPVAGTHAHSFVQAYRDEYVAFKKYAETHKKCVFLVDTYDTLKSGVPNAIRVAKEFGDRIDFYGIRLDSGDMAYLSKKARKLLDEAGFTNTKIIASSDLDEYTIMHLKSQGAKIDVWGVGTKLITSFEQPALGAVYKLVAIEDTDGKLNDTIKISSNPEKITTPGLKRIYRIINRVNDHAEGDYIALDCEEPGKEERLKMFHPVHTYISKFVTNFEARELHKDIFVNGERTYELPGILDIQKYNEQSLALFWEEYMRTLNPEEYPVDLSQECWDHKMNYIQTVREQVEKNIQK

SEQ ID NO: 24699 - protein, 298 aa, Bacillus cereus ATCC 10987
MEKIRKKKYRNGIEMKKQRGNSFAFFMDKMRLEVIFLPIFEYKKNVHALLGEGVSMLIEFRNVNKYYGTFQVLKDINVQVKKGEVVVVVGPSGSGKSTLLRCINQLESITDGELIVQNTEVHNAKTDMNELRRNIGMVFQHFYLYPHKTVLQNITLAPIKVNKISKEEAEQTAMFYLEKVGIPEKANVYPHQLSGGQQQRVAIARGLAMQPEIMLFDEPTSALDPEMIGEVLDVMKTLAKEGMTMVVVTHEMGFAREVADRILFMDDGKIIEDTTPAQFFASPEQERARLFLSRVLNH

SEQ ID NO: 24700 - protein, 473 aa, Bacillus cereus ATCC 10987
MQQQTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNADVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESEEPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYKTPLYPIVPILALITNSIVVISLAFIPEQRMALYCGIPFIIFCYIYYYINKKRQKPMKVETTNETNHQTR

SEQ ID NO: 24701 - protein, 449 aa, Bacillus cereus ATCC 10987
MFFTQFFKPAPHVERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIVFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMRDTPQSCGLPSIEEHTGEYPPDEKVQDRERELSVKEILFTYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSPKQKQA

SEQ ID NO: 24702 - protein, 437 aa, Bacillus cereus ATCC 10987
MLSIKGQKWRNWTGNVEGTPHYTMYPESIQDVVEVVELARKEGKKIRVVGSGHSFTPLVQTEEILVSLDELKGIVNVDAEKMVAEVWAGTKLHELGKLLEEKGYAQENLGDIDSQSIAGAISTGTHGTGITFGSLSTQVIEITAVLSTGESIVCSQTENVQYWRAFQLSLGMLGIIVKIKLKVIPAYSLVYKSEKQSLSTVMNKLEEYKKNRHFEFFVFPYSDEVQVKITNETTGKKSDLKWHKLKVELLENKMFSLLSKGCKWFPSISKGVSRLSAKAVPNTKIIGPSYEVFATSRAVPFYEMEYSVPSKYMQVVVEEISNLIEKKKYKVHFPIECRYVKRDDIWLSPAYGRDSAYIAVHMYKGMKYAAYFGEVEKIFLKYEGRPHWGKMHTLTYEKLQNIYPELHSFLKVRKLLDEAEMFSNPYTEKLFTIMKKS

SEQ ID NO: 24703 - protein, 463 aa, Bacillus cereus ATCC 10987
  misc_feature (244)..(244): Xaa can be any naturally occurring amino acid
  misc_feature (260)..(260): Xaa can be any naturally occurring amino acid
  misc_feature (276)..(276): Xaa can be any naturally occurring amino acid
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFXRILLFYVGALFVMMAXYPWNELGEKGSPFVLXFQQIGIAKAAGIINFVVLTAALSSCNGGLFSTGRMLYTLAQQKKAPERFGRLNKNGIPSQGIVATAIVLLVGVILNYLVPAKVFTWLTSISTFGAIWTWGIILVAQIKFRKSLPTQNKQKLSYKMPLYPLSSYFSLAFLALVLCIMAYSEDTRIALIVGPIWLIGLAVVYYMKGFHKIDETPNSKIS

SEQ ID NO: 24704 - protein, 430 aa, Bacillus cereus ATCC 10987
MFQLQKYNTSVKQELLAGITTFFTFAYILVINPKILSDAGVPFDQAFTATIIATVVGTLCMAFLANYPIVIAPAMGMNAYFAYSVVQQAEGITYVIAFSAVFVTGIIFLLLSFTSFRQKLIVAIPDSLKHAIAGGIGLFIAFIGLRLSGIIVDHPSNLVTIGDFHSPAVILTLIGLILAAVLMTLRVSGALFISMIVTGIIAFFTGQLKFTDKIVAMPHLPEGIIVSNPINAFSDVIEYGLYGVVFSFLLVLLFDTTGALLGLIKQAGLITDNTEKRFGKAFIADAIGGTTGSIFGTSPTAATIESSAGIAAGGKTGLTGIVVVGLTIITAFFSPVIASLSSVAAITAPSLIIVGSLMAQSIRDINWNEFEDALPAFLIFVGIPLTSSIANGIAIGFLVYPVLKIVKGKGMEVHPLLYLFTILFGCHLFL

SEQ ID NO: 24705 - protein, 471 aa, Bacillus cereus ATCC 10987
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 24706 - protein, 433 aa, Bacillus cereus ATCC 10987
MFNLSKHKTSIKTEIMAGIITFLTMAYIIVVNPVILGDAGVPFEQAFTATIIAAVVGTLFMAIFTNLPIAIAPGMGLNAYFSYSVVKAHEGMTFAIAFSAVFVAGMILILLSFTSFRTKLMEAIPENLKHAITAGIGLFIAFIGLRLTGIVTKNEANLVGLGDLHSAPVLLALAGLGITIVLMSLNVNGALFIGMLLTGIIAFFTGQLSFSNGVTSMPGLPEGIIVSNPITAVSDVINYGLYGVVFSFFLVTLFDTTGTLLGVAQQGGFMKDGKLPKAGRALLSDSFSATIGSMFGTTPSTAYIESSAGVAAGGRTGLTTVTVAVLFALAAFFGPLVSAVSGVSAITAPSLIIVGSLMMGSVRHIDWDAFDEAFPAFLVILSMPLTSSIATGIALGFISYPLMKVAKGKFRAVHPLVYVFGILFAYQLIFLPH

SEQ ID NO: 24707 - protein, 479 aa, Bacillus cereus ATCC 10987
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKAAMIPLVLELGGKDPGIVREDADLQDAANHIVSGAFSYSGQRCTAIKRVLVHENVADELVGLLQEQVAKLSVGSPEQDSTIVPLIDDKSADFVQGLVDDAVEKGATIVIGNKRERNLIYPTLIDHVTEDMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 24708 - protein, 244 aa, Bacillus cereus ATCC 10987
MISIQHLQKSFGDNTVLKHIDLTVEKGEVVVIIGPSGSGKTTFLRCLNVLETPNAGHIRIGNKELDFSQKVTKKDIVNLRTQTGMVFQHHNLFPHLTALQNVMEGLVTVKKMGKEEAKKKANYFLEKVGLADKVDLYPFQLSGGQQQRVGIARALAMEPEVLLFDEPTSALDPELVQEVLKVMKELAKEGMTMVIVTHEMRFAHQIANRVIFMDGGVVVEQGTPEDVFTNPKEERTKKFLQMLQ

SEQ ID NO: 24709 - protein, 510 aa, Bacillus cereus ATCC 10987
MNLVQSLAETAKKKGDKPAYIFMDQSVSYDQLNKMVTRFSSNLAEMGIGKGDNVALVVGNSPHFLVGLYGTMKAGATVIPVNPIYTADEMHYILQNGDVKTIIVLDVLLPVIQSLTTRLPSLENIIICETSSDFNHTETEKMKTFTRMIGAGDLTYEGPELDEEDVAVILYTSGTTGKPKGAMLTHKNLYSNASDVASYLQYTADDRVVAALPMFHVFCLTVAVNAPIVNGATILMLPKFSPKEVFRICRTYEPTIFAGVPTMYNYLYLFEEASAEDVKTLRLCISGGASMPVALLQNFEKRFDVIVSEGYGLSEASPVTCFNPLDRPRKPGSIGTNIWHVENKIVNELGEEVPVGAVGELIVRGPNVMKGYYNAPEDTAATLKDGWLYTGDLAKMDEEGYFYIVDRKKDIVLVGGYNVYPREVEEVLYTHESVAEVVVIGVPDENLGEAVRAYVVLKQTNVTEEELMHYCALHLAKYKVPKSIEFLTELPKNTTGKLLRRALREKAMQV

SEQ ID NO: 24710 - protein, 433 aa, Bacillus cereus ATCC 10987
MRVGKIHTRKLFICFCLAVVLFVPIHTFADEKREWRDEVIYSIMIDRFNNGEPKNDKQLEVGNLEGYQGGDIRGIIKRLDYIKEMGFTTVMLSPLFESVKYDGLDVRNFQKVNEHFGTENDVKELVQEAHAKGMKVVFQFPLGENEQQVIDSMKWWIKEVDLDASYVIHSEKKSPAFWDDVQKDMQVIKKDFRVMTKEDSEYNEKIVDAFSKADVSVKPLYDVSKKDGAAATFLDNQDTKRFARIAKENMNYPPSRLKLALTYLLTTPGIPNFYYGTEIALDGGGTPDNRRLMDFKSDEKFMQHITKLGELRQARPSLRRGTFELLYDKDGMSVLKRRYKDEVTLVAINNTKETQKVALPASTIGEKQELRGLLEDEIIREENGKFYLVLKREESNVYKVNRETGVNWLFISLIVGVNVLFIAFLIAVKKRRK

SEQ ID NO: 24711 - protein, 258 aa, Bacillus cereus ATCC 10987
MGVEKIKAAFENGKKAFIPYVMGGDGGLEKLKERIRFLDEAGASIVEIGIPFSDPVADGPTIQRAGKRALDSGVTVKGIFQALIEVRKEVQIPFVLMTYLNPVLAFGKEQFIENCIEAGVDGIIVPDLPYEEQDIIAPLLRTANIALIPLVTVTSPIERIEKITSESEGFVYAVTVAGVTGVRQNFKEEIHSYLEKVKSHTHLPVVAGFGISTKEHVEEMITICDGVVVGSKVIELLENEKREEICELIQATKQKEEA

SEQ ID NO: 24712 - protein, 444 aa, Bacillus cereus ATCC 10987
MNYVIIGGDAAGMSAAMQIVRNDENANVVTLEKGEIYSYAQCGLPYVISGAIASTEKLIARNVKTFRDKYGIDAKVRHEVTKVDTEKKIVYAEHTKTKDVFEFSYDRLLIATGVRPVMPEWEGRDLQGVHLLKTIPDAECILKTLETNKVEDVTIIGGGAIGLEMAETFVELGKKVRMIERNDHIGTIYDGDMAEYIHKEADKHHIEILTNENVKAFKGNERVEAVETDKGTYKADLVLVSVGVKPNTDFLEGTNIRTNHKGAIEVNAYMQTNVQDVYAAGDCATHYHVIKEIHDHIPIGTTANKQGRLAGLNMLDKRRAFKGTLGTGIIKFMDLTLARTGLNEKEAKGLHIPYKTVKVDSTNMAGYYPNAKPLYLKLLYRSDTKQLLGGQVIGEEGVDKRIDVIAMALFNKMSIHDLEDVDLSYAPPYNSVWDPIQQAARRAE

SEQ ID NO: 24713 - protein, 455 aa, Bacillus cereus ATCC 10987
MSISSIVNKQKAYFYNGYTRSVEVRKNNLKKLYEGVQRFEQEIFQALKLDLNKSVHESFTTEVGYVLKEISFQLKHISSWSKPKRVRTALTHFGSKGKVVPEPYGVTLIIAPWNYPFQLAIAPLVGALAAGNTIVLKPSELTPNVSKVITRMLEELFQEELVAVVEGGVEESTALLKEPFDYIFFTGSVGVGKVVMEAAAKQLTPLTLELGGKSPCIVHKDAKIDVTARRIVWGKFLNAGQTCVAPDYMYVHASVKEQLIEALRHEIEEQYGKEPLHNDNYVRIVSERHFERLCTFLKDGKTVIGGNYKKETLHIEPTVLTNVTWESAVMEDEIFGPILPIIEYDNIEDVIDTIQQHPKPLALYVFSEDKGVQKKVTSNISYGGGCINDVVYHLATPYLPFGGVGSSGLGSYHGEESFRTFSHYKSILAQSTAFDMKIRYSSTKSALKFIRKLLK

SEQ ID NO: 24714 - protein, 323 aa, Bacillus cereus ATCC 10987
MAKILVAGKIPAIGLELLKDHDVEMYDKEELISLDELTERVKDKDALLSLLSTKVTKEVIDAAPNLKIVANYGAGYDNIDYSYAGEKGIAVTNTPKVSTEATAELTFALLLAAARRIPEGDTLCRTTGFNGWAPLFFLGREVHGKTIGIIGLGEIGKAVAKRAKAFGMNVLYTGPNRKPEAESELEATYVTLEELLQTADFITINCAYNPKLHHMIDEEQFKMMKKTAYIINASRGPIMHEAALAHALKTNEIEGAALDVFEFEPKITEELKGLKNVVLAPHVGNATFETRDAMAETAVRNILAVLNGEEPVTPVNQKVFVTK

SEQ ID NO: 24715 - protein, 266 aa, Bacillus cereus ATCC 10987
MKEIKVIIAGPRGRMGHEAVLLMERTEHFNLVAAVDYKHGGEKISDLPGMPALDTPIYADLHTCLEEVEADVLLDLTTPEVGKQHVTLAVERGLRSVIGTTGFTEEELKQLTETAKEKAVGTIIAPNFAIGAVLMMKFSQMAAKYFQDVEVIELHHDQKLDAPSGTAVKTVELIRQNRESKQQGHPNEVEQLKGARGANVDGIHIHSVRLPGLIAHQEVMFGGDGQMLTVRHDSFNRASFMSGVKLSIETVMNLDHLVYGLENIID

SEQ ID NO: 24716 - protein, 449 aa, Bacillus cereus ATCC 10987
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVVGTLKTAMERI

SEQ ID NO: 24717 - protein, 451 aa, Bacillus cereus ATCC 10987
MEATEKLREKPIKSLFISYLIPAVLGMVLMSVNIVIDAVMISRGVGANGLAGVNVAIPAFSIFFSISLWIGMGGATLYSIALGENKIERARSIFTQSMTVAVIIVGVLAAICLWRIEDLAYVFGANEVILPYALDYLHVLLTFGMIYVLENILSTFIRNDGNPNLAMAGLVVTAVLNIVFDYIFIFIFKWGVTGAASATILSAAIGFLVLLTHFFRKSSILKWTKFHFEWDTVKQIMIIGFPSFTAESTVAIVTIGFNIAFVQYAGEVGVASYAMVNSIHAMTLLLFFGVGAALQPIASFHYGANLAERLREGLQFAVKIAVVLGGVAIIVGLFFGKYIIGLFDVQSPELLELTLTGMSLFFIQYVFLGYNIVYGEYFQSVRQTTKSVLIIMSRGLLFIIPLLWIMPKLFGINGIWLVMPVAEVLTAIIVFTMNRMKHPVPLNMAGEKEAI

SEQ ID NO: 24718 - protein, 330 aa, Bacillus cereus ATCC 10987
MDIKISGLEKSFGKVQALKPLQIVMKQGEFTTLLGPSGCGKTTLLRMIAGLEEPDKGEIYFGDTCMYSSSKKIKTAPHERNIGMVFQDFALWPHMTVFENVAFGLRATKQTNQLREKVEEAIKRVRLQGMEKRYPHELSGGQQQRVAFARAIVTKPHFILFDEPLSALDAILREEMRLELMDIVHSIGLTALYVTHDQTEAMSMSDQIIVMKQGEVLQKGTPEDIYVKPSHEFVAKFVGKANWLVEGEKMVRPEHISWTKNEVCEMYTGEVQHVTYVGERYEVKVNMGAIGIWTAYHNNKLSIGKPVSLYVPKKCIHHIGGESYEEIQFA

SEQ ID NO: 24719 - protein, 469 aa, Bacillus cereus ATCC 10987
MKPPTDNNKEGAESHKLESESKPIWKSMSMFLVPLLLSNVLQSVGQLFGMVVVGRWLGVNDLAAISAFFPLFFLLVSFVIGIGSGSSILIGQAFGAKNEDRLKAIVGTTLTFTFIIGVVLAIVGSIFAMDIMRLMGTPENIIEISVHYARILFISMPILFLYFAYTTFMRGTGDSKTPFYFLIVSTALNMILLPILIFGWLGAPKLDVYGAAYASVISTVITFIVMLVYLKKKNHPLQLDSTVRKYLRMDWGLLKLLLRLGIPASINMILVSLSEIAVIAFVNRYGSDATAAYGVVNQVASYVQMPAVSLGITVSIFAAQSIGANQFDRLQKVVKAGIIMNYVIGGVLISLIYLFSRDILALFLTSQTTIEIAHSLVMITLWSYLIFGHAQIISATMRASGTVLWPTVIGVVSIWLVEVPVAYYLSYHTSLGIEGIWIGYPAAFIVSLILQYAYYKLSWQKKRITRLVS

SEQ ID NO: 24720 - protein, 305 aa, Bacillus cereus ATCC 10987
MKLCENVTELIGDTPVVRLSKFIPEDAADVYVKLEMFNPSRSVKDRAAYNLLHVAEENGHIKPGDTIIEPTSGNTGIGLAMNAAAKGYKTILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 24721 - protein, 311 aa, Bacillus cereus ATCC 10987
MKYTKLQKAGLHISKLGLGTNAVGGHNLYADVNEEEGKRLIEEAIGQGITFFDSADSYGFGRSEELVGEVLKGKRHEVVLATKGGIQPLLNGEVYMNNEPSYLRNAVENSLRRLQTDYIDLYYLHFTNPETSYIDSIGELTRLKEEGKIRSIGISNVNVEQLKEANQHGHIDVVQSPYNMLDRTAREELLPYCIESGISFIPYGPLAFGILGGKYTEDFKLNKGDWRQSVNLFEENTYKSNFKKVEKLKDLAKEKDLELSHLALAWLLNQKGIDTVIPGGKRAEQIRESVRAVEVSLNEKVMKEIESILED

SEQ ID NO: 24722 - protein, 300 aa, Bacillus cereus ATCC 10987
MERVQMAETLEFSRIIQGFWRLAEWNMTKQELLSFIEDCMDMGITTFDHADIYGGYTCEGLFGEALQLKPSLRENMQIITKSGIAPPSPKFPERYVAHYNTSAEHIIQSAEASLKNLHTDYIDVLLIHRPDPFMDPNEVAEAFSRLRQEGKVRHFGVSNFLPSQFNMLSSYLDFPLITNQIEVSALQLEHFEKGTLDLCQEKRINPMIWSPLAGGEIFTGQSERAVRVRETVQKVATELGVSSIDTVMYAWLLAHPAKMLPIIGSGKLDRVKTAALATKVNLDRQQWFTIFESSNGHPVP

SEQ ID NO: 24723 - protein, 345 aa, Bacillus cereus ATCC 10987
MNYKLFSPYTIKDVTLKNRIVMSPMCMYSSENGDGQVTNFHLIHYGTRAAGQVGLVMIEATAVLPEGRISNKDLGIWDDSLIEGLHKTTTFIHDNGAKAAIQLAHAGRKAELETDALAPSAIPFNETMKMPIEMSKHQIKDTVLAFQQAAVRSKQAGFDVIEIHGAHGYLINEFLSPLTNKRTDEYGGSPENRYRFLREIIDSINEVWNGPLFVRISANDYHPDGLTVQDYVQYTKWMKEQGVDLIDCSSGAVVPARIDVYPGYQVQYAKHIKEHANIATGAVGLITTGAQAEQILNNNEADLIFIGRELLRNPYFPRIAANELGFELEEPYQYERAPGKISTNK

SEQ ID NO: 24724 - protein, 489 aa, Bacillus cereus ATCC 10987
MNKELLADKLKVKDAKLFIDGKYVDSVCGETFDTFNPATNRKLASIAKANEEDTKRAIDVAERTFKSGIWSKMPVEERSNILCKMSDLIMERVDELAYIETLDVGKPIKESKGFDIPRSAHNFRFFAEMAKYIVHEHYDKHNFMSYAKYAPAGVTSLIIPWNLPFMQMTWKASAALASGNTVVVKPASYTPLSAVMLGEIANDAGLPPGVLNIITGPGSTVGTKMTTHPAVRRISFVGESNTGKTIMRNASENLIPVSLELGGKSANIVFEDADLDEAVQGSIEAIYRNQGEICLAGSRLLVQESVYEQFLEKFVAAVKRIKVGDPLSEDTDMGALVSKSHLETVDRYVELGISEGAKLAYGGKRVESLVEGNFYEPTILYDVDNSMRVAQEEIFGPVLVVIPFKTEEDAIRIANDSIYGLAGVVWTNDLRRAQRVVSQIDSGLLWINCWYVRDLRTPFGGSKASGIGREGGRHSFEFYTEAKTVTMKL

SEQ ID NO: 24725 - protein, 161 aa, Bacillus cereus ATCC 10987
MTVYDFSAKTITGEEKSLKDYEGKALLIVNVASKCGFTPQYKGLQEVYDKYKEQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGNN

SEQ ID NO: 24726 - protein, 468 aa, Bacillus cereus ATCC 10987
MKQKRNSLYIFSITLVAAIGGLLFGYDTAVISGAEESLKVYFIDSLGLGSLAHGVTVSSALIGCIIGGVISGYCASKFGRKRSLIIAAILFIVSALGASYPEFLFFTKGEPTIVLLLAFNLYRIIGGIGVGLASAICPIYIGEIAPADIRGRLVSFNQFMIIFGMLVVYFVNWGIANGETLEWINDVGWRYMFASGVIPAIIFAILLLFVPETPRYLAIQHQDKKALAILTKINGPLEAKAILDDIKQTMAINVSSEKLFSYGKLVIIVGVLLSVFQQFVGINVALYYAPRIFESMGAAKDSSMMQTIIMGLVNVIFTVIAILTVDRWGRKPLLIVGSIGMAIGMFGVASMAFANIIGIGTLIFIIVYTASFMMSWGPICWVLISEIFPNKIRGQAVAIAVAAQWAANYFISSTYPMMMEYSGGLTYSFYGLMSVLSALFVWKLVPETKGKTLEQMENTWKKQTEYIS

SEQ ID NO: 24727 - protein, 347 aa, Bacillus cereus ATCC 10987
MKAVVVNKNSKANIEIIEKELRPLHSGEALVDVEYCGVCHTDLHVANHDFGNTDGRILGHEGIGIVTKIADDVTSLKVGDRVSIAWMFQSCGRCEYCITGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIVQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQHVFEEMEQGRIQGRMVIDFKHNNCDCNSL

SEQ ID NO: 24728 - protein, 298 aa, Bacillus cereus ATCC 10987
MKLGLIGLGKMGFPLAEHLYEDKHEVVVYDVNKELVEKAGALGITARHTLKEMIAELEAPRTIWVMVPAGEVVESVLKDVYPLLEEGDIVIEGGNSFYKDTLRRAEEAKSFGLHYVDIGTSGGVEGARYGACLMVGGEKEIYDQLEPLFKDLAVENGYSYAGRVGSGHFLKMVHNGIEYGMMQAIAEGFEVLDKSDFDFNYEDVAKVWANGSVIRGWLMDLTEKAFAEDPKLDGIKGVMNSSGEGKWTVETALELQAAAPVIAMSLFMRYRSQEDDTFHGKVVSALRNQFGGHEVVKK

SEQ ID NO: 24729 - protein, 474 aa, Bacillus cereus ATCC 10987
MKKHLYINGDWKSVNTYKPLYAPYSEETLAEIAQGTEEDVKEAVIAAKNAMKEMNRLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPKGALNIISGPGSTVGEAIVTNDDVASITFTGSPKVGLGIKAKAGLKRVTLELGSNAAVIIDEDVELTDELIERVKWGAFVNNGQVCISVQRVFVHEERMDEFLSKLQKAMETVVVGDPLLEETDVSALISKKDVERIDNWVQEAVKEGASVLYGGNKRDERIFKPTVLTNVPEHVSVQCQEVFGPLMTVNTFKEFDEAIEQVNHSRYGLQAGVFTNNLFKVMRAIDELEVGGVMINDIPTFRVDHMPYGGVKESGTGREGIKYAIEEMTEMKLVCIKK

SEQ ID NO: 24730 - protein, 232 aa, Bacillus cereus ATCC 10987
MTTITNTFSKLKEIEEVISLFHDDMTLMFGGFGGIGSPPSLIQAILEKGVTNLNLIGNDTGFPDVGIGRLVTNERVKSLITSHIGSNPNAGRQLNEGRLQIEFSPQGTLAERIRAGGVGLGGILVDVGVDTIVEEGKRTVEMNGKTYLVETALTAEVAIVYAKKADPFGNLVFDKSARNMNPHVAMAGDITIVEAEEIVPLGSLDPEEIVVPGVFVNYIVPSEGVNWKWVWA

SEQ ID NO: 24731 - protein, 296 aa, Bacillus cereus ATCC 10987
MKKIGFIGLGNMGLPMSKNLVKSSYTVYGVDLNKNAEASFEKEGGIIGLSISKLAETCDVIFTSLPSPRAVEAVYFGEEGLFENSHSNVVLIDTSTVSPQLNKQLEEAAKEKKVDFLAAPVSGGVIGAENRTLTFMVGGSKEVYEKTESIMGVLGANIFHVSEQIDSGTTVKLINNLLIGFYTAGVSEALTLAKKNNMDLDKMFDILNVSYGQSRIYERNYKSFIAPENYEPGFTVNLLKKDLGFAVDLAKESELHLPVSEMLLNVYDEASQAGYGENDMAALYKKVSEQLISNQK

SEQ ID NO: 24732 - protein, 486 aa, Bacillus cereus ATCC 10987
MITTEIKRVKNHINGEWVESTGTEVEAVPNPATGKIIAYVPLSPKEDVEKAVEAAKAAYETWSKVPVPNRSRQLYKYLQLLQENKEELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFHEDNYVGPLIRESHKERVLGYINSGVADGATLLVDGRKIKEEVGDGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 24733 - protein, 398 aa, Bacillus cereus ATCC 10987
MELKSMIRILAIVAFFVGLDSLLVAPLLPVITETISIPDGSGGLLITIYALCYGITAPVLGTMSDRVGRKRMIIIGFTIFSISTFCTGLAKSFEILLLFRGLTGLSGAMIMPSVFALVVDKVTYESRGKAMGTIMGAMVGSTVIGVPIGAFLSEVGNWQWTFYSIGLLTLFLTLLVNRILRNEKQRNNVHVSIAKTLSAPLKMVLVNVSVLFALLATFLWTIGLHGMFSYIGVYYGNNFGLSVGEIGVVIFLAGVGSVAGNILGGKLADKIGKKNVISIASIVTSISVILFSLSIENLVIAITLHIIWSLFIGFGQASLTALISELKPDVRGTVMALNSSAMYIGMTIASGLASLTVSNGFPFSSLGIMCAIASLLVLPIIFVLVKGKALSNKKKMTI

SEQ ID NO: 24734 - protein, 245 aa, Bacillus cereus ATCC 10987
MIKLVLIRHGQSLWNLENRFTGWTDVDLSENGLSEAREAGAILKKNGYTFDVAYTSVLKRAIRTLWIVLHEMDLAWIPVHKCWKLNERHYGALQGLNKDETAKKYGEEQVHIWRRSIDVRPPALTEDDPRYEMNDPRYKALKKGELPLTECLVDTEKRVLAYWHSEIAPSLKSGEKVIISSHGNTIRSLVKYLDNLSSDGVVSLNIPTSIPLVYELDDNLRPIRHYYLSMDGEVPEGEIPKHISF

SEQ ID NO: 24735 - protein, 459 aa, Bacillus cereus ATCC 10987
MSKLVVIGGGPAGYVAAITAAQSGKEVTLIDEADLGGTCLNVGCMPTKSLLESAEVHDIVRKANHYGVMLNEGSISVDWKQMQARKSQVVTQLVQGIQYLMKKNKIKVIQGKAKFETDHRVRVTHGGKEIVVDGEQFIIAAGSEPTELPFATFDGKWILNSSHAMSLENIPKSLLIVGGGVIGCEFASIYSRLGTKVTIVEMAPQLLPGEDEDIAHILRGKLENDGVEIFTGAALKGLNNYKKQASFEYEGSTQVVNPEFVLVSVGRKPRVQQLDLEKAGIQYSNKGISVNEHMQTNASHIYAAGDVIGGIQLAHVAFHEGTTAALHASGEDVKVNYHAVPRCIYTAPEIASVGLSEKLAREQYGDILIGEFPFSANGKALIIGEQTGKVKVIVEPKYQEIVGISIIGPRATELIGQGTVMIHTEVTADIMRDYIAAHPTLSEAIHEALLQAVGHAVHA

SEQ ID NO: 24736 - protein, 494 aa, Bacillus cereus ATCC 10987
MLTKNIELKPKVKAFLNEEIKMFINGEFVPSISGKTFETYNPATEDVLAVVCEAQEEDINVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPKGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTNVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 24737 - protein, 399 aa, Bacillus cereus ATCC 10987
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKNNGFLPNLELIPEEIADKAKMMILNFPGNPVPAMAHADFFKEVIVFAKKHNIIVVHDFAYAEFYFDGNKPISFLSVPGAKEVGVEINSLSKSYSLAGSRIGYMIGNEEIVRALTQFKSNTDYGVFLPIQKAACAALKNGAAFCEKNRGIYQERRDTLIDGFKTFGWNVDKPAGSMFVWAEIPNGWTSIDFAYALMDRANVVVTPGHAFGPHGEGFVRIALVQDKEVLQQVIENIRNSGIFSLEKINELVKN

SEQ ID NO: 24738 - protein, 405 aa, Bacillus cereus ATCC 10987
MSDWFQLDKEYMMSTYCRTKLAIERGEGCKLYDVDGKEYLDLFSGVGVNVLGYNHPKIVQTTMDQVTKSLHLPFHFLNPVAIEYAKKLVDCSLKNGKVFFTNSGTEATETTLKLIDKYRAITHEEREGIVVLKNSFHGRTLGALHFTRQESVYQNFPKTSIPVYEVERENIEELEKTIIHENPIAIMLEPVLGSGGIYPLSGEYLHGVQNLCEKYNVLLIVDEVQSGMGRTGKLFAYQNFNITPHIIQIGKGAGGGIPLGGIIVGEKLCDVFAPGDHGTTFAHSSMGTALGLTVLNTLLDDGLMQEAYETSLYLNDKLQDIQKENSYYIQEVRHAGMMFGISVNDTNENVKKLQIELMNKGMLVDVTQGNIIRLLPPYIITKEEIDAFTYEFISCVHNIAATASI

SEQ ID NO: 24739 - protein, 488 aa, Bacillus cereus ATCC 10987
MNSATNQATSKTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPNTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLKDLPYKAKWFPFGPLFAFTLCIIVILGQNYGAFMGESIDWNGVLVSYIGLPLFLVLWLGYKFTKKTKVIPLDKCELK

SEQ ID NO: 24740 - protein, 1065 aa, Bacillus cereus ATCC 10987
MDKKVSAIPQPKTYGPLGNLPLIDKDKPTLSFIKIAEEYGPIFQIQTLSDTIIVISGHELVAEVCDETRFDKSIEGALAKVRAFAGDGLFTSETQEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGNQEENDLLSRMLHVQDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEDLDKVPHHAYKPFGNGQRACIGMQFALHEATLVMGMLLQHFEFIDYEDYQLDVKQTLTLKPGDFKIRIVPRNQNISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKESMWSDAMKAFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYHEQILKKRISMLDLLEKYEACEIRFERFLELLPALKPRYYSISSSPLIAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDERDGLISLHTAFSRLEGHPKTYVQHVIKEDRMNLISLLDNGAHLYICGDGSKMAPDVEDTLCQAYQEIHEVSEQEARNWLDRLQDEGRYGKDVWAGI

SEQ ID NO: 24741 - protein, 316 aa, Bacillus cereus ATCC 10987
MKNRVNPVLLPGLEMYPDQDLRPECLPTMREEASKVFPPTIIDETLSVTNEVIEGPDANPLRLKIYRPKSNNESLPALLWIHGGGYILGSINDNDDLAVKIAKEANCMVVSVDYRLAPEHPYPAPIEDCYAALKWIADNAETLNIDSNRIGVAGVSAGGGLTAALTLLARDRQYPSICFQMPLYPMIDDRNNTPSANEIKKGFVWNQKSNEAGWKMYLGKLHGTDHIPAYAAAARAEDYRNLPRTYTCVGQLDPFRSETLTYVTKLAEAGVDVEFHLYPGAYHGFEMMHPDADISVHAWNDYVRAVKTGFAKKELR

SEQ ID NO: 24742 - protein, 331 aa, Bacillus cereus ATCC 10987
MNLAKFPRKKYTESYTPIEKLNNFSEALGGPTIYFKRDDLLGLTAGGNKTRKLEFLVADAQVKGADTLITAGGIQSNHCRLTLAAAVKEKMKCILVLEEGLEPEEKPDFNGNYFLYHLLGAENVIVVRNGADLMEEMHKVAKEVSEKGSTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFKKEDNILFVHSGGSPALYANTSLFV

SEQ ID NO: 24743 - protein, 223 aa, Bacillus cereus ATCC 10987
MTSLLKLDKVSKVYGEGNTEVTALHPISLDVKAGEFIGIVGPSGSGKSTLLSIAGALLSPSKGDIYIREQNITQLSEKEMTDIRLKKIGFIFQFANLVPYLNVKEQLLYIAKLKKESKQESEKRADHLLAAFGLEERKNHYPNQLSGGEKQRVAIARAFMNNPDLILADEPTASLDSKRAREVVEMMKREVKESQKAAIMITHDERMLDVCDRILTLRDGKLI

SEQ ID NO: 24744 - protein, 159 aa, Bacillus cereus ATCC 10987
MWKTTDLCDEFEKELQICRQSFRSFGKKEQFHGKIATVKVKDDNVLVKEGLQTLPEGTVLVVDGGASTNCALLGDNLAAIAEERKLAGIIVNGYVRDSSELKNVNIGILALGTMPNRSVKEGKGERNISLQFGGVEWKPNDYVYADEDGVIISEKSLHR

SEQ ID NO: 24745 - protein, 352 aa, Bacillus cereus ATCC 10987
  misc_feature (224)..(224): Xaa can be any naturally occurring amino acid
MTIDRICTIGPASNNKETLAQLISNGMKIVRLNLSHGTHESHKDIIRLVKSLDDSIKILGDVQGPKIRLGEVKGEQITLQAGDSFILHTQPVTGSSTEASVDYEGIANDVKVGSRILMNDGEVELIVGKVGKDKIETKVKAGGNISSHKGVNLPGAIVRLPAITEKDKQDIQFLLEEGVDFIACSFVRKPSHIKEIRDFIQQYKETSPNLIAKIETMEAIKNFXDICKEADGIMIARGDLGVELPFQFVPLLQKMMIQECNRTNTYVITATQMLQSMVEHSIPTRAEVTDVFQAVLDGTNAVMLSAESASGEHPIESVKTLRLVSEFAEHVKKDGPFVMKDVLELLHKSLNA

SEQ ID NO: 24746 - protein, 297 aa, Bacillus cereus ATCC 10987
MQVGLIGLGKMGLNLGKNLMDHKHEVVAFDLNASAVEEMKEYGATGTSSLNELVQSLQSPRVLWVMVPHAVVDSVIDEVTPLLSKGDILIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 24747 - protein, 499 aa, Bacillus cereus ATCC 10987
MRTMQKLLQKRAMQSPNLEALVGGGKRYSFQQYNERVNQLAHYLLQSGVQRGDRIGILCKNNHPFPSVMMASLKIGAVCIPLNHQLTAYELETIVKEAKLKVLVIDEEFHEALKIDAVKEIPYVIQTTKEGFGSFELTLQEQPSTEPNVEVHEDDDAIYLFTSGTTGQAKACVIGHKNLHHYFAEIAGQREIPAGERFLSVHPLFHMSGVLSILNCIYHGVTMIFLADSNPTLIWDKIEEEKITTMLAFPAVYSYMLDELNKKERNISTFKVAQSGGTKVPETLIQKYMEKGIYMVQGYGSTEGWVVTSWHPMMGKEKMSSVGKTLKHVEVKIVHPETGHELTTNEVGEIHVRSPYMFKGYWNNEKATKKVVKDNWFNMGDAGMIDDDGFLHIMGRYKDVIIRGGDNVYPDQVEDVIHEIHGILEVAVVGVPDDFWGEVPTAYIVKDMQTSLTEEEIIQHCKEKLASYKIPEVVFMDKLPKNALGKVLKRELREGVLVK

SEQ ID NO: 24748 - protein, 472 aa, Bacillus cereus ATCC 10987
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAIGVVLSYIAPKNLFVYVYSASVLPGMVPWFVILISQINFRKEKGAEMKDHPFKMPFAPVTNYLTIAFLIMVLIGMWFNDDTRISLIVGIIFLAIVTISFYAFGIGKRTPLDVQNDQEISSK

SEQ ID NO: 24749 - protein, 332 aa, Bacillus cereus ATCC 10987
MKAMIIDKYGKVPMHMTEVPTPEINEYEVLAEIHAASINPIDFKIRDGKVKMLLKYEMPLILGNDFSGVITKVGSKVTRFKVGDEIYARPRKNKIGTFAEYIAIHEDDIALKPKNLSFEEAASIPLVGLTSYQALHDIMHLQKGQKILIHAGSGGVGTFAIQLAKIMGATVTTTASEAGTNLVKSLGADEIINYKTEKFEEILTNYDAVFDTIGGTTLEKSFNIIKSGGNIVSVSGTPNARFGKEFGSGFFKTLLFSLASKKLTALEKKHNAQYSFLFMKPSGDQLRTIANYIEAGKIKPVIDRVFSFEDAQKAMEYSEAGRAKGKIIVKIK

SEQ ID NO: 24750 - protein, 322 aa, Bacillus cereus ATCC 10987
MKVLEAISNIAGKYFAFWVICIAAIAYFIPAPFLGLTSYITILLGVVMFGMGLTLKAVDFKIIATKPLPVIIGVCAQFIIMPLVAYVLAYVMNLPAELAAGLVLLGSVPGGTASNVMVYLAKGNLALSIAMTSLSTLLAPIATPLILLLLAGQWMPVNPMSMFLSIVQVIIIPIILGLVVKKFFPKTVKKGMTVIPFISVLAIIIIVSAVVSANVSSITSSGLLIFIAVMLHNAFGFLLGYITAFILRLDEGTRRAISIEVGMQNSGLGVALATAHFGPAAALPSVLAAVWHNIAGPILATIWSKNAKDTFSDETLSVNIEK

SEQ ID NO: 24751 - protein, 253 aa, Bacillus cereus ATCC 10987
MIEISDLYKSYKSNEVLKGISLTVNKGEVVVIIGPSGSGKSTLLRCLNLLEQPEDGSIRIEDLEIHVKKLYKKEIIKLRQKTAMVFQNYNLFKNKTALQNITTPLTVVQKKSEEEAKRIAKEILKQVGLAEKENFYPTMLSGGQQQRIGIARAMALNPAVLLFDEPTSALDPELVNEVLQVIKDLARQHITMVIVTHEMNFAKEVADRIIFMADGIIVEQGTPEEIFRNPQNERTKKFLRQLNASEEGNHFVI

SEQ ID NO: 24752 - protein, 494 aa, Bacillus cereus ATCC 10987
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDRGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 24753 - protein, 1012 aa, Bacillus cereus ATCC 10987
MLINYSTMIITCRNVVRIFSWWSFFYSQKGGKTMNNNMVHITIDGKKYTAEPGSTILGVMNENGIEHPQICYVPEVDPIQTCDTCIVEVDGKLMRSCSTVATEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVASKLGAIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQRFIDENVNFFEDFKESLTAYTLEYAEEMTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFLWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRALVTDRVKANELYLPMNSTDNETAINFLTGPAVDTRTNTPAYKQTKVRMEVLEVEGENPMPKANPRNKKRHPQAGIEVHRKWARPGYVHLTDK

SEQ ID NO: 24754 - protein, 375 aa, Bacillus cereus ATCC 10987
MTSSNNKAASIYEGTNINAGGSFENIEETKLFNPIQIGSWSLRNRIAMAPMTRCFANHETGVVGTDVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQAVIGQYAQAAKNAIEAGFDGVEIHGAHGYLIDQFTYEFANKRTDKYGGDLKERLTFMKEVTAAVIEAVGANKTLLRFSAFKGDNPTYMWENPELAIETFVNMFKEVGLTMIHPSTMNYTAVIADGKNFHQLVRKYWDGTIVGVGNLNPKEAEEALQEGIIDVAAFGRPLIANPDFVHRIKNAESLVEYDAKEHLATLV

SEQ ID NO: 24755 - protein, 323 aa, Bacillus cereus ATCC 10987
MEHGHYLKKNAKFIDREVTKWSEMIKDWEEGVEIFGAALIGAPLSKPSISHSGASFAPKTIRAMLDAYSTYAITEEHDMKESVLYDCGDITMHVTDIKESHNRIAKTVGHVTKVNPNMIPIVLGGDHSISFPSITGFANSKGKVGIIQFDAHHDLRNLEDGGPSNGTPFRSLLENGVITGKQLVQIGIRNFSNARAYHEYAKEHGVTVYTMKDVREREIKDIMTESIEVLRKQGVTSIYISLDMDVLDQAFAPGCPAIGPGGMDSATLLDAIEFLGKEPLVQGMDIVEIDPTLDFRDMTSRVAAQVIMSFLLARETVRKQVSI

SEQ ID NO: 24756 - protein, 444 aa, Bacillus cereus ATCC 10987
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQANEVISNALGDHLLEHFIEAKEIEWDIFRTQVHQWERDQYMSLY

SEQ ID NO: 24757 - protein, 487 aa, Bacillus cereus ATCC 10987
MGVLLPVNAGQISKLRLEGDVQELEKNLKKDLKIRHITMISIGGVIGAGLFVGSGAVVHSAGPGSIISYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGVPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLKIRKKMGKVEQQNLKVKMWFFPYVTYVTIAAIIAVLVAMLAIESLRSQALLTMLVTVLIILSYFIFNRNKNSTVSNTTSKNEESVRF

SEQ ID NO: 24758 - protein, 240 aa, Bacillus cereus ATCC 10987
MVKLVLIRHGQSEWNVENRFTGWTDVDLSSKGLEEAREAGVMLKASGFSFDIAYTSVLRRAMRTLWITLEEMDLMWIPVYKTWKLNERHYGALQGLNKEETARKYGDEQVTLWRRSTNVRPPALTKDDERYEAAHPKYRDIKDYEFPLTEDLEDTEKRVVSYWNEEIAPNVKAGKQVIIAAHGNTIRALVKHLDQISDKDIENVNIPTGTPLVYELDNDLKPIGHYYLNREIETLEEKQV

SEQ ID NO: 24759 - protein, 392 aa, Bacillus cereus ATCC 10987
MKSFQPSEIVTSLPTQFFASLVAKVNKVVAAGHDVINLGQGNPDQPTPQHIVKALQDAAEKTIHHKYPPFRGHESLKEAVATFYQREYGVELNSKTEVAILFGGKAGLVELPVCFTNPGDTILVPDPGYPDYLSGVALAKAKFETMPLIAENNFLPDYAKIDDSIAERAKLMFLNYPNNPTGATASKDFFDETIHFANKHNILVIHDFAYGAIGFDGQKPVSFLQADGAKDTGIEIYTLSKTFNMAGWRIAFAVGNESVIETINLLQDHMYVSIFGAVQDAAREALLSSQSCVIDLVNSYEARRNALISACHSIGWNVNIPTGSFFAWLPVPKGYTSEQFSNILLEKAHVAVAPGVGFGEHGEGYVRVGLLHTEDRLREAIHRIDKLNFFKK

SEQ ID NO: 24760 - protein, 170 aa, Bacillus cereus ATCC 10987
MAQIRIHEINTRIENEVEVSKFLQEEGVLYEKWNISKLPTHLKENYSLTDENKAEILAVFSKEIADVSSRRGYKAHDVISLSNSTPNLDELLINFQKEHHHTDDEVRFIVSGHGIFAIEGKDGTFFDVELEPGDLISVPENARHYFTLQDDRQVVAIRIFVTTEGWVPIY

SEQ ID NO: 24761 - protein, 292 aa, Bacillus cereus ATCC 10987
MKHKNVSIGFIGIGVMGKSMVRHLMQDGHTVYVYNRTKSKTDSLVQDGANWCDTPKELVKQVDVVMTMVGYPHDVEEVYFGIDGILENANEGTIAIDFTTSTPTLAKRINETGKSKNVYTLDAPVSGGDVGAKEARLAIMVGGEKEIYDRCLPLFEKLGTNIQLQGPAGSGQHTKMCNQIAIASNMIGVCEAVAYAKKAGLDPDKVLESISTGAAGSWSLSNLAPRMLKGDFEPGFYVKHFMKDMKIALDEAERLQLQVPGLSLAKELYEELIKDGEENSGTQVLYKKYVRG

SEQ ID NO: 24762 - protein, 429 aa, Bacillus cereus ATCC 10987
MKGILERTFKLGLHETSPKQEVLAGVTSFFTIVYIMIVNASILSDAGIPLEAGILATVFSSFVGCLLMAFWANAPAILVPGMGVNAFFTYTAVHTLGLTWQEALAAVFISGIIFAIAAFTPIARVLSVSIPKSLKEAITVGIGLFLAFIGLQKGGLVVSNPNTAVAMGKLSSPVVLATVLTLIVALILFIRNVRGNFLWTIAIGTGIAWLFGLVDTSQIGKSSFSFASYGDVFGAMSFGKLSSLPFWIATFSLSMVLIFENMGLLHGLLEDDRKFPRAYQANAISAMTCGLFGTSPTVSTVESAAGITAGGKTGLTSIVTGLLFFASLFALPFVKLIPDSAIAPILIIIGGLMITSIQQIPLNDFSEGFPAFLIIVMIPLTYSIADGIAFGFIAYPILKVALGKRKEVAPSMYIITCLFLAMFVLHAIG

SEQ ID NO: 24763 - protein, 304 aa, Bacillus cereus ATCC 10987
MKKRQLGNSDLYVTEMGLGCMSLGTSETEALRIIDEAINLGINFFDTADLYDYGLNEEFVGKALKGKRDQIVLTTKVGNRWTEEKNGWSWDPSKNYIKAEVKESLRRLQTDYIDLYQLHGGTIEDPIDEVIEAFEELKKEGIIRHYGISSIRPNVIREYAKRSNIVSVLMEYSLLNRRPEEWFQLLNEHQISVIARGPLAKGILTDNNARKIERVKEKDYLSYSYDELYATLTNVKEIIGENALTGTAIQYCLHNETVAAVIPGASSIQQLRENVQSSKQTQLTTAEYTQLQQIVKCDTYALHR

SEQ ID NO: 24764 - protein, 307 aa, Bacillus cereus ATCC 10987
MKRFFAALFTILGAITALGIFFTNKVMYLKKKTEEEILERETKKHFRIEDFDALHKEEIHIPSQFGYDLHGYYIPAGHSNKFMIFCHGVTVNKMNSVKYARLFLNRGYNVVIYDHRRHGKTGGKTTSYGYYEKHDLKSVVDWLKGRFGTNITLGIHGESMGAATLLQYAGLVEDGADFYIADCPFSDFYGQLQHRLKVEFHLPKWPLLPLANAFLKVRDGYTIREVSPIDCIKNINNPVLFIHSKDDDYILADMTKALYESKENNKQLYIAEHGAHACSYNENKEEYEAAIDQFLNSYVKETKNRLA

SEQ ID NO: 24765 - protein, 462 aa, Bacillus cereus ATCC 10987
MTFSKSTTDKPSYTYEELSEKNKAYVWHPFTQMKDYLEEDPVIIERGEGRKLYDVNGNEYWDGVSSIWLNVHGHQVPELDEAIREQLNKISHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNNKEEIVKKHLEEMEELLKDKHEEIAAIIVEPLMQGAGGMITMPKGYLKGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVARKTEYVATQLEDLFAYKHVGDIRQCGLMVGIELVKNKETKEAFEWTERVGVQVCKRSRELGMILRPLGNTIVFMPPLASTIDEIDDMLRILYKAISDVTEGE

SEQ ID NO: 24766 - protein, 386 aa, Bacillus cereus ATCC 10987
MTSHLFQTYGRRKSEFVKGKGTKVIDHNGKQYLDFTSGIGVCNLGHCHPTVMKAVQEQLHEIWHISNLFTNSLQEEVASLLTENIALDYAFFCNSGAEANEAALKLARKHTGKSLVVTCEQSFHGRTFGTMSATGQNKVKEGFGPLLPSFLHTPFNDIKALEEVMNEEVAAVMIEVVQGEGGVILADLSFLKAIEALCKKFGSLFIIDEVQTGIGRTGTLFAYEQMGIKPDIVTVAKALGNGIPVGAMIGRKELGTSFTAGSHGSTFGGNYVAMAAAKEVLQVSKRPSFLKEVKEKGDYVLQKLQEELRHVECIQNIRGKGLMVGIECKHEVASFIEQLEEEGLLVLQAGPTVIRLLPPLIVTNEELEQAVYMIKKVVCTKNVSII

SEQ ID NO: 24767 - protein, 240 aa, Bacillus cereus ATCC 10987
MIKIENLHKSFGKNEVLKGITTTIGKGEVVAIIGPSGSGKSTFLRCMNVLEAPTNGHIWIGTEEVTNPKTNIMHVRENVGMVFQHFHLFPHMTVLENITYAPINVKGVTKQEAEKKAEKLLEKVGLLDKKDTYPNRLSGGQKQRVAIARALAMEPEVMLFDEPTSALDPEMVKEVLEVMKSLVTTGMTMAIVTHEMGFAKEVADRVLFLDGGKLVEDSAPAEFFAAPKSERAQQFLQKIL

SEQ ID NO: 24768 - protein, 473 aa, Bacillus cereus ATCC 10987
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 24769 - protein, 307 aa, Bacillus cereus ATCC 10987
MNVYRGVHELIGHTPIVEITRFSLPEGVRLFAKLEFYNPGGSVKDRLGRELIEDALEKGLVTEGGTIIEPTAGNTGIGLALAALQHDLHVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 24770 - protein, 401 aa, Bacillus cereus ATCC 10987
MNRSTKFTVKNRFYKAAMSETMATKNNNPTEELVTLYGRWAQGGAGLLMTGNVMIDREALGEPGNVVIEDERDLDILKRWAKSGTQNGTQLWMQINHPGKQSPKTLSKNPVAPSAIPLTGDIKDFFNKPRELTSGEIWQLIKRFGNAARIAKKAGFTGVQIHAAHGYLINQFLSPHHNQRQDEWGGDLDGRMKFLIETYYEIRKQVGEEFPIGLKLNSADFQRGGFTEEESMKVLKKMDDLGMDLIEISGGNYENPKMFDGVRESTKKREAYFLDYAQKARTLVQAVLIVTGGFRSEEGMNEAIESGAVDMVGVGKLFALNPDFPNQIIHGNYHTVTIKPIRTGLKRLDKKISSMLELTWYERQFKLMGKGKEPNPNYSVWKTVFQMISENGMNAFQKRRA

SEQ ID NO: 24771 - protein, 477 aa, Bacillus cereus ATCC 10987
MASIYKFYLNGEWRESSSGETIEILSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGIDMVSFTGGTNTGKHLAKKAAMITLVLELGGKDPGIVREDADLQDAANHIVSGAFSYSGQRCTAIKRVLVHENVADELVSLLQEQVAKLSVGSPEQDSTIVPLIDDKSADFVQGLVDDAVEKGATIVIGNKRERNLIYPTLIDHVTEDMTVAWEEPFGPILPIIRVSSDEQAIEIANKSEFGLQASVFTKDINKAFAIANKIETGSVQINGRTERGPDHFPFIGVKGSGMGAQGIRKSLESMTREKVTVVNFK

SEQ ID NO: 24772 - protein, 283 aa, Bacillus cereus ATCC 10987
MIRVGYLGPEATFTNMAVSRFFPEAEHVPYRTIPDCMDAAANGNVDYAVVPLENAIEGSVNITIDYLVHEQPLSIVGEITVPIQQHLLVHPQYAEVWEEVYAVHSHPHAIAQCHKFLNEELKGITARDMTSTSAAAQYVKEHPEEKIAAIANEAAAEKYGLTIVRRSIHTHKNNHTRFLVLHKKKKAILSNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 24773 - protein, 429 aa, Bacillus cereus ATCC 10987
MKKFDKSIAAFEEAQDLMPGGVNSPVRAFKSVGMNPLFMERGKGSKVYDIDGNEYIDYVLSWGPLIHGHANNRVVEALKAVAEKGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 24774 - protein, 221 aa, Bacillus cereus ATCC 10987
MLKKAIAEFIGTFVLVLFGTGVAVIGGGIEGIGTLGIAMAFGLSIVAMAYSIGTISGCHINPAVSVAMFINKRMNAMELCYYVLAQILGGLLGTATLVTILKSAKTPLDNLGQNGFGTLGLSGAFLVEFILTFVFILVIVAVTGKKGSSSLAGLVIGFTLVLVHLLGIPLTGTSVNPARSIAPALFAGGEALSQLWVFIVAPIVGGIVAAIVGKFILNTEK

SEQ ID NO: 24775 - protein, 320 aa, Bacillus cereus ATCC 10987
MKPKVYIAEPVPTFVENYLSEHCDYEKWEQNEKVPRDVLLEKIQDKDGLLNFGSAINEELLEAAPNLKVVSNISVGYDNFDLQAMEKRNVIGTNTPYVLDDTVADLVFALMLSAGRRVCELDSYVKNGEWNAEIGKEHFGLDVHHSTIGIIGMGRIGEAVAKRAKFGFDMDVLYYNRRRKEEAEQKFDATYCDLQTLLKQSDFIVLLTPLTDETYHLIGEKEFSFMKETAIFINASRGKTVDEEALIHALTEKKIFAAGIDTFTQEPIQKDNPLLSLQNVVTLPHIGSATLKTRQQMAMTAAENLVAALQGKTPPHIVRG

SEQ ID NO: 24776 - protein, 509 aa, Bacillus cereus ATCC 10987
  misc_feature (489)..(489): Xaa can be any naturally occurring amino acid
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSDGEPMTAHTTNPVPFIVTKNDVELREGGILGDIAPXMLTLLGVEQPKEMTGKTIIK

SEQ ID NO: 24777 - protein, 251 aa, Bacillus cereus ATCC 10987
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLEAVK

SEQ ID NO: 24778 - protein, 394 aa, Bacillus cereus ATCC 10987
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELDVLGKALSNPDRPFTAIIGGAKVKDKIGVIRHLLDKVDNLIIGGGLAYTFVKALGHEIGLSLCEDDKIELAKEFMQLAKEKGVNFYMPVDVVITEEFSETATTKIVNIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 24779 - protein, 444 aa, Bacillus cereus ATCC 10987
MFKWLKPAPAIERLPADMIDRVYRLLRIRVLIGISVGYAAYYLVRSNFTLSSTYLVQEYGFSTAQIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADHANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKAA

SEQ ID NO: 24780 - protein, 399 aa, Bacillus cereus ATCC 10987
MGKVKEISKRKLLSIAGLGWLFDAMDVGMLSFVMVALQKDWGLSTQEMGWIGSINSIGMAVGALVFGILSDKIGRKSVFIITLLLFSIGSGLTALTTTLAMFLVLRFLIGMGLGGELPVASTLVSESVEAHERGKIVVLLESFWAGGWLIAALISYFVIPKYGWEVAMILSAVPALYALYLRWNLPDSPRFQKVEKRPSVIENIKSVWSGEYRKATIMLWILWFSVVFSYYGMFLWLPSVMVLKGFSLIKSFQYVLIMTLAQLPGYFTAAWFIERLGRKFVLVTYLIGTACSAYLFGVAESLTVLIVAGMLLSFFNLGAWGALYAYTPEQYPTVIRGTGAGMAAAFGRIGGILGPLLVGYLVASQASLSLIFTIFCGSILIGVFAVIILGQETKQRELV

SEQ ID NO: 24781 - protein, 432 aa, Bacillus cereus ATCC 10987
MDVTTDVQSTTEETKEKRYKTLFGSALGYAAEGLDMLLLSFVLVYILKEFHLSPVEGGNLTLATTIGMLIGSYLFGFIADLFGRIRTMAFTILLFSLATALIYFATDYWQLLILRFLVGMGVGGEFGIGMAIVTETWSKEMRAKATSVVALGWQFGVLVASLLPAFIVPHFGWRAVFLFGLIPALLAVYVRKSLSEPKIWEQKQRYKKELLQKEVEGSLTTTEAEQLKQMKKFPLRKLFANKKVTVTTIGLIIMSFIQNFGYYGIFTWMPTILANKYNYTLAKASGWMFISTIGMLIGIAIFGILADKIGRRQTFTIYYVGGTIYCLIYFFLFTNPTLLLWGSALLGFFANGMMGGFGAILAENYPAEARSTAENFIFGTGRGLAGFGPVIIGLLAAGGNLMGALSLIFIIYPIGLITMLLCVPETKDKVLE

SEQ ID NO: 24782 - protein, 327 aa, Bacillus cereus ATCC 10987
MENVFDYEDIQLIPAKCIVNSRSECDTTVTLGKHKFKLPVVPANMQTIIDERIATYLAENNYFYIMHRFQPEKRISFIRDMQSRGLIASISVGVKADEYEFVQQLAAEHLTPEYITIDIAHGHSNAVINMIQHIKKHLPESFVIAGNVGTPEAVRELENAGADATKVGIGPGKVCITKIKTGFGTGGWQLAALRWCAKAASKPIIADGGIRTHGDVAKSIRFGATMVMIGSLFAGHEESPGETIEKDGKLYKEYFGSASEFQKGEKKNVEGKKMFVEHKGSLEDTLIEMEQDLQSSISYAGGTKLDSIRTVDYVVVKNSIFNGDKVY

SEQ ID NO: 24783 - protein, 398 aa, Aspergillus fumigatus
MADEQKVTPAATNANAEAEKDVQNVLAELKGEAGEAPKPSEQPTEDKKGEAPTEDAEEARIVAAAAKLGEQSAKAEEQKEGKAEERDTRGRGNRRNNVKFDPSTLEVTDNHDEIRKQVEFYFSDSNLPMDKFLLSKVGGSSNRPVPLELLHSFKRMRRFQPFSAIVEALKSSKTLELTDNDTCVRRKVPLPESVTEKPDPSVTKVFEDQAMSRSIYAKGFGEETPTTQIDIEAFFAPYGPVNAIRLRRTHDRIFKGSVFVEFATEEKQKEFLALDPKPQWKGQDLLIKSKKDYCEEKVRDIEAGRIKPSRGRGGFRGRGRGGPRGGDKRDWRERRAEDQKNGFGKPQGEQRREVQKDARGVPVVQSTADDATAGQKRTREDEATTNGEHPAKKVDTKE

SEQ ID NO: 24784 - protein, 1102 aa, Aspergillus fumigatus
MPLIDNSRSNDAVQSSICNGISHTTIIESVRDPDYRHNDPNRRQKIVIVGLGMVAISFIEKIVKQDAERRKYDIVVIGEEPHIAYNRVGLSSFFEHRKIEDLYLNPKEWYGSFKDRSFDYHLNTKVTDIFPERKTVRTSTGDVIPYDILVLATGSDAVLPTHTPGYNAKGIFVYRTIQDLERLIEFASKHKGETAVTVGGGLLGLEAAKAMTDLEDFGRVKLIDRNKWVLARQLDGDAGTLVTRKIRELGLDVLHEKRVAKIKTDDDNNVTGITFEDGEEIDCCCICFAIGVRPRDELGPPAGIQCAGRGGFVINESLQTSIPDIYAIGECASWENQTFGIIAPGIEMADVLSFNLTNPDKEPKSFKRPDLSTKLKLLGVDVASFGDFFADRDGPKFLPGQRPSIVDGSVGNADGDKEPSVKALTYKDPFAGIYKKYLFTMDGKYLLGGMMIGDTKDYVKLNQMVKSQKPLEVPPSQFILGAQKEGEENADDLDDDAQICSCHNVTKGDIVENVKSGTCKTIGEIKSCTKAGSGCGGCMPLVQSIFNKAMRDMGQEVSNHLCMHIPYSRADLYTVIAVKRLRTFVDVMQAVGRKPDSLGCEICKPAIASILSSLFNQHIMDKELHDLQETNDRFLANIQRNGTFSVVPRVPGGEITADKLITIGQVAKKYNLYCKITGGQRIDLFGAKKQDLLDIWTELVDAGMESGHAYAKSLRTIKSCVGTTWCRFGIGDSVGMAIRLEERYKSIRSPHKLKGAVSGCVRECAEAQNKDFGLIATEKGYNIFVGGNGGAKPRHSELLAKDVPPEKVIPIIDRYLIFYIRTADKLQRTARWIENLPGGINYLREVIIDDKLGIGAEMEQQMEELVNSYFCEWTETVRNPKRRKYFQQFANSDETVDTVEVIKEREQQRPTYWPKDSAGEDFKGHQWSSLSWQPVIEANYFSDEHPQISSANIKRGDTQLAIFKVKGKYYATQQMCPHKRAFVLSDGLIGDDDAGKYWVSCPYHKRNFELNGEQAGRCTNDESMNIATFPVEERDDGWVYMKLPPVEELDSVLGTEKWKVRKGEAPDPFQKVDKRYKGMRGKKACDISTKAPTTQAANIIDW

SEQ ID NO: 24785 - protein, 508 aa, Aspergillus fumigatus
MMNSLKLLVVSPEINPSNRKARSIPVLNPFDRYGRVFFFSWLGFMVAFLSWYAFPPLLTVTIRKDLHMTQQQVANSNIVALLATFLVRFIAGPLCDRFGPRLVFIGLLLCGSIPTAMAGLVTTPNGLIALRFFVGILGGTFVPCQVWCTGFFDKNIVGTANSLAAGWGNAGGGITYFVMPAIYDSLVHSQGLAPHKAWRVAYIVPFIIIVVLALCMLLICEDTPTGKWSERHIWMKENNESQANIVNLMSGSPSTRPSGPPSINISTPQSEKKGAQTPQMVDPEAQAVGQVDILRADTVVAPSRKEVMNVLLSLSTAAVAIPYACSFGSELAINSILGEFYSKNFPDMSQTESGRWAAMFGLLNVVFRPAGGFIADMLYKYTGAVWSKKVLLSFLGVVMGAFQLAIGLADPRSEATMFGLTAGLAFFLEACNGTNFAVVPHVHPFANGVVSGAVGGMGNLGGIIFAIIFRYNETHYSRSLWIIGVISIAANLAVSWIRPVPKSQMMRQ

SEQ ID NO: 24786 - protein, 326 aa, Aspergillus fumigatus
MAEFVRAQIFGTTFEITSRYTDLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENKRIRAGEALAHEYLSPYHDPTDEPEAEEKFDWSFNDADLPVDTWKIMMYSEILDFHNIDQGNDAGQVLMEGGVAQAQQNYA

SEQ ID NO: 24787 - protein, 250 aa, Aspergillus fumigatus
MSHEMSYMGHRAFNHDQNADVEAEYDRLRDLARQEAAKRNSCFQRSQEAYSNGDGARAKELSEQGKAHGRKMDEYNKQASEFIFRENNADGRVPADTIDLHGQFAEEAEEILEQRIKYAKAHGQTHLHVIVGKGNHSANHVQKIKPRVEQVCRELGLQYATEENAGRIYVNLTGGPAEMPPSTGHGHGHGHGQGHGQSYSHGQPAHQQYPGQQPHHQQQGEQQQDEIEQVVNAILPRVLRKLEKACCTIM

SEQ ID NO: 24788 - protein, 1145 aa, Aspergillus fumigatus
MAYATTSSPAALNGDAESSLNINNSLPNPPKLHHVIKSFSPATQTSSTTSYISSLTTTPSSLFPASNHSNASSPSGTPLQIATDALQGRLSTFPPVSLSSFELGESMMAVPGNPATSNVDSVSPNPNKGAGLMRRISRGAASKLTRRRQSATHSDKRDRSSGPVIMRRRSDSKTAAQTGRECALDSSNEEDGNDAVDSLGVWCGSEAPSLSTDASMMASRNVGAVAPKVDSAIQRGTVLTKVTKKRKKQVRFFLDLDAGKVYWDLSNPAKRFYIDDIKEVRVGVDARNYREEHQVPQDVEGRWFTIVIADPEKSKGRSVKTLHLIAPNDHILELWTTTLENISQYRINLMAGLAGSGQSETVLKVHWQREMSRLFPQGLAPGEEESLDFGAVETVCRSLHINCSKNMLRAQFSKADLGNKGRLNFSEFQNFVARLKERKDINDLYKTWATNAQEGLTVDEFLAFLRDAQQEDVDTDRAYWVSVFEKYVRKCKPRAPSLTDGVERQAFRMSLEAFSAFLSSNWNGIYASRPPQSRFDRPLNEYFISSSHNTYLLGRQVAGASSTEAYISALSQGCRCVEIDCWDGADGRPIVSHGRTMTTSVLFADCITVINRYAFITCDFPLILSLEVHCNPEQQLAMVRIMKDTFKERLVLEPLLTNSFVLPSPEELKGRILVKVKTCDETLDGVRQDTSTSFASAGRKRSSSSPWMRPSVPENPLCTNLPPLSSPMTIGQESVGPFVSQDRRSFTTTSMSSATEDSDGALVSVKRERRRRQKSKITKPLSDLGVYTRGYKWHSFSSPESQRFNHVYSFAERAFESICRDAENKALLERHNQKYLTRVYPSGFRLRSSNFDPLKFWRRGVQMAALNWQTYDIGMQLNQAMFAAGTDRTGYVLKPESLRLPPYEQASKTSTERKLVRFSVEVISAQQLPRPRTMGPDDNINPYVEIEMFSADDRGQSFVVGEGGMNASARNGVSGIGYPHRRRTKIEQSNGYSPTFNDRFKLSLETKYPDLVFVRWTVWSSLDGRSAGNNNSVQLATFTAKLSSLSQGYRYLPLYDLGGDQYLFSTLFCRITKEEPVPVQRLGAEELRAERLGILRQIGQTVFKRGSSTERSDKGSETPASQDDKDTSPVLTPTVSTTSTSSLFL

SEQ ID NO: 24789 - protein, 350 aa, Aspergillus fumigatus
MPLVVPSATPRVILGLMTFGPDESEGARITSLDDFNKCLDHLQQQGYNEVDTARIYVGGKQEAFTAQARWKERGLTLATKWYPHTPGAHKPDVLRENLERSLKELQTDQVDIFYLHAADRSVPFAETLEAVNELHKEGKFVQLGLSNYTAFEVAEIVILCNERGWVRPTIYQAMYNAITRNIETELIPACKRYGLDIVVYNPLAGGLFSGKYKTKDIPAEGRYSNQSSTGALYRGRYFKDATFDALRLIEPVAQKHGLTMPEIAFRWIHHHSALNMKDNGRDGVIIGVSSPAQLENNLKDIQKGPLPQEVVDTLDQAWLIAKPTAPNYWHLDLKYTYDTQAALFKPKPKA

SEQ ID NO: 24790 - protein, 451 aa, Aspergillus fumigatus
MMACSPKCRAKSRPIHILQNQIVLDVNIYMMPSHATMSSPPAGTKLDLSKKLSELRASRRSHSGPSPREPTPVTPPLPSPPDLSTHTYTRPVRRILSRKDHETFLASSTYTLVVSFTFSLSDSVRGRAVTDNKDQPASPNISRILSVIDTIRQLVDKHPSIDQGGSRFGNPAFRDLFDDVAAQNATWHREIIGLQNADAIEEVSSYLVHSLGSRDRLDYGSGHELNFMMWLLCLRQMQMISTADFPMIVFRVYLEYMRLMRQVQMTYYLEPAGSHGVWGLDDYHFLPFLFGAAQLVDHPYITPLAIHNTAVLDEEGDKYIYLDQVRWVDSVKTVKGLRWHSPMLDDISGAKNWLKIEGGMKKMFIKEVLGKLPIMQHFLFGSLLPADPSMGERSDDAQEDDLHDHGNGNPHARHTDHFGDCCGIKVPSTVAAGAEMRKRIGGTGLRPIPFD

SEQ ID NO: 24791 - protein, 293 aa, Aspergillus fumigatus
MSEITHPTIKDGWFSEQSDMWPGQAMNLKVNQILHHEKSKYQDVLVFESTDYGTVLVLDNVIQCTERDEFSYQEMITHLAMNSHPNPKKVLVIGGGDGGVLREVVKHESVEEAILCDIDEAVIRVSKKYLPGMSIGFQHPNVKVHIGDGFQFLKERKNEFDVIITDSSDPEGPAESLFQKPYFELLRDALRDGGVITTQGSENQWLHLSLITDLKKACKEVFPVAEYAYTTIPTYPSGQIGFMVCCKDATRNVREPVRTWSREEEERLCRYYNQDIHRASFVLPNFARKALDV

SEQ ID NO: 24792 - protein, 408 aa, Ipomoea quamoclit
MVDGNHPAPAPALTPPKVCVTGTAGFIGSWLVMKLLQQGYHVHATVRDPGNTKKLKHLLELPMADTNLTVWKGVMEEEGSFDEAIAGCEGVSHVATPMDFHSKDPDNELIKPAINGVLNIIKSCVKAKTVKRLVFTSSAGTLNVHPQQKPVCDETCWSDLDFIYAKKMTGWMYFASKILADKEAWKATKEKQIDFISIIPPLVVGPFITPTFPPSLITALSLITGNEAHYSIIKQGQYVHLDDLCEAHIFLYEHPKAEGRLICSSHHTTIHGLAEMITQNWPEYYIPSQFKGIEKDLPVVYFSSKKLQDMGFQFKYSLEDMFKGAIETLRKKGLLPYSTKEPAAAIEEEEETVPLKVEEPSTAIEEQKQEATTVPLKPAAIEEQKQEATTVPLKPAAIEQKQETVLCP

SEQ ID NO: 24793 - protein, 206 aa, Saccharomyces cerevisiae
MNSEYDYLFKLLLIGNSGVGKSCLLLRFSDDTYTNDYISTIGVDFKIKTVELDGKTVKLQIWDTAGQERFRTITSSYYRGSHGIIIVYDVTDQESFNGVKMWLQEIDRYATSTVLKLLVGNKCDLKDKRVVEYDVAKEFADANKMPFLETSALDSTNVEDAFLTMARQIKQSMSQQNLNETTQKKEDKGNVNLKGQSLTNTGGGCC

SEQ ID NO: 24794 - protein, 255 aa, Escherichia coli
MRHPLVMGNWKLNGSRHMVHELVSNLRKELAGVAGCAVAIAPPEMYIDMAKREAEGSHIMLGAQNVNLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 24795 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 24796 - protein, 125 aa, Salmonella enterica
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGT

SEQ ID NO: 24797 - protein, 312 aa, Flaveria chloraefolia
MEDIIKTLPQHTCSFLKHRFTLYKYKDAWNHQEFLEGRILSEQKFKAHPNDVFLASYPKSGTTWLKALAFAIITREKFDDSTSPLLTTMPHDCIPLLEKDLEKIQENQRNSLYTPISTHFHYKSLPESARTSNCKIVYIYRNMKDVIVSYYHFLRQIVKLSVEEAPFEEAFDEFCQGISSCGPYWEHIKGYWKASLEKPEIFLFLKYEDMKKDPVPSVKKLADFIGHPFTPKEEEAGVIEDIVKLCSFEKLSSLEVNKSGMHRPEEAHSIENRLYFRKGKDGDWKNYFTDEMTQKIDKLIDEKLGATGLVLK

SEQ ID NO: 24798 - protein, 356 aa, Magnaporthe grisea
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQENNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 24799 - protein, 345 aa, Pseudomonas sp. W7
MKAIGYLEPQAIDQADALIDIELDTPTATGRDLLVKVHAISVNPVDTQVRRAAKPEAGQHKVLGWDAVGEVVATGLKTQLFKVGDLVWYAGDITRTGSNAEFQLVDERIVGAKPSSLSNVEAAAMPLTGITAWELLFDRLDFTPLLEGQAGATSAAPQARILIMGAAGVGSILTQLAAKLTNAVVIGTASREQTQRWVKELGADHVINHHQPLVPQLNALGIENVSHVISLTHTEQHYEQLVEALAPQGKLALIDDPQGGLDVMKLKQKSLSLHWELMFTRSMFNTWDMQKQHELLTQLAQLIDNGVIRTTLGENYGTINAENLKRAHAHIESNRAVGKIVLEGF

SEQ ID NO: 24800 - protein, 461 aa, Neurospora crassa
MVETDTNSPTWKFTQCFGDKGDVEDITEADIISTVEFDHTGNYLATGDKGGRVVLFERNETKKTCEYKFHTEFQSHEPEFDYLKSLEIEEKINKIKWCRRQNASHYLLSTNDKTIKLWKVFEKSLKVVAENNLSHDLTPASVAGGGGAPRALPHTQFRSPADLKLPRLTHHDTVVAAVPRRTYANAHAYHINSISVNSDGETFISSDDLRINLWNLNIQDQSFNIVDIKPANMEELTEVITAAEFHPLSCNWFMYASSKGTIKLADMRERALCDQHAKMFEQEEDPSSRSFFSEIISSISDVRFSHDGRYILSRDYLTVKIWDVNMERQPVKTIPIHEHLRPRLCDTYENDSIFDKFEVVFSGDAKNVMTGSYNNNFMIYPSDPDKEVEVVLQADKSAFKAKKGNSRAGSPAAAGQGQRMRKETDADQIDFNKKILHMSWHPFEDSIAIAATNNLFVFSAL

SEQ ID NO: 24801 - protein, 481 aa, Neurospora crassa
MVETDTNSPTWKFTQCFGDKGDVEDITEADIISTVEFDHTGNYLATGDKGGRVVLFERNETKKTCEYKFHTEFQSHEPEFDYLKSLEIEEKINKIKWCRRQNASHYLLSTNDKTIKLWKVFEKSLKVVAENNLSHDLTPASVAGGGGAPRALPHTQFRSPADLKLPRLTHHDTVVAAVPRRTYANAHAYHINSISVNSDGETFISSDDLRINLWNLNIQDQSFNIVDIKPANMEELTEVITAAEFHPLSCNWFMYASSKGTIKLADMRERALCDQHAKMFEQEEDPSSRSFFSEIISSISDVRFSHDGRYILSRDYLTVKIWDVNMERQPVKTIPIHEHLRPRLCDTYENDSIFDKFEVVFSGDAKNVMTGSYNNNFMIYPSDPDKEVEVVLQADKSAFKAKKVGVPTPINSSTSPTANGGKKGNSRAGSPAAAGQGQRMRKETDADQIDFNKKILHMSWHPFEDSIAIAATNNLFVFSAL

SEQ ID NO: 24802 - protein, 335 aa, Nepenthes alata
YQWAFAIAAAGITSGSIAERTQFVAYLIYSSFLTGFVYPIVSHWFWSVDGWASASRASNLLLGSGVTDFAGSGVVHMVGGVSGLWGALIEGPRIGRFDRSGRSVILRGHSGSLVVLGTFLLWFGWYGFNPGSFLTILKAYGNNGGYFGQWSAVGRTAVTTTLAGSTAALTTLFGKRLLVGHWNVTDVCNGLLGGFAAITSGCSVVDPWAAIICGFVSSWVLIGFNKLAEKVKYDDPLEAAQLHGGCGMWGLIFTGLFATKKYVSEVYGGSPDRPHGLFMGGGGKLLAAQLIQIVVIFGWVTATMGPLFYGLKWLKLLRVKSEHEMAGMDMTSHGG

SEQ ID NO: 24803 - protein, 379 aa, Nepenthes alata
AVIGSGVLSLAWAIAQLGWVAGPAVLIAFSAITYFTSTMLADCYRAPDPVTGKRNYTYMDVVKAYLGGRKVQLCGLAQYGNLVGVTIGYTITASISMVAVKRSNCFHKHGHRDGCHTSNNPFMIAFACIQIVFSQIPNFHELFMASPIVAAAMSFAYSSIGIGLSIAKVAGGAHARTSLTGVAVGIDVTSTEKVWRTLQAIGDIAFAYAYANVLVEIQDTLKSSPPENKVMRRASLIGGRPPHSFYVLCGCMGYAAFVYDAPGNFLTGFGFYEPFWLIDFANVCIAIHLIGAYQVFGQPIFAFVEGWCRDMWPENKFITREHPIEVPFVGVYYLNLFRLVWRTTYVIITAIVAMLFPFFNDFLGLIGAASFWPLTVYFP

SEQ ID NO: 24804 - protein, 377 aa, Nepenthes alata
AVIGSGVLSLAWAIAQLGWIAGPAVMLLFSFVIYYTSILLADCYRVDDPIFGNRNYTYMDAVRSNLGGVKVKVCGLIQYLNLIGVAIGYTIAASISMMAIRRSNCFHNSGAKKPCHMSSNPYMIMFGILEIILSQIPDFDQIWWLSIVAAVMSFTYSTIGLSLGIAQVAANKAFKGSLTGISIGAVTQTQKIWRSFQALGDIAFAYSYSIILIEIQDTVKSPPSEAKTMKKASLISIVVTTAFYMLCGCMGYAAFGDIAPGNLLTGFGFYNPFWLLDIANAAIVVHLVGAYQVYCQPLFAFVEKSASGKWPKNAFINKGIKIQIPGFGAYDLNIFRLAWRTAFVITTTIISMLLPFFNDIVGILGAFGFWPFTVYFP

SEQ ID NO: 24805 - protein, 376 aa, Nepenthes alata
AVIGSGVLSLAWATAQLGWIAGPTAMLLFSFITFYTSRLLADCCRSGDSFTGERNPTYMDAVRSNLGGIQVKICGLVQYANLFGVSIGYTIAASISMMAIKRSNCFHASDDKNPCQYPASPFMIIFGLTEIIFAQIPDFHRLWWLSIVAAVMSFTYSTVGVSLGIAQVAENGKIKRSLTGISIGTVSQAQRIWRRFQALGDIAFAYSYSLVLVEIQDTIKSPPSEIKTMKKATVMSIAVTTLIYLLCGCMGYAAFGDLAPGNLLTGFGFYNPYWLLDLANAAIVVHLLGAYQVCCQPIFAFIETTASNAFPDNEFITKEVEIPIPGFKPYKLNLFRLVWRTSFVGVTTTISILLPFSNGVVGLLGALAFWPLTVYY

SEQ ID NO: 24806 - protein, 360 aa, Pseudomonas syringae pv. glycinea
MPTLFDPLTLGDLQSPNRVLMAPLTRGRATREHVPTELMIEYYTQRASAGLIITEATGITQEGLGWPYAPGIWSDEQVEAWKPVTQAVHEAGGRIILQLWHMGRTVHSSFLGGAKPVSSSATRAPGQAHTYEGKQDYDEARPLSADEIPRLLNDYEHAAKNAMAAGFDGVQIHAANGYLIDQFLRDNSNVRGDAYGGSIENRIRLLVEVTRRVAETVGAEKTGVRLSPNGDSQGVNDSNPEPLFSAAAKALDEIGIAHLELREPGYEGTFGKADRPPVHPVIRQAFSRTLILNSDYTLETAQAALATGEADAITFGRPFLANPDLPHRFAERLPLNKDVMETWYSQGPEGYVDYPTADQK

SEQ ID NO: 24807 - protein, 445 aa, Nicotiana tabacum
MAKAVDAAAAAAAAIAPVDTTVVNEDVALVENETCNDQNVQFDSLPSMKYASFLNSDGSVAIHAGERLGRGIVTDAITTPVVNTSAYFFNKTSELIDFKEKRRASFEYGRYGNPTTVVLEEKISALEGAESTLLMASGMCASTVMLLALVPAGGHIVTTTDCYRKTRIFIETILPKMGITATVIDPADVGALELALNQKKVNLFFTESPTNPFLRCVDIELVSKLCHEKGALVCIDGTFATPLNQKALALGADLVLHSATKFLGGHNDVLAGCISGPLKLVSEIRNLHHILGGALNPNAAYLIIRGMKTLHLRVQQQNSTALRMAEILEAHPKVRHVYYPGLQSHPEHHIAKKQMTGFGGAVSFEVDGDLLTTAKFVDALKIPYIAPSFGGCESIVDQPAIMSYWDLSQSDRAKYGIMDNLVRFSFGVEDFDDLKADILQALDSI

SEQ ID NO: 24808 - protein, 255 aa, Enterobacter cloacae
MRHPLVMGNWKLNGSRHMVNELVANLRKELAGVTGCAVAIAPPDMYLDLAKHAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 24809 - protein, 352 aa, Samanea saman
MASNGAREPLLPQSPDPAPPKTNGQVSRRRYLRCRSAPLANVDPPEKTDIGSIHRFDSILGKLHPSFRTVALYLIGYLGIGAVIFYLVRHQITGKKTEGVLDAIYFTIVTMTTVGYGDLVPNSDLTKLLACAFVFTGMALVGLILSKAADYLVEKQEALIIKALHGNHEVGPTKILQEAEVNRKWYKFFVVFVLLVALIIMGTIFLVAVEKLDVIDAFYCVCCTITTLGYGDKSFSSEGGRVFAVFWILTGTICLAQLFLCIAEMNTEKRRKEITEMVLKRRITIADLEAADIDHDGTVGVAEFIIYKLKEMGKISQEDIALIMQQFEELDVDQSGTLSPSDLTLAQAPWPS

SEQ ID NO: 24810 - protein, 441 aa, Arabidopsis thaliana
MERDEEAGGPMMEMCTNGGEETSNRRPIISGEPLDIEAYAALYKGRTKIMRLLFIANHCGGNHALQFDALRMAYDEIKKGENTQLFREVVNKIGNRLGEKYGMDLAWCEAVDRRAEQKKVKLENELSSYRTNLIKESIRMGYNDFGDFYYACGMLGDAFKNYIRTRDYCTTTKHIIHMCMNAILVSIEMGQFTHVTSYVNKAEQNPETLEPMVNAKLRCASGLAHLELKKYKLAARKFLDVNPELGNSYNEVIAPQDIATYGGLCALASFDRSELKQKVIDNINFRNFLELVPDVRELINDFYSSRYASCLEYLASLKSNLLLDIHLHDHVDTLYDQIRKKALIQYTLPFVSVDLSRMADAFKTSVSGLEKELEALITDNQIQARIDSHNKILYARHADQRNATFQKVLQMGNEFDRDVRAMLLRANLLKHEYHARSARKL

SEQ ID NO: 24811 - protein, 462 aa, Streptomyces seoulensis
MANDASTVFDLVILGGGSGGYAAALRGAQLGLDVALIEKDKVGGTCLHKGCIPTKALLHAGEIADQARESEQFGVKATFEGIDVPAVQKYKDDVISGLYKGLQGLIASRKVTYIEGEGRLSSPTSVDVNGQRIEGRHVLLATGSVPKSLPGLQIDGDRIISSDHALVLDRVPKSAIILGGGVIGVEFASAWKSFGADVTVIEGLKHLVPVEDENSSKLLERAFRKRGIKFSLGTFFEKAEYTQDGVKVTLADGKEFEAEVLLVAVGRGPVSQNLGYEEQGVNIDRGYVLVDEYMRTNVPTISAVGDLVPTLQLAHVGFAEGILVAERLAGLKTVPIDYDGVPRVTYCHPEVASVGITEAKAKEIYGADKVVALKYSLAGNGKSKILKTAGEIKLVQVKDGAVVGVHMVGDRMGEQVGEAQLIYNWEALPAEVAQLIHAHPTQNEALGEAHLALAGKPLHAHD

SEQ ID NO: 24812 - protein, 269 aa, Pseudomonas putida
MSVDSAYAVELKGVTFKRGSRSIFSNVDIRIPRGKVTGIMGPSGCGKTTLLRLMGAQLRPSSGEVWVAGQNLPTLSRSDLFDARKQMGVLFQSGALFTDLDVFENVAFPLRVHTQLSDEMIRDIVLMKLQAVGLRGAIDLMPDELSGGMKRRVALARAIALDPQILMYDEPFVGQDPIAMGVLVRLIRLLNDALGITSIVVSHDLAETASIADYIYVVGDGQVLGQGTPDELMGSDNPRIRQFMKGDPDGPVPFHFPAPDYRADLLGAR

SEQ ID NO: 24813 - protein, 212 aa, Eucalyptus globulus
FVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 24814 - protein, 437 aa, Pseudomonas fluorescens
MAERLNNDFQFIDVGRKDPKKKLLRQRKKEFVEIYEPFKPQQSADQAHRCLGCGNPYCEWKCPVHNFIPNWLKLVAEGNILQAAELSHQTNTLPEVCGRVCPQDRLCEGACTLNDGFGAVTIGSVEKYITDTAFAMGWRPDMSKVKPTGKRVAIIGAGPAGLGCADVLVRGGVTPVVFDKNPEIGGLLTFGIPEFKLEKTVLSNRREVFTGMGIEFRLNTEVGKDVTMEQLLEEYDAVFMGMGTYTYMKGGFAGEDLPGVYDALDFLIANVNRNLGFEKSPEDFVDMKGKKVVVLGGGDTAMDCNRTSIRQGAKSVTCAYRRDEANMPGSRKEVKNAKEEGVKFLYNRQPIAIVGEDKVEGVKVVETRLGEPDARGRRSPEPIPGSEEIIPADAVVIAFGFRPSPAPWFEQFSIQTDSQGRVVAPEQGQYKHQTSNP

SEQ ID NO: 24815 - protein, 475 aa, Escherichia coli
MMSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 24816 - protein, 202 aa, Prunus persica
MASYEKQYGATPTDEYGNPIRRTDEYGNPLGHHTTTTGTTAATTGAGGYDPHDFAATTVAGQGQGVHGHDYDRKGHHGVTGAVLHRSGSSSSSSSEDDGLGGRRKKKGLKEKVKEKLPGGTKTDTTYGGTGTTGQHHQEKGTMDKIKEKLPGTGGHRADDPYPSQTHTTATTTPYGGTAYTEEHQEKKGIMDKIKEKLPGQH

SEQ ID NO: 24817 - protein, 475 aa, Casuarina cunninghamiana
MSPQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 24818 - protein, 475 aa, Comptonia peregrina
MSPPTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 24819 - protein, 475 aa, Gymnostoma webbianum
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 24820 - protein, 475 aa, Myrica gale
MSPQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 24821 - protein, 202 aa, Lycopersicon pennellii
MTAIGEVENPTVVQRPTEASKVKEQAPATDKKPRAPKEKKPKSAKAVTHPPYFQMIKEALLALNEKGGSSPYAVAKYMEDKHKDELPANFRKILGLQLKNSAAKGKLIKIKASYKLSEAGKKETTTKTSTKKLPKADSKKKPRSTRATATAAKKTEVPKKAKATPKPKKVGAKRTRKSTPAKAKQPKSIKSPAAKRAKKIAV

SEQ ID NO: 24822 - protein, 454 aa, Haloferax volcanii
MTEDNALTDGGLSDEAQAVIDEIEEKNVDFLRLQFTDILGTVKNVSIPASQAEKAFTEGIYFDGSSIDGFVRIQESDMRLEPDPSTFAVLPWRKKENSAAGRLICDVFNTSTGEPFSGDPRGVLKRAIEPEELGYDVNVAPEPEFFLFEEDEDGRATTVTNDAGGYFDLAPKDLASDVRRDIIYGLESMGFDIEASHHEVAEGQHEINFTYDDALSTADNVRTFRSVVRAIAAEHDLHATFMPKPIPRINGSGMHTHISLFKDGENAFHDGDDEFDLSDTAKSFVAGILDHAPAITASLTRRSTPTRRLVPGYEAPVYIAWSDRNRSALIRKPAARTPAASRIEARFPDPSCNPYLAFAALIHAGLDGVEKGLDCPDPVRENIYEFDEAKREEYGIETLPKTSAARRRPRRDEVIQEALGDHVFEKFVEAKRSEFKDYLVDVSQWELDRYLETF

SEQ ID NO: 24823 - protein, 239 aa, Chlamydomonas reinhardtii
AYLFDQFGLNLAVAGALGAIFGLMNIFSRATGGMISDLIAKPFGMRGRLWVLWITQTLGGIFCIIMGKVSNSLTATIVIMIIFSIFCQQACGMHFGITPFVSRRAYGVVSGLVGAGGNVGAAITQAIWFSGTATWQINLSRPDSFVWMGVQAVALTVAVMFIWFPMWGSMFTGPREGVEEEDYYLREWSAEEVAQGLHQGSMRFAMESKSQRGYKDKRMLDAVGETASADVAAVKATVA

SEQ ID NO: 24824 - protein, 331 aa, Zymomonas mobilis
MMKEVIIKEAGSADVLALHDAPIPTPKADEILVKIAAAGINRPDIIQRMGQYPLPPDATPIPGLEISGTVIALGQDVEEFKIGDRICGLTNGGGYAEYGVIPAKQALPVPDNLSLTEAAAIPETYFTVWANLFDIGQAKSGETVLVHGGSSGIGSAAIILAKACGLKVFTTVGNQEKAAAVEKLGAIAINYNEQDFLTIIQEEMAGKGVDVILDIIGGSYFSRNMKALAFGGRLVIVGAMGGRIADKFDLLPLIFKRATISGSTMRARTADEKANIARSLREKVWPLLEQGQCHPLIDSSFPLEKVQDAHKRMESRDHCGKIVLTMPEALF

SEQ ID NO: 24825 - protein, 256 aa, Zymomonas mobilis
MDDGQCHNRATEVAALKEGIALGMTLIDTAEMYGEGAAEICVGEDIKGTPRESLYLVSKAYPQNASRKTLPKVCEASLKRLGTDYLDLICCIGGGVCLAETIETMEALQAAGKIRRWGVSNLDTDDMEEWIAAGGQACTTDQILYNLTRRGPEFDLIPLLRKHHMPVMAYSPVEQGRLLKNPALIALAQALNVTPAQLGLAWVMRHPDIMAIPKAGHVAHVKENFASLDIVLDDTILAELDKLFPAPTRKQHLAIL

SEQ ID NO: 24826 - protein, 269 aa, Klebsiella aerogenes
MERYETLFAQLKNRQEGAFVPFVTLGDPGPEQSLKIIDALIEGGADALELGIPFSDPLADGPTIQGAALRAFAAGVTPAQCFEMLAAIRQKHPTIPIGLLMYANLVFSPGIDAFYAQCARVGVDSVLVADVPVEESAPFRQAAMRHNIAPIFICPPNADDDLLRQIASYGRGYTYLLSRAGVTGAENRAALPLHHLVEKLAEYHAAPPLQGFGISAPEQVSAAIDAGAAGAISGSAIVKIIERHLDEPQTMLDELKAFVQSLKAATKTA

SEQ ID NO: 24827 - protein, 496 aa, Pisum sativum
MAATGVLAEIIDGDVYKYYADGEWKKSTSGKSVAIINPTTRKPQYKVQACSQEEVNKVMDSAKSAQKSWAKTPLWKRAELLHKAAAILKEHKAAIAECLVKEIAKPAKDAVTEVVRSGDLVSYCAEEGVRILGEGKFLVSDSFPGNERTKYCLTSKIPLGVILAIPPFNYPVNLAVSKIAPALIAGNSIVLKPPTQGAVAALHMVHCFHLAGFPKGLISCVTGKGSEIGDFLTMHPGVNCISFTGGDTGIAISKKSGMIPLQMELGGKDACIVLEDADLDLVAANIIKGGFSYSGQRCTAVKVVLVMESVADALVEKVKVKVAKLSVGPPEDDSDITPVVSESSANFIEGLVNDAKEKGATFCQEYKREGNLIWPLLLDNVRPDMRIAWEEPFGPVLPVIRINSVEEGIHHCNASNFGLQGCVFTKDINKAIMISDAMESGTVQINSAPARGPDHFPFQGIKDSGIGSQGITNSINMMTKVKTTVINLPSPSYTMG

SEQ ID NO: 24828 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 24829 - protein, 294 aa, Vigna unguiculata
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSSMLSLDPSKRITARIAVEHEYFKDIKFVP

SEQ ID NO: 24830 - protein, 252 aa, Geobacillus stearothermophilus
RKPIIAGNWKMNGTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGALVGGASLEPASFLQLVEAGRHE

SEQ ID NO: 24831 - protein, 240 aa, Bacillus cereus ATCC 10987
MRDKSVASSYVTTVKLDSFREIAYSKELKRKLLAEFIGTFTLVFAGTGAIIVNSITQSLTHIGVAITFGLVVLALIYSFGHISGAHFNPAVTIALLSAKEISRREAILYILIQMIGASFASLFLLSIFGDIANLGATLPSQSWTQSFILEFVLTFILMMVIFASATHGKATKSFAGVAIGSTVALEAMFGGPISGASMNPARSFGPALISGTFEYLWIYLVATTLGALLAAIVYKFIHEQ

SEQ ID NO: 24832 - protein, 248 aa, Bacillus cereus ATCC 10987
MGIIEISNLKKSYGNLDVLKRISFDINKNDVIAVIGPSGSGKSTMLRSLVYLEELDNGSICVSGDYLVKDGVYAIPQEIRQITGKMGMVFQHFNLFPHLTVKENLELAPKMLKKELSADIHQRSGELLERIGLSDRANAYPANLSGGQKQRVAIARALMMNPEFMLFDEPTSALDPELTGEVLQVMKDLAQEQMTMIVVTHEMGFAKEVANKVIFMDNGEIVESGNPTDLFMNPKFERTKAFLNRSLK

SEQ ID NO: 24833 - protein, 277 aa, Lactococcus lactis
MMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 24834 - protein, 395 aa, Pleurotus djamor
MPLSSNAPVPGAKEFYPLNDPEIGTDEKIPLLFQPVTIGGTTFKNRIFVSPMCQYSSSNGHATDWHLVHIGGFATRGAAAIIMEATAVVPEGRISPEDAGIWTDSQIEPLRRIVQFCHAQGTKIGIQLAHAGRKASTLALWVKNNYAAASVEQGGWPDDVYGPSTIPFADKFATPKEMDEAHLTYVENAFVEAIERCEEVGFDFIEIHSAHGYLFHSFLSNLSNVRTDSYGGQPLENRLRFPLRVIKSCREAWSKPLFVRISASDWAEGPEKADDGTWKQWGIEQSKVLAGELVKIGVDLVDCSSGGNWAQQKIPFSHGYQVPFAESLKKAYPSLNVGAVGLISDPEKAEGYLQEGKADIILLARELLRNPHWPLTAAKALGVSMKVANQYERAA

SEQ ID NO: 24835 - protein, 396 aa, Pleurotus djamor
MPLRGNAPVPGAKEFYPLNDPEIGTDEKVPLLFQPITIGGTTFKNRIFVSPMCQYSSSNGHATDWHLVHIGGFATRGVGAIIMEATSVVPEGRISPEDAGLWTDTQIEPLKRIVQFCHAQGTKIGIQLAHAGRKASTLAPWARGGAYIAPVEQGGWPDDVYGPSTLPFHEKFPTPKEMDEPHLTYVENAFVEAIERCEEVGFDFIEIHSAHGYLFHSFLSNLSNDRTDSYGGQPLENRLRFPLRVIKSCREAWSKPLFVRISASDWADRPEQGDDGLWKQWGIEQTKVLVGELLKIGVDFVDCSAGGNWAEQKIPLSHGYQVPFAESLKKAYPGLNVGTVGLISDPEKAEGYLQEGKADVILLARELLRNPHWPLTAAKALGVYLKVANQYERAVV

SEQ ID NO: 24836 - protein, 466 aa, Atherosperma moschatum
SVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQTETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYIEKDRSRGIYFTQDWVSLPGVMPVASGGIHVWHMPALTEIFGDDSVLQFGGGTLGHPWGNAPGAVANRVALEACVQARNEGRDLASEGNEIIREASKWSPELAAACEVWKEIKFEFQAMDTL

SEQ ID NO: 24837 - protein, 465 aa, Steganthera hirsuta
  misc_feature (241)..(241): Xaa can be any naturally occurring amino acid
VGFKAGVKDYKLTYYTPDYDTKNTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPIAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMXKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 24838 - protein, 453 aa, Emericella nidulans
MTSNGTNGSATAYHASSTQEAIQAENDFAAHNYHPLPVVFARAQGTSVWDPEGRHYLDFLSAYSAVNQGHCHPKLVAALVDQASRLTLSSRAFYNDVFPKFAEMVTKYFGFDMVLPMNTGAEAVETGIKIARKWGYKVKGIPENEAIILSAENNFHGRTMAAISLSSDPESRENYGPYVPNIGCTIPGTEKPITYNDKAVREAFEKAGSNLAAFLVEPIQGEAGIIVPDDDYLQLARSLCDQHNVLLICDEIQTGIARTGKLLCHEWSGIKPDMVLLGKAISGGMYPVSCVLGRKDVMLTVEPGTHGSTYGGNPLACAVAIRALEVVQEENMVERAEKLGQAFRSGLEAIQNPIIQTVRGKGLLNAIVIDESKTNGHTAWDLCMLMKEKGLLAKPTHQNIIRLAPPLVITEEEIAKALEIIKAAVAELPNLKGAAEDKVVPPPEKKVKITLEN

SEQ ID NO: 24839 - protein, 459 aa, Streptococcus pneumoniae
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 24840 - protein, 510 aa, Arabidopsis thaliana
MAYVGLVEVFIALLVFFFFHFLIHKKSHQITPRNWPVLGMLPGVLVMLHRINDYVAEILEVSNLTFAFKGPWFSGMNMLITADPSNIQHVFSSNFSNYDKGPEFKEMFDFLGNGIFTADSKLWEDMRKSALVVLSHQGFQSFSLRTITCKIKNGLVPVLDHFAEANTVFDLQDVFQRLAFDVTLTLVTGCDSSSLSIEMPKNEYAKAMDDAEEVVVYRHVKPVVLWKLQNWIGLGEEKKMKEANAAFDRSCAKYISAKREEIISHHSNIGGEAHAEDLLSVYMNLDISKYELLNPNDDNFLKDIIKSFMLAGRDAIATTLTWFFWLLSKNPEAVTKIRQEINTNLPGSGMSLDADKLNKMVYLHGALCESLRLYAPIPFERKTPIKQDVLPSGHMVDKNWKILFSVYALGRMRSVWGQDASEFKPERWISERNGGLKHEPSFKFFVFNSGPRNCLGKNLSFLQMKTVAVEIIRNYDIKVVEGHKIEPASSIILHMKHGLKVTVSKRGLVS

SEQ ID NO: 24841 - protein, 271 aa, Nicotiana tabacum
MDDYLNLFIEETSFYNRVVLGTFLPESWWGPLPHWFQGWLRNYIGGVLLYFISGFLWCFYIYRLKRNVYIPKDAIPSNRAMLLQIGVAMKAMPFYCALPSLSEYMIVNGWTKCFSRISDVGWLSYLIYMAVYLVIVEFGIYWMHRELHDIKLLYKYLHATHHIYNKQNTLSPFAGLAFHPLDGILQAVPHVVALFLLPEHFTTHIALLFIEAIWTANIHDCKHAKVWPVMGAGYHTIHHTTYRHNYGHYTIWMDWMFGTLRDPVEDEVKKM

SEQ ID NO: 24842 - protein, 361 aa, Rhizomucor pusillus
AEGDGSVDTPGLYDFDLEEYAIPVSIGTPGQDFYLLFDTGSSDTWVPHKGCDNSEGCVGKRFFDPSSSSTFKETDYNLNITYGTGGANGIYFRDSITVGGATVKQQTLAYVDNVSGPTAEQSPDSELFLDGIFGAAYPDNTAMEAEYGDTYNTVHVNLYKQGLISSPVFSVYMNTNDGGGQVVFGGVNNTLLGGDIQYTDVLKSRGGYFFWDAPVTGVKIDGSDAVSFDGAQAFTIDTGTNFFIAPSSFAEKVVKAALPDATESQQGYTVPCSKYQDSKTTFSLVLQKSGSSSDTIDVSVPISKMLLPVDKSGETCMFIVLPDGGNQFIVGNLFLRFFVNVYDFGKNRIGFAPLASGYEND

SEQ ID NO: 24843 - protein, 113 aa, Saccharomyces cerevisiae
SEVIEGNVKIDRISPGDGATFPKTGDLVTIHYTGTLENGQKFDSSVDRGSPFQCNIGVGQVIKGWDVGIPKLSVGEKARLTIPGPYAYGPRGFPGLIPPNSTLVFDVELLKVN

SEQ ID NO: 24844 - protein, 176 aa, Dendrobium grex Madame Thong-In
LPSLNAGGARLMKSTGTIGNRVASINVENAETNRRALRELLFCAPGALQYLSGVILFEETLYQKTAGGKPFVEVLNEGGVLPGIKVDKGTVELAGTNGETTTQGLDDLGKRCAKYYEAGARFAKWRAVLKIKSHSAFPAFYQSECLWTSSHAIICQENGLEAKHGHQKKRISLSII

SEQ ID NO: 24845 - protein, 128 aa, Dendrobium grex Madame Thong-In
IMLSDIFFFGGPFSGAAGTKKQKYEKISERKVSTSIEALCRGYPSEFASYFHYCRSLRFDDKPDYAYLKRIFRDLFIRLGFQFIMCLIGPFLNISSPKLILLKPSAKLLGLGLACHQPLDTQHLVRVN

SEQ ID NO: 24846 - protein, 346 aa, Hydrogenophilus thermoluteolus
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEATRRTTPTSTRSS

SEQ ID NO: 24847 - protein, 494 aa, Escherichia coli
MHPTGPHLGPDVLFRESNMKVTLTFNEQRRAAYRQQGLWGDASLADYWQQTARAMPDKIAVVDNHGASYTYSALDHAASCLANWMLAKGIESGDRIAFQLPGWCEFTVIYLACLKIGAVSVPLLPSWREAELVWVLNKCQAKMFFAPTLFKQTRPVDLILPLQNQLPQLQQIVGVDKLAPATSSLSLSQIIADNTSLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNVLEKQPADLSALRFFLCGGTTIPKKVARECQQRGIKLLSVYGSTESSPHAVVNLDDPLSRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMSDERLGERS

SEQ ID NO: 24848 - protein, 397 aa, Mycoplasma hominis
MAKLDFDRSKPHVNIGTIGHVDHGKTTLTAAIATVLAKKGLAEARDYASIDNAPEEKARGITINTSHIEYQTEKRHYAHVDCPGHADYVKNMITGAAQMDGAILVVAATDGPMPQTREHILLARQVGVPKIVVFLNKIDMFKDDEREEMVGLVEMDVRSLLSEYGFDGDNAPIIAGSALKALQGDPEYEKGILELMDAVDTYIEEPKRETDKPFLMAVEDVFTITGRGTVATGRVERGVLQLNEEVEIVGLKPTKKTVVTGIEMFRKNLKEAQAGDNAGLLLRGIDRSEVERGQVLAKPKTIVPHTQFEATVYVLKKEEGGRHTPFFHNYKPQFYFRTTDVTGGIEFKPGREMVVPGDNVELTVTLIAPIAIEEGTKFSIREGGRTVGAGSVTKILK

SEQ ID NO: 24849 - protein, 335 aa, Nicotiana tabacum
MVHEKQVIEEVSGWLRVFEDGSVDRTWTGPPEVKFMAEPVPPHDYFIDGVAVKDVVADEKSGSRLRIYLPERNDNSASKLPVILHFQGGGFCVSHADWFMYYTVYTRLARAAKAIIVSVFLPLAPEHRLPAACDAGFAALLWLRDLSRQQGHEPWLNDYADFNRVFLIGDSSGGNIVHQVAVKAGEENLSPMRLAGAIPIHPGFVRSYRSKSELEQEQTPFLTLDMVDKFLGLALPVGSNKDHQITCPMGEAAPAVEELKLPPYLYCVAEKDLIKDTEMEFYEAMKKGEKDVELFINNGVGHSFYLNKIAVRMDPVTGSETEKLYEAVAEFINKH

SEQ ID NO: 24850 - protein, 508 aa, Nicotiana tabacum
MAIENNNNGVNFCTVKRPKTKIVCTLGPASRSVPMIEKLLRAGMNVARFNFSHGSHDYHQETIDNLRQAMESTGILCAVMLDTKGPEIRTGFLKDAKPVQLKQGQEITISTDYSIKGDESMICMSYKKLAEDVKPQSVILCADGQITFTVLSCDKENGLDRCRCENTAVLGERKNVNLPGVIVDLPTLTDKDKDDILNWGVPNHIDMIALSFVRKGSDLVEVRKLLGEHAKNILLMSKVENQEGVANFDDILLNSDAFMVARGDLGMEIPIEKIFLAQKVMIYKCNIQGKPVVTATQMLESMIKSPRPTRAEATDVANAVLDGTDCVMLSGETAAGAYPDLAVGTMAKICIEAESTIDYPDVFKRIMSNAPVPMSPLESLASSAVRTANSAKAALILVLTRGGSTAKLVAKYRPGMPILSVVVPEIKTDSFDWTCSDESPARHSLIFRGLVPVLHAGSARASHEESTEEALDFALQHAKTKGLCKQGDSVVALHRVGTASVIKIVTVK

SEQ ID NO: 24851 - protein, 296 aa, Streptomyces coelicolor A3(2)
MSTLPKVAWIGLGIMGSPMSENLIKAGYQVTGFTLEQEKLDRLAAAGGGVAGSIAEAVRDADVVVTMVPASPQVEAIAYGPDGILENAKSGALLVDMSSITPQTSVDLAKAAKDKGIRVLDAPVSGGEAGAIEAVLSIMVGGEQADFDEAKPLLEALGKTIVLCGPHGSGQTVKAANQLIVAVNIQACAEAVVFLEKSGVDLKAALDVLNGGLAGSTVLTRKKDNFLGRDFKPGFRIDLHHKDMGIVTDAARNVGAALPVGAVVAQLVASLRAQGDGGLDHSALLRAVERLSGDQV

SEQ ID NO: 24852 - protein, 319 aa, Prunus persica
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEQGYLKKAFYGTNGPTFGTKVSNYPPCPKPELIKGLRAHTDAGGLILLFQDDKVSGLQLLKDGQWIDVPPMRHSIVINLGDQLEVITNGKYKSVEHRVIAQTDGTRMSIASFYNPGSDAVIYPAPTLVEKEAEEKNQVYPKFVFEDYMKLYAGLKFQPKEPRFEAMKAVETNISLGPIATA

SEQ ID NO: 24853 - protein, 323 aa, Glycine max
AKGQTPLFPRIFGHEASGIVESVGEGVTHLKPGDHALPVFTGECGDCAHCKSEESNMCELLRINTDSGVMIHDGQSRFSKNGQPIHHLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEVNKAFDLMLKGQSIRCIIRMQE

SEQ ID NO: 24854 - protein, 1006 aa, Schizosaccharomyces pombe
MVATDSSDQVAKFDVSHKIIEDIVYSLSNRIFSYAEHVPLNRYLTQWNNSGRRNGFSNNVELFNLEARSGASAFLLGSYTAAISSPGVYSMMTPSSCLSLLNPLLSNIIPFYGASKPLVVHVAALAYLEQTYCADNVSVLDFSYANNFTVFASQSNVEAAHLALASTLAAKAAPVIHVYEPDAIVTTTDPSLPLLDSNAVVECFNSYQSEADPVSNASKALKHVNDYFNTSYAPAEYYGSQTASKVIVTFGKSETVAARALLAANPDVGVLSIRIFPFVAENIFNVLPTTCKSLVVLSQVRSTAVGTSSIYYSFLLATLLSTKPSALAISEHRYSLVESVTLSSLFDALHETLQLKAATPKAVHVDKSINVWESDVGDSLVLSLVSAYRTDKSRSVAFRPLFDNLTLAGVRFTVAQVSTANAVLTDVVKDVDADITILTTDRLPLHYRVLAKAAEHSICLLQSSIAPDEATKKLPYEFIADALEKGVKLVLIDPKKFAIDASNLPLLVSFIQLVKPGLGVDEALAVLAKQNNLTDTNLKDAVDSLKQSLSFINLDASALKDREPSEKELPSTAKETSFAPNAVKTLDEDITPQSSNWQTVAKQIIFPEAYKKKDALRPDVSEKVFTVHVRANKRLTPAEYNRNIFHIEFDLGDSGLTYDIGEALGVYGVNNKTHVHDFIEEYGLDANELIHVPSIQHPGHWETRTVFQALCQNIDIFGKPTKKFHEQLLEFETDEKERADLQILISPAGAPDFKRRAEVDMLTYADVLKEFKHAKLTAAQIAQIVPVIKRREYSISSSQKKHNDSVHLLVVVVGWKDGMGRDRYGQCSHYLSNLKVGEPLCVAVKTSVMKLPTSPLKPIVMAGLGTGLAPFRAFLQFKEWQRMQGIESGDILLYLGSRTQREEYLYGEDWEAYHSANLLTHIGQAFSRDQPYKIYIQDVMRSTKDMLKKALMDEGGSFYLCGPTWPLPEITSVLEEVIQSSYDEPVDARKIIEQWKEERRFVIEVY

SEQ ID NO: 24855 - protein, 503 aa, Capsicum annuum
MAIGSLARRKASTILSSSRYVSKYSSYYFSRSFASGSDENDVVVIGGGPGGYVAAIKAAQLGLKTTCIEKRGTLGGTCLNVGCIPSKALLHSSHMFHEAQHSFAQHGVKFSSVEVDLPAMMSQKDKAVAGLTRGIEGLFKKNKVNYVKGYCKFLSPSEVSVDTIDGGNTVVKGKNIIIATGSDVKSLPGLTIDEKRIVSSTGALALTEVPKNLVVIGAGYIGLEMGSVWGRLGSQVTVVEFASDIVPTMDGEVRKQFQRSLEKQKMKFMLKTKVVSVDTAGDVLKLTLEPAAGGEQTTLEADVVLVSAGRVPFTSGLGLDKIGVETDKAGRILVNERFASNVTGVYAIGDVIPGPMLAHKAEEDGVACVEFIAGKEGHVDYDLVPGVCYTHPEVASVGKTEEQVKALGLDYRVGKFPFLANSRAKAIDDAEGIVKVLAEKETDKILGVHIMAPNAGELIHEAVLALHYGASSEDIARTCHAHPTMSEALKEAAMATYDKPIHI

SEQ ID NO: 24856 - protein, 381 aa, symbiont bacterium of Paederus fuscipes
MRILADENIPLVDAFFSDQGSIRRLPGRVIDRSALVNTDVLLVRSLTDVNHALLEGSPVRFVGTCTIGTDHLDLDYLAKAGIAWSNAPGCNARGVVDYVLGCLLTLAESRGARLAERTYGVVGAGQVGRCLIKVLRSLGWKVLVCDSPRQARELEGDFVSLDHLLAETNVISLHTPLIHDGKYPTHHLLDTKRLATLQPGTWLINASRGAVIDSQALRQCLATGIDLEVVLDVWEGEPEVDVELAEHCLIATPHIAGYSLEGKLRGTAQVYRAFCAWYDIAPSVSLEQVLPEPWLAGLCLNASCDPDWALAMLCRAVYDPRRDDAAFRRSLAGDTVTRRSAFDALRKHYPPRREITSLRVTVADRRPELLQLVQALGAQLS

SEQ ID NO: 24857 - protein, 497 aa, symbiont bacterium of Paederus fuscipes
MTTPTRADWEIRAKDLNIEGRAFVNGEYRNAASGETFDCLSPVDGRFLAKVASCDQADAEQAVKAARAAFDSGVWSRLAPAKRKRTMIRFADLLLKNAEELALLETLDMGKPISDSLHIDVSSAANSIYWNAEAIDKIYDEVAATPHEELGLVTREPVGVVTAIVPWNFPLLMACWKLGPALATGNSVILKPSEKSPLTAIRIACLATDAGIPTGVFNVLPGYGHTVGKALALHMDVDTLVFTGSTRIAKQLMIYAGESNMKRIWLEAGGKSPNIVFADAPDLKAAAEAAASAIAFNQGEVCTAGSRLLVERSIKDRFLPLVVEALKGWKPSNPLDPDTNVGALVDTQQLHTVLSYIEAGHKDGARLMVGGKRILEETGGVYVEPTLFDGVDNAMKIAREEIFGPVLSVITFENAEEAVRIANNTQYGLAAAVWTSDLSKAHLTAKALRAGSVWINQYDGGDMTAPFGGFKQSGNGRDKSLHAFDKYTELKATWIKL

SEQ ID NO: 24858 - protein, 310 aa, Streptomyces coelicolor A3(2)
MNWAYSASRQRGDESLRAVHRALDLGVSLLDTADMYGPFTNELLLGRVLRERRSEAFVSTKVGLLVGEQHIVANGRPGYVRRACDASLRRLQTDVIDLYQLHRADPEIPVEETWGAMAELVRAGKVRALGLCAVGARSARRPGARLHDATIRQLERVQQVFPVSAVEAELSVWSPEALRTLLPWCVSRGVGFLAAMPLGNGYLTGTLTPGQGFEPEDLRARHPRFTAEMMAANQPIVAALRRIAARHGDGVTAAQVALAWVLAQGRHVVPVPGTKQERWVTQNAGAARLRLTERDLAEVRVLPPGQGSWE

SEQ ID NO: 24859 - protein, 502 aa, Glycine max
MDFTTPPIEDGFTAEKLFTQGFSYTYDDVIFLPHYIDFAADAVDLSTRLTRRLPLAVPFVASPMDTVSESAMAAAMASLGGIAVVHSNVPAAVQAAILRRAKSRRVPILSDPAFAAPSAVVEHDDAFGASPFLLVTDTGTSVGKLLGYVARSDWTNQTDKGLRVGDYMAPPPKPAPWNADLNKINEIMESEKSGAVALERDGEVVDLVVREEVERVRGYPKLVAPATVGADGEFMVGAAVGTREDDKERLEHLVKAGLNVVVLDSSQGNSIYQLEMVNYVKRVYPELDVIGGNVVTMYQAENLIQAGVDGLRVGMGSGSICTTQEVCAVGRGQATAVYNVSLIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 24860 - protein, 258 aa, Streptomyces coelicolor A3(2)
MTTRTPLMAGNWKMNLNHLEAIAHVQKLAFALADKDYDAVEVAVLAPFTDLRSVQTLVDGDKLKIKYGAQDISAHDGGAYTGEISGPMLAKLKCTYVAVGHSERRQYHAETDEIVNAKVKAAYKHGLTPILCVGEELDVREAGNHVEHTLAQVEGGLKDLAAEQAESVVIAYEPVWAIGTGKVCGADDAQEVCAAIRGKLAELYSQELADKVRIQYGGSVKSGNVAEIMAKPDIDGALVGGASLDSDEFVKIVRFRDQ

SEQ ID NO: 24861 - protein, 403 aa, Streptomyces coelicolor A3(2)
MKTIDELLSEGVAGKRVFVRADLNVPLDGTTITDDGRIRAVVPTVKALADAGARVIVASHLGRPKGAPDPAFSLAPAAARLGELLGADVAFAEDTVGSSAEAVVTGLADGGVAVIENLRFNAGETSKDDAERAAFADKLAGLADVYVGDGFGAVHRKHASVFDLPKRLPHYAGYLIATEVGVLKKLTDEVKRPYVVALGGAKVSDKLAVIDQLLGKADRLLIGGGMAYTFLKAKGYEVGISLLQEDQIPAVKEYIERAEKNGVELVLPVDVLVAPEFPDLKTKAPANPTTVAADAIPADQEGLDIGPETRKLYASKLADAGTVFWNGPMGVFEHPDYAEGTKAVAQALVDAPGFTVVGGGDSAAAVRTLGFDENAFGHISTGGGASLEYLEGKTLPGLAALED

SEQ ID NO: 24862 - protein, 302 aa, Streptomyces coelicolor A3(2)
MIVVAGEALIDLVPQGTGALAALRPALGGGPYNTAVALGRLGSPVAFCSRVSYDGFGEALLDRLRETGVDVSPVQRGAEPTTLAVASLDADGSAAYSFYVEGTADRMFALPAALPSGTRAVSFGTCSLVLEPGASAYEELLRETAARGVFTALDPNIRAGLIPDPDAYRARFKSWLPSVSLLKLSAEDAEWLGGTPREWLAAGPAAVVVTRGGDGLTAFTRDGGEYTVPGERVEVVDTIGAGDTVNAALLHGLAARGALRDADLAALGPDGWAGLLGFAARAAAVTCSRAGAEPPYAHEVAA

SEQ ID NO: 24863 - protein, 446 aa, Methanococcus voltae
MTSLEMALEYIKINNVKFLRFQFVDIHGEPKNIAYPVKLGTADGEEELMGVLENGLFFDGSSIEGFVEIEDSDMVLKPDLSTLSVLPWRPSEKSVARIICDVYRKNGKPFEGDPRGCLKRVLAEFKEEFKGEYFVGPEPEFFILKNENGKWVPGDDAGYFELEPLDEGNDLRRNIVFALENLGFHVEASHHEVAPGQHEVDFKYDNAVKTADSVITFKTTIKTLAKQSGVLATFMPKPFFGMNGSGMHCNQSIWLDGKPSFYDENNAHQLSDICLSYIGGILEHTKALVSVTNPTVNSYKRLVPGYEAPVNIAWANSNRTSIIRVPAARGKGTRVEFRAPDPACNPYLAFTVMLAAGLDGVRRKLIAPEPVEKNIFAMSEAEKREANIDSVPSNLYDAIEELRQDKVLKKALGDHIFNKFIEIKTKEYDAYRTAVTDWEFNKYVRI

SEQ ID NO: 24864 - protein, 197 aa, Capsicum annuum
MRFIALVFLVGALAIIAVECNSEGDALNAFKMNMLDPNNALQSWDPTLVNPCTWLHVTCNIQNSVTRVDLGGANLSGILTPQLGVLYNLQYLQVENNSISGAIPRELRNLTNLLSLGLENNKLSGTIPSSLGNLKSLRWMRLNSNRLSGEIPISVLKLVLWGNLQLMNVSDNKLAGTVPLANKTGFAITTIVQDMKA

SEQ ID NO: 24865 - protein, 136 aa, Methanococcus vannielii
MGIKDIDIKENFGKIVQNMDLKFRKIDDKELLIAIAIDKYKNVLMTAFMDKESLKMTLKTGLMHYFSTSRNKIWMKGEESKNVQKVLEVFKDCDGDALLFIVEQTGWACHEGYMSCFHNKVDLNTGNSTVIGDKLD

SEQ ID NO: 24866 - protein, 445 aa, Pisum sativum
GGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQMYDTDRSGCIT

SEQ ID NO: 24867 - protein, 333 aa, Nicotiana tabacum
MSKARVYTDINVLRPREYWDYESLTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQSRLTAKEAMAHPYFLQVRAAETSRMRTQ

SEQ ID NO: 24868 - protein, 159 aa, Citrobacter koseri
FAGYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRKGMA

SEQ ID NO: 24869 - protein, 159 aa, Citrobacter koseri
LLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRKGMA

SEQ ID NO: 24870 - protein, 158 aa, Citrobacter koseri
SLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRKG

SEQ ID NO: 24871 - protein, 159 aa, Citrobacter freundii
TSLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKG

SEQ ID NO: 24872 - protein, 160 aa, Citrobacter freundii
SLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGIMPEEWGGESQFVHVSAKAGTGIDELLDAILLQAEVLELKAVRKGMA

SEQ ID NO: 24873 - protein, 286 aa, Enterobacter aerogenes
KTSLLDYIRSTKVASGEAGGITQHIGAYHVETDNGMITFLDTPGHAAFTSMRARGAQATDIVVLVVAADDGVMPQTVEAIQHAKAAQVPVVVAVNKIDKPEADMDRVKNELSQYGVMPEEWGGEAQFIPVSAKVGTGIDDLLNAILLQAEVLELKAVRNGMASGAVIESFLDKGRGPVATVLVREGTLHKGDIVLCGFEYGRVRAMRDELGREVLEAGPSIPVEILGLSGVPAAGDEVTVVRDEKKAREVALYRQGKFREVKLARQQKSKLENMFANMTEGEVHEV

SEQ ID NO: 24874 - protein, 286 aa, Enterobacter cloacae
KTSLLDYIRSTKVASGEAGGITQHIGAYHVETENGMITFLDTPGHAAFTSMRARGAQATDIVVLVVAADDGVMPQTIEAIQHAKAAQVPLVVAVNKIDKPEADMDRVKNELSQYGVMPEEWGGEAQFIPVSAKAGTGIDDLLNAILLQAEVLELKAVRKGMASGAVIESFLDKGRGPVATVLVREGTLHKGDIVLCGFEYGRVRAMRNELGQEVLEAGPSIPVEILGLSGVPAAGDEVTVVRDEKKAREVALYRQGKFREVKLARQQKSKLENMFANMTEGEVHEV

SEQ ID NO: 24875 - protein, 284 aa, Enterobacter cloacae
SLLDYIRSTKGVSGEAGGITQHIGAYHVETENGMITFLDTPGHAAFTSMRARGAQATDIVVLVVAADDGVMPQTIEAIQHAKAAQVPLVVAVNKIDKPEADMDRVKNELSQYGVMPEEWGGEAQFIPVSAKAGTGIDDLLNAILLQAEVLELKAVRKGMASGAVIESFLDKGRGPVATVLVREGTLNKGDIVLCGFEYGRVRAMRNELGQEVLEAGPSIPVEILGLSGVPAAGDEVTVVRDEKKAREVALYRQGKFREVKLARQQKSKLENMFANMTEGEVHEV

SEQ ID NO: 24876 - protein, 286 aa, Enterobacter cloacae
KTSLLDYIRSTKGVSGEAGGITQHIGAYHVETENGMITFLDTPGHAAFTSMRARGAQATDIVVLVVAADDGVMPQTIEAIQHAKAAQVPLVVAVNKIDKPEADMDRVKNELSQYGVMPEEWGGEAQFIPVSAKAGTGIDDLLNAILLQAEVLELKAVRKGMASGAVIESFLDKGRGPVATVLVREGTLHKGDIVLCGFEYGRVRAMRNELGQEVLEAGPSIPVEILGLSGVPAAGDEVTVVRDEKKAREVALYRQGKFREVKLARQQKSKLENMFANMTEGEVHEV

SEQ ID NO: 24877 - protein, 159 aa, Escherichia coli
KTSLLDYIRSTKVASGEAGGITQHIGAYHVETENGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRK

SEQ ID NO: 24878 - protein, 284 aa, Enterobacter cloacae
SLLDYIRSTKVASGEAGGITQHIGAYHVETDNGMITFLDTPGHAAFTSMRARGAQATDIVVLVVAADDGVMPQTIEAIQHAKAAQVPLVVAVNKIDKPEADMDRVKNELSQYGVMPEEWGGEAQFIPVSAKAGTGIDDLLNAILLQAEVLELKAVRKGMSNGAVIESFLDKGRGPVATVLVREGTLDKGDIVLCGFEYGRVRAMRNELGQQVLEAGPSIPVEILGLSGVPAAGDEVTVVRDEKKAREVALYRQGKFREVKLARQQKSKLENMFANMTEGEVHEV

SEQ ID NO: 24879 - protein, 158 aa, Hafnia alvei
TSLLDYMRSTKVASGEAGGITQHIGAYHVQTDNGMITFLDTPGHAAFTSMRARGAQATDIVVLVVAADDGVMPQTIEAIQHAKAAKVPVVVAVNKIDKPEADMDRVKNELSQYGVMPEEWGGESQFIPVSAKAGTGIDDLLDAILLQAEVLELKAVRS

SEQ ID NO: 24880 - protein, 165 aa, Klebsiella oxytoca
KTSLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRKGMASGA

SEQ ID NO: 24881 - protein, 160 aa, Klebsiella oxytoca
TSLLDYIRSTKVASGEAGGITQHIGAYHVETDNGMITFLDTPGHAAFTSMRARGAQATDIVVLVVAADDGVMPQTIEAIQHAKAAQVPLVVAVNKIDKPEADLDRVKNELSQYGVMPEEWGGEAQFIPVSAKAGTGIDDLLNAILLQAEVLELKAVRNGM

SEQ ID NO: 24882 - protein, 156 aa, Klebsiella oxytoca
KTSLLDYIRSTKVASGEAGGITQHIGAYHVETDNGMITFLDTPGHAAFTSMRARGAQATDIVVLVVAADDGVMPQTIEAIQHAKAAQVPLVVAVNKIDKPEADLDRVKNELSQYGVMPEEWGGEAQFIPVSAKAGTGIDDLLNAILLQAEVLELKA

SEQ ID NO: 24883 - protein, 272 aa, Klebsiella pneumoniae
QDSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMASGAVIESFLDKGRGPVATVLVREGTLHKGDIVLCGFEYGRVRAMRDELGREVLEAGPSIPVEILGLSGVPAAGDEVTVVRDEKKAREVALYRQGKFREVKVARQQKSKLE

SEQ ID NO: 24884 - protein, 150 aa, Klebsiella pneumoniae
DYIRSTKVASGEAGVITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELK

SEQ ID NO: 24885 - protein, 161 aa, Klebsiella pneumoniae
TSLLDYIRSTKVVSGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMA

SEQ ID NO: 24886 - protein, 161 aa, Klebsiella pneumoniae
NSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMA

SEQ ID NO: 24887 - protein, 166 aa, Klebsiella pneumoniae
VDHGKTSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMA

SEQ ID NO: 24888 - protein, 161 aa, Listeria monocytogenes
KAHTRFPRNTKVTLGEAGGITQHIGAYQLEIHDKKITFLDTPGHAAFTAMRARGAQITDITILVVAADDGVMPQTIEAINHAKAAGMPIIVAVNKIDKPQANPDRVMQELTEYELVPEAWGGDTIFAPISAKFGEGLENLLDMILLVSEVEELKANPDRRA

SEQ ID NO: 24889 - protein, 157 aa, Listeria monocytogenes
RFPRNTKVTLGEAGGITQHIGAYQLEIHDKKITFLDTPGHAAFTAMRARGAQITDITILVVAADDGVMPQTIEAINHAKAAGMPIIVAVNKIDKPQANPDRVMQELTEYELVPEAWGGDTIFAPISAKFGEGLENLLDMILLVSEVEELKANPDRRA

SEQ ID NO: 24890 - protein, 158 aa, Listeria monocytogenes
TRFPRNTKVTLGEAGGITQHIGAYQLEIHDKKITFLDTPGHAAFTAMRARGAQITDITILVVAADDGVMPQTIEAINHAKAAGMPIIVAVNKIDKPQANPDRVMQELTEYELVPEAWGGDTIFAPISAKFGEGLENLLDMILLVSEVEELKANPDRRA

SEQ ID NO: 24891 - protein, 159 aa, Morganella morganii
LLDYIRSTKVASGEAGGITQHIGAYHVTTDKGAITFLDTPGHAAFTSMRARGAQATDIVVLVVAADDGVMPQTIEAIQHAKAAGVPVVVAVNKIDKPEADPDRVRNELSQYGILSEEWGGETQFISVSAKKGIGIDDLLDAILLQAEVLELKAVRAGMA

SEQ ID NO: 24892 - protein, 167 aa, Morganella morganii
LLDYIRSTKVASGEAGGITQHIGAYHVTTDKGAITFLDTPGHAAFTSMRARGAQATDIVVLVVAADDGVMPQTIEAIQHAKAAGVPVVVAVNKIDKPEADPDRVRNELSQYGILSEEWGGETQFISVSAKKGIGIDDLLDAILLQAEVLELKAVRAGMASGVVIESY

SEQ ID NO: 24893 - protein, 192 aa, Morganella morganii
LLDYIRSTKVASGEAGGITQHIGAYHVTTDKGAITFLDTPGHAAFTSMRARGAQATDIVVLVVAADDGVMPQTIEAIQHAKAAGVPVVVAVNKIDKPEADPDRVRNELSQYGILSEEWGGETQFISVSAKKGIGIDDLLDAILLQAEVLELKAVRAGMASGVVIESYLDKGRGPVATILVQSGTLNKGDIVL

SEQ ID NO: 24894 - protein, 153 aa, Pantoea agglomerans
LLDYIRSTKMASGEAGGITQHIGAYHVETDNGMVTFLDTPGHAAFTAMRARGAQATDIVILVVAADDGVMPQTVEAIQHAKAAKVPVVVAVNKCDKPEADPDRVKNELTQYGIIPEEWGGENMFVNVSAKAGTGIDDLLNAILLQAEVLELTA

SEQ ID NO: 24895 - protein, 157 aa, Pantoea agglomerans
TSLLDYIRSTKVASGEAGGITQHIGAYHVETDNGMITFLDTPGHAAFTAMRARGAQATDIVILVVAADDGVMPQTVEAIQHAKAAGVPVVVAVNKIDKPEADPDRVKNELTQYGIIPEEWGGENMFVNVSAKAGTGIDDLLNAILLQAEVLELTAIR

SEQ ID NO: 24896 - protein, 159 aa, Proteus mirabilis
LLDYIRSTKVASGEAGGITQHIGAYHVKTDKGEITFLDTPGHAAFTSMRARGAQVTDIVVLVVAADDGVMPQTIEAIQHAKAANVPVVVAVNKIDKPEADPDRVKTELSQYGILPEDWGGETQFIHVSAKQGLGIDELLDAILLQAEVLELKAVKEGMA

SEQ ID NO: 24897 - protein, 162 aa, Proteus mirabilis
ENLLLDYIRSTKVASGEAGGITQHIGAYHVKTDKGEITFLDTPGHAAFTSMRARGAQVTDIVVLVVAADDGVMPQTIEAIQHAKAANVPVVVAVNKIDKPEADPDRVKTELSQYGILPEDWGGETQFIHVSAKQGLGIDELLDAILLQAEVLELKAVKEGMA

SEQ ID NO: 24898 - protein, 154 aa, Salmonella enteritidis
SLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKA

SEQ ID NO: 24899 - protein, 155 aa, Salmonella enteritidis
TSLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKA

SEQ ID NO: 24900 - protein, 158 aa, Serratia liquefaciens
KTSLLDYIRSTKVAAGEAGGITQHIGAYHVETDNGMITFLDTPGHAAFTSMRARGAQATDIVVLVVAADDGVMPQTIEAIQHAKAAQVPLVVAVNKIDKPEADPDRVKQELSQYGVMPEEWGGEAQFVHVSAKAGTGIDELLNAILLQSEVLELKAVR

SEQ ID NO: 24901 - protein, 161 aa, Salmonella typhimurium
KTSLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAVRKGM

SEQ ID NO: 24902 - protein, 155 aa, Salmonella typhimurium
SLLDYIRSTKVASGEAGGITQHIGAYHVETDNGMITFLDTPGHAAFTSMRARGAQATDIVVLVVAADDGVMPQTIEAIQHAKAAGVPVVVAVNKIDKPEADPDRVKNELSQYGILPEEWGGESQFVHVSAKAGTGIDELLDAILLQAEVLELKAV

SEQ ID NO: 24903 - protein, 307 aa, Escherichia coli
MNAKVWVLGDAVVDLLPESEGRLLQCPGGAPANVAVGVARLGGNSGFIGRVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 24904 - protein, 305 aa, Medicago truncatula
MDNEEIPSVPSTPATPGTPGAPLFGGFRSERTGNGRKNSLLKNLKCFSVEDWTLEDGALPKVTCSLPPPPVPLAKKVGAEFIGTYILMFAGIATAIVNQKIHNSETLIGCAGATGLAVMIIILSTGHISGAHLNPAVTISFAALKHFPWKNVPLYIAAQVLASICASFTLKGVFHPFMSGGVTVPSVEYGQAFALEFIISFNLMFVVTAVATDTRAVGELAGIAVGATVMLNILIAGPATGASMNPVRTLGPAIAANNYKGIWLYLIAPILGALGGAGAYTAVKLPDEEFNSEVKASSAPGSFRR

SEQ ID NO: 24905 - protein, 356 aa, Saussurea medusa
MVAVSGNTRVESLATSGIHQIPKEYIRPQHELQTITNIFDEQNDQNAPQLPTIDLNDIHSHDPMTRQRCRDELTKAATEWGVMHLVNHGISGELIDRVKAAGESFFNQPVEEKERYCNDIGSGKIQGYGSKLANNACGQLEWEDYFFSSRLPRGERDLNVWPTTPDDYIPATTEYAKQLRALATKILSVLSLGLGLEEGRLEKEVGGMEELLLQLKINYYPKCPQPELALGVEAHTDVSALTFILHNMVPGLRLFYGGQWVTAKCVPDSIIVHIGDTIEILSNGKYKSILHRGLVNKEKVRISWAVFCEPPKEKIVLKPLPETVFEKEPPLFPPRTFHQHMEHKLFRKNNDIVDPK

SEQ ID NO: 24906 - protein, 191 aa, Pneumocystis carinii
MQTIKCVVVGDGAVGKTCLLISYTTNKFPSEYVPTVFDNYAVTVMIGEEPYTLGLFDTAGQEDYDRLRPLSYPQTDVFLICFSVTSPASFENVREKWHPEVRHHCPGTPCLIVGTQIDLRDDPMIVEKLSRQRQTPITKELGEKLSKELGAVKYVECSALTQKGLKNVFDEAIVCALEPPVTKKKTKCLIL

SEQ ID NO: 24907 - protein, 510 aa, Allium cepa
MPIPVLLLLTIFLALLLYLFFFVAKKHEGKRVPGPKGWPILGNLPQLGAKPHQSLCELSRTYGPLFGLRFGYVDVVVAASADVAEQFLRVHDVNFSNRPPNSGAEHIAYNYQDLVFAPYGPRWRMLRKLCALHLFSPKALEDLSPVRSLEVATLANTLYLRAQSDQPTVNLAQMLTTCTTNALSKAMMGRRVFVNETTDTETSKFKDMVLEIMSLAGVFNVGDFVPWLRPFDLQRVVRKMKDVHARFDSFLDKVIAEHRMVDNAHDLLSLLIRSKDDVDNDGVKLTNTDIKALLLNLFTAGTDTSSSTVEWALSEMIRHPDALKRAQRELDEVVGRDRLVSETDIRSLPYIQAIVKETFRLHPSTPLSLPRISSEACTVNGYLIPKNTTLLVNVWAISRDPGVWKEPLEFRPERFLGGGGYETVDLKGNDFELIPFGAGRRVCAGLSLGLRMVQFLTATLVHGFDWKLVDGQSAEKLDMEEAYGLPLQRAVPLMVRPVPRLDEKAYHVVV

SEQ ID NO: 24908 - protein, 312 aa, Aspergillus fumigatus
MAFGGPRGGGRGAPRGGRGAPRGGGGRGGRGGLGSGGRGRGGARGGGRGGPARGRGGRGGGRGGAKGAKGGAKVIIEPHRHAGVFVARGGKEDLLVTKNLTPGESVYGEKRIAVESPAGEDGAVTKIEYRVWNPFRSKLAAGILGGLDDIYMKPGSKVLYLGSASGTSVSHVADIVGPTGNVYAVEFSHRSGRDLIGMATHRTNVIPIVEDARHPLRYRMLVPMVDVIFADVAQPDQARIVGLNAHMFLKNEGGVIVSVKANCIDSTAKPEVVFAREVQKMREEKIKPKEQLTLEPFERDHCIVSGIYKRSA

SEQ ID NO: 24909 - protein, 1497 aa, Aspergillus fumigatus
MSLLGTINPNINPERTVAGRGTQEEEGEIARVEHNHHNNAASVSTDETVLERSKEIGDEDVAVEEVTRLARQLTRQSTRFSTSGNVENPFLETKEDSTLNPLSPNFKAKNWMKNLLALSSRDPERYPKRVAGVAFKNLSVHGYGSPTDYQKDVFNSVLEVGTLVRRIMGTGKQKIQILRDFDGLVKSGEMLVVLGRPGSGCSTFLKTISGEMNGIYMDEKSYLNYQGISSKQMRKQFRGEAIYTAETDVHFPQLTVGDTLKFAALARAPRNRLPGVSREQYAVHMRDVVMAMLGLTHTMNTRVGNDFVRGVSGGERKRVSIAEATLSGSPLQCWDNSTRGLDSANALEFCKTLNLMTKYAGATVAVAIYQASQSAYDVFDKVTVLYEGRQIYFGRTDEAKEFFTNMGFECPERQTTADFLTSLTSPAERVVKPGFEGKVPQTPDEFVRAWKSSEAYAKLMREIEEYDREFPIGGESLNQFIESRRAMQAKNQRVKSPYTISVWQQIELCMIRGFQRLKGDSSLTMSQLIGNFIMALVIGSVFYNLPDDTSSFYARGALLFFAVLLNAFSSALEILTLYAQRPIVEKQARYAMYHPFAEAIASMLCDMPYKITNAIIFNLTLYFMTNLRREPGAFFVFLLFSFVTTLTMSMLFRTMAASSRTLSQALVPAAILILGLVIYTGFTIPTRNMLGWSRWMNYIDPIAYGFESLMVNEFHNRQFLCPDSAFVPSSGAYDSQPLAYRVCSTVGSVSGSRYVQGDDYLNQSFQYYKSHQWRNLGIMFGFMFFFMFTYLTATEYISESKSKGEVLLFRRGHAQPTGSHDVEKSPEVSSAAKTDEASSKEATGAIQRQEAIFQWKDVCYDIKIKGEPRRILDHVDGWVKPGTCTALMGVSGAGKTTLLDVLATRVTMGVVSGEMLVDGRPRDQSFQRKTGYVQQQDLHLHTTTVREALRFSALLRQPAHVPRQEKIDYVEEVIKLLGMESYADAVVGVPGEGLNVEQRKRLTIGVELAAKPQLLLFLDEPTSGLDSQTSWSILDLIDTLTKHGQAILCTIHQPSAMLFQRFDRLLFLAKGGKTVYFGEIGEKSSTLASYFERNGAPKLPPDANPAEWMLEVIGAAPGSHSDIDWPAVWRDSPERRAVHEHLDELKRTLSQKPIDPSKADPGSYDEFAAPFTIQLWECLLRVFSQYWRTPVYIYSKTALCVLTALYIGFSFFNAQNSAQGLQNQMFSIFMLMTIFGNLVQQIMPNFCTQRSLYEVRERPSKTYSWKAFMAANIIVELPWNTLMAFLIFVCWYYPIGLYRNAEPTDSVHERGALMFLLIWSFLLFTSTFAHMMIAGIELAETGGNLANLLFSLCLIFCGVLAPPQSLPGFWIFMYRVSPFTYLVSAMLSTGVSGTNAVCEPVEFLHFDPPSNMTCKDYMADYISTRGGYLENPSATSDCTFCTISSTDTFLSAVSSHYSDAWRNFGIMWAYIIFNIFAAVFIYWLARVPKGKRTKGST

SEQ ID NO: 24910 - protein, 297 aa, Fagopyrum esculentum
  misc_feature (282)..(282): Xaa can be any naturally occurring amino acid
  misc_feature (286)..(286): Xaa can be any naturally occurring amino acid
  misc_feature (289)..(289): Xaa can be any naturally occurring amino acid
  misc_feature (295)..(295): Xaa can be any naturally occurring amino acid
LGTPPQKVSLVLDTGSSLVWTPCTIPTATYTCQNCTFSGVDPTKIPIYARNKSSTVQSLPCRSPKCNWVFGSDLNCSTTKRCPYYGLEYGLGSTTGQLVSDVLGLSKLNRIPDFLFGCSLVSNRQPEGIAGFGRGLASIPAQLGLTKFSYCLVSHRFDDTPQSGDLVLHRGRRHADAAANGVAYAPFTKSPALSPYSEYYYISLSKILVGGKDVPIPPRYLVPSKEGDGGMIVDSGSTFTFMERIIFDPVARELEKHMTKYKRPKEIEDSSGLGPCYNITGXSEVXVPXLTFSFXGG

SEQ ID NO: 24911 - protein, 457 aa, Sphingobium herbicidovorans
MDEKDRDDSPSALLGEVIDKQSWNALVVTTVLLSTLMMFIDGYDLHTIAFAAPSIMSEWSLSSAAFGLVFAAASFGMLVGGIVFGWIGDRHGRKLGSLAALVVCGLGSLSVLHARDVNLLSLCRFLTGIGIGGLTPLLYALNQELVPHRFRATVVAVIMMGYMAGSASGGAVAAALMPHYGWEPLFWIGGAFSLLLAGVGYVLLPESVAFLSRRAARKAEMATLLRRIDPTITPETVARIATIPDAPQGAASRGLSPLFSGHLSTITPLLWLAYICSSATVFFMISWLPTLMLGAGLSKAESALGLSLFILAGSIGGLVISAVIDRLGVSSITVIPVVGCLLLATLALPNLSSSGYMIAVGICGYFVLGGHQGLNGAAGLLYPSPVRASGIGWALSIAKIGSIIGPLVGGLLLAAELPRMQLMMIIASPLPIFAVSLILLGMAKSRERHARAAPVRD

SEQ ID NO: 24912 - protein, 418 aa, Diaporthe helianthi
MSCSPSTHSLTHIHSLTELYSRPNFLTPTSLFFNNHFLPTTKMVYKSGLIAAVLAASVMASPTPITNGDEVMKRASTCTFSGASGAAQAMKEQASCSTITLKNLQVPAGTTLDLTKVKANTRIVFEGETTFGYKEWEGPLLSIAGTGLTVEGASGSVLNDLGEKYWDGKGSNGGKTKPKFFAAHKMMKSSINNITIKNAPVQVVSINGCDNLTVNRMHIDNKDGDSKGGHNTDGFDIGSSNNIHINAAQVYNQDDCVAINSGTNIKFDSGLCSGGHGLSIGSVGGRADNTVTGVTFSKSTVQNSDNGIRIKAKKDTTGNISNIVYEDITLSKIAKYGVLIEQNYDGGDLHGEPTNKLPISHVTVNGLHGAGAIASGGHNMAIVCGSGSCANWTWKDVKVSGGKKYDSCKNIPGVVGSC

SEQ ID NO: 24913 - protein, 371 aa, Pisum sativum
MGAPIANAIPLITPYKMGNFNLSHRVVMAPLTRMRSYNNVPQPHAILYYAQRASQGGLLIAEATGVSDTAQGYPNTPGIWTKEQVEAWKPIVEAVHAKDSVFFLQIWHVGRVSNSIYQPNGQAPISSTDKAITSNDQQQFTAPRRLRTNEIPNIVNDFKLAARNAIEAGFDGVEIHGAHGYLLDQFMKDKVNDRTDEYGGSLENRCRFTFEVVEAVANEIGADKVGIRLSPFAEYAESGDSNPNALGLYMANALNKYNILYCHMVEPRLIQTFDPVETPHSLEPMRKAFNGTFMVAGGYNRQDGIKAIAENRADLVVYGRWFISNPDLPKRFALDAPLNKYNRETFYSSDPVIGYTDYPFLNDETPVESKA

SEQ ID NO: 24914 - protein, 116 aa, Pisum sativum
MGATTTDSVPLLTPYNMGKFKLSHRVVMAPLTRTRSYNNVPQPHAILYYSQRASQGGLLIAEATGVSDTAQGLPDTPGIWTKQQVEAWKPIVDAVHAKGAIFFCQIWHVGRVSNSS

SEQ ID NO: 24915 - protein, 463 aa, Achromobacter denitrificans
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEEGARIAGWKDSVKALFGGQLSKITPALWGAFVCSSVTVFFLASWIPVLTVGTGRSASLAAVGLALFSAGGRFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 24916 - protein, 1266 aa, Achromobacter denitrificans
MQISQKHSTVMDIHSKFDPASRFRGFASGQPAASELRERITAACRTAEPVAVSALLAMAKMEPEVARKANQLSMQIAQRLRERKNSAGRAGIVQGLLQEYALSSQEGVALMCLAEALLRIPDMATRDALIRDKIARGHWQEHAGRSPSLFINAATWGLFLTGKLVSTYSESSLSTLLTRLIAKGGEPLIRKGVDMAMRMMGEQFVTGETIKEALDHARGLEAQGFRYSYDMLGEAAMTAEDADRYRQSYERAIHAIGEASNGRGVYEGPGISIKLSALHPRYSRAQYGRVMDELYPVVRSLALLARRYDIGLNIDAEEADRLELSLDLLEKLCFEPALAGWNGIGLVIQAYQKRCLFVIDHVIELAQRSRHRLMIRLVKGAYWDSEIKRAQVEGQDGFPVYTRKVYTDVSYLACARKLLVAPAEIYPQFATHNAHTMAAIYNLAEPANYQPGQYEFQCLHGMGEPLYEQVVGSLADGKLGRPCRIYAPVGTHETLLAYLVRRLLENGANTSFVNRIADPSIPLEALVEDPVAAVERMAQEEGEAGRPHPCIPSPSALYGQARRNSHGLDLSNEQTLRGLEPILVDSARTGWTAEPLLGESAEAEPTAWKPVLNPADHRDVVGKVRAASEQQIEAALRSATGFAPQWAATSAGDRAFVLERAADLLQDQLPYLLGLLCREAGKSYANGVAEVREAIDFLRFYAAHARTDFDDPAHKPLGPVVCISPWNFPLAIFVGQVSAALAAGNPVLAKPAEQTSLIAAEATRLMHTAGVPRAALQLIPGRGSVVGARMVADARVQGVMFTGSTAVARQLQRTMAERLGPTGAPVPLIAETGGQNAMIVDSSALVEQVVADVMASAFDSAGQRCSALRVLCVQDDVADRLLHMLRGAMAESNVGDPSSLCTDVGPVIDLAARTTIESHIELMQSRGRRVNRAGRAAHEVLEGGTFVLPTMIELESISELEREVFGPVLHVVRYARQDLDTMLAQISATGYGLTMGIHSRIDETIGRVVSSAKVGNVYVNRNMVGAVVGVQPFGGEGLSGTGPKAGGPLYMYRLLAESPHDVLVRAAERGLPGSVADGSVTQASEPFEALLSWIETHRERPLTARCRLLKRTAGSGQMRVLVGPTGERNTYSLQPRVAALCLAEDEDSLLFQLAGALVVGCRAIWPSNTDTQALRATLPLDVQAEIALARDWAAPTVEFDVALYQGSREGLLAASARLAERQGPITSLWRFPTDSGKVPLEALVVEQAVSTNTAAAGGNASLMTIS

SEQ ID NO: 24917 - protein, 481 aa, Chlamydomonas reinhardtii
MSSTPSATAIDHGATYSDLLIIQGAIVFFLQVGFVSLEVGYGRSKNVKNILLKNTVNILLCAICWWAVGYAFSYGSSTDGFIGTSGFFHDGGLGAAKLWFYSWTFCLSTVTIVSGCLAERTSLVAYPVFTVLMASWVHPVVVHWAWSRDSWLLGISSECRFLDFAGGTVVHICGGMMGLVGAALVGPRIGRFEEGRAKELPGHDVSSVAIGTLFLWFGWFGFNCGSAYVYMGNMAAAAAEAAASAVASGDTSADVYASAAAAVSAAVTSGANATLHPGSTPADRVALNMTLCASVSGLTALLLSSLRSGTVDLCVCCNSLLAGLVMSTPACGFITSWAAVIYGLVAAALYMGGTRMLVRFHVDDPLESSAIHFGCGGVGTLLLALLARPTYVQELTGYDCGGLVYGGRKGAILLGLQLLGIAAITAWTAFFSVLVFYLLRRLGRLRVDQVTELAGLDNMEHGGPAYPEFNLVPYNTGSAER

SEQ ID NO: 24918 - protein, 487 aa, Chlamydomonas reinhardtii
MPLAELWRLTKLVPLACTVLLLSVRALAVDSGGLNDSADNSSRSLLQESGQASGTSQPYTYSSSDFVLLNGFLIFFMQIGFVSAESGQGRAKNVRNILLKNSVNIMLCAICWWAVGYAFAYGNSGGGFIGTSRFFSDGESFGSKPWFFTWTFCLSCVTIASGCLAERTHLFVYPVYTAVVSIAVHPVIAHWVWAPDSWLNSMTGSPCRFLDFAGGAVVHTVGGLTGLIGAMLCGPRLGRFEDGVGKDIPGHDVSSVSLGSLMLWFGWYGFNCGSTYIYMAQGGSEASAAVSRVALNMTLCASVAGMTSLVVSSIQTGTFDLAVCCNGLMAGLSASTSNVGFLTPWAACITGALAGLLYVGISRLLVRMGVDDPLDSSAIHCGSGILGVLVSGFLARPSYVMQMVGCNCGGVVYATNGGMQLGMQLLGLSCSMVWTAMWALLTFGILKKLQLLRVDQQTELAGIDNMEHGGPAYPEFLQRVQSTRPGY

SEQ ID NO: 24919 - protein, 129 aa, Chlamydomonas reinhardtii
MGGCLEEQYLEVLAALHSDAVAAATLCRVFSSRERTEEVAFGLNTVFMLFSAALVFIMHGGFAMLEAGAIRSKNAMNILLQTVLDGAASAVMWYLVGFGFAYGIGDNPNGFIGDALFGLSRYSSHNTGT

SEQ ID NO: 24920 - protein, 319 aa, Nicotiana tabacum
MENFPIINLEKLNGSEKAATMEMIKDACENWGFFELVNHGIPHEVMDTVEKLTKGHYKKCMEQRFKELVASKGLEGVQAEVTDMDWVCTFFLRHLPVSNISEVPDLDDQYREVMRDFAKRLENLAEELLYLLCENLGLEKGYLKNVFYGSKGPNFGTKVSNYSPCPKPDLIKGLRAHTDAGGIILLFQDDKVSGLQLLKDGQWIDVPPMRHSIVVNLGDQLEVITNGKYKSVMHRVVAQKDGTRMSLASFYNPGSDAVIYPAPALVEKEAAESKQVYPKFVFDDYMKLYAGLKFQAKEPRFEAMKSIESDVKMDPIVTA

SEQ ID NO: 24921 - protein, 504 aa, Bixa orellana
MESTGRAPLGNGRIGNPGGLVVPEIKFTKLFINGRFVDNVSGQTFDTRDPRTGDVLATIAEADKDDLDLAVKNAREAFDHGPWPRMSGYERARIMTKFADLVEAFIEELAALDTADAGKTLSMGKAVDIPAAVQIMRYYAGAADKLHGQPLKMNQDTQGYTLKDPIGVVGHIIPWNYPTMMFFLKNAPALAAGCTMVVKPAEQTPLSALFYAHLARMAGVPDGVVNVVPGFGPTAGAAVSSHMDVDSVSFTGSQEVGRAIMRAAAQSNLKNVSLELGGKSPVIIFDDADVDMAVSLSQLACFTNKGEICVATSRVYVQEGIYDALVKKIVEAAREWRFDTKANMGPQVDKKQFERVLKYIDLGKREGATLLTGGKTNGDKGYYIQPTIFLDVREDMNIAQDELFGPVMALMKFKTVDEAIQKANCTKYGLAAGIVTKELNLANTVSRSIRAGAVWVNCYFGFDPDAPFGGYKMSGFGKDRGVLAIDQYLKAKTVNTAIPNSPWY

SEQ ID NO: 24922 - protein, 124 aa, Zymomonas mobilis
MQNDQDYGNKLNPAWDEKGLITAVLTDAKTGLLLMVAHMNKESFELSMATKEATFWSRSRKKIWRKGEESGHVMKIQEIRIDCDQDTLWLKVIPMGPACHTGAQSCFYRLVEDGHLVTIPKDQI

SEQ ID NO: 24923 - protein, 484 aa, Zymomonas mobilis
MTISKLETLPQHDRSIRSSALNPRPILRLQAMRAAEMAAMKCGSSVDDLMEKAGKVAASITRSFAGNMPALILCGPGNNGGDGYVVARYLAEWGIPVSVAAYSEPKTDAAKKARSLFSGKVTSLDEAEAAPLLIDALFGVGMSRSLDNALLSKLTALSKAASLRIAIDVPSGVDTDKGSLLSDIPAFDLTIAIGALKPAHRLEPSATICGRVAVGDIDLTISNPDLIEIPKPRLAAPTPADYKYSRGYVAITAGAMAGASLLSAVAAQRAGAGYVALLGGETISGPMALVHRSWSREALADERINALVIGPGLGRDELGVQRLSMALDTSHPLVLDADALFLLSREGLDCLRNIQQPTIITPHEGEFKRLFEGISGDKLTRVTKAAALSGLVVVLKGADTVIATPDGRAAISQPAVSWLANAGTGDVLSGICGAMLARGMDPFDAACTAVWLHGEAARLAGPGMIADDLIHHLRSAFVEVTVAS

SEQ ID NO: 24924 - protein, 123 aa, Escherichia coli
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTSSKTPSVVTVNCLPKVLTLS

SEQ ID NO: 24925 - protein, 488 aa, Bacillus halodurans
MAHTVSEQRIHEVGSMKRDHYRMVINGERVDSDETFETFNPAKGEILATVAKASREHAEKAVQAARHAFDHGKWRKYPVGKRARVLNQIAAIMRERFQELVEIEVLNSGKAISAAQPQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYIGR

SEQ ID NO: 24926 - protein, 306 aa, Bacillus halodurans
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIQDM

SEQ ID NO: 24927 - protein, 453 aa, Bacillus halodurans
MPCMTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRLWVGVCQFRQEWGTDN

SEQ ID NO: 24928 - protein, 364 aa, Ipomoea batatas
MVTTISATVPSRVERLAGSGIERIPKEYIRPEEERPSIGDIFAEEKMGGGPQVPTVDLKRINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRQTDQEGADTPKPDE

SEQ ID NO: 24929 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPEPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 24930 - protein, 469 aa, Arabidopsis thaliana
MDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLRLGRGFTIKLCHENVYLPMLKTLCLDTVDFDGDHNVFETLLPRCPLLEELVLEDQRWKQWCGSVSSPSLKRLRIRFFHIPIISLDVPGLVYLELSCIFGSKYANVNLDSLVEARLNHWVEEQELRKLRDGSSHLVPADMMDLITGIRKVKVLHLTSDALEVSLLFLFYCSSKDLFMLQSSDAKTGFLFYFSGQELPMFDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 24931 - protein, 468 aa, Pectobacterium carotovorum subsp. carotovorum
MSHQFPKEFLWGGAIAANQVEGAYLTDGKGLSTSDLQPQGIFGEIVTRTPGDSGIKDIAIDFYHRYPEDIALFAEMGFKCLRTSIAWTRIFPQGDETQPNEAGLAFYDRLFDEMAKYGIQPLVTLSHYEMPYGLVKNYGGWGSRETITFFERYARSVFQRYKDNVKYWLTFNEINCALHAPFTGIGLPTESSKQDIYQAIHHQLVASAKAVKACHDIIPDAKIGNMMLGSMFYPLACKPADVMETMQQNRDWLFFGDVQSRGYYPAYTKRFFAQNEITLTVTEDDRQSLKETIDFISFSYYMTGCVTTDEEVNLKARGNILNMVPNPHLESSEWGWQIDPEGLRYLLNYLYDRYQKPLFIVENGLGAKDKLESDGSINDDYRIKYLNDHLYQVGEALEDGVEVMGYTCWGPIDLVSASKAEMSKRYGFIYVDRDDEGNGTLARRRKKSFYWYKDVIATQGQVLTSAKE

SEQ ID NO: 24932 - protein, 498 aa, Chlamydomonas reinhardtii
MADEMDPMTACITALTDAAMTTAQATALCGQFAFAADNSDLSDRLDQTNQGLNTLYLVSCGALVFVMHAGFAMLCAGAIRSKNTMNILLQTVMDAAVSAVAFYILGYGFAYGIGNNPNGFIGDSLFGLSRWVSHSSSSDAGANWQAWFFQWAFAATATTIPAGAVAERLNFNAYLIYSFFISAFVYPVVVHWVWAAEGWLGYARFGGYSHLFRSGMIDFAGSGVVHMTGGLAGLAGCIMVGPRMGRFDSNGQPVEMPGHSATLVVLGTVLLWFGWYGFNPGSQLIINYTASAAVVGRAAVTTTLSGAAGCLSCLLTAFLRHKAWDLVSGCNGALVGFVSITASANVVEPWAALIAGLVGGWVFDAVCLLFLKLRIDDPLSAAPMHAFCGAWGVFFAGLLAKKEYICESYGRDCEGYVADGLFYVGDGRLLAQVIGIISIFAWVFGLMLLLFGGLKAVGLLRISAEEEQAGLDVSKHGGSAYNYDHGLGKPEKAQALGL

SEQ ID NO: 24933 - protein, 506 aa, Oleomonas sagaranensis
MIHQTIEEISKSIAFRSRYDNFIGGKWVAPVRGQYFDNITPITGMPVAQIARSTAEDIELALDAAHAAKDAWGRTSVAERARLLNKIADRMEEKLDLLAMVETIDNGKPIRETKAADLPLAIDHFRYFASCVRAQEGSIGEVDHDTMAYHFHEPLGVVGHIIPWNFPLLMACWKLAPALAAGNCVVLKPAEQTPLSIMVWADLIGDILPPGVLNIVNGFGIEAGKPLASNKRIAKIAFTGETTTGRLIMQYASENLIPVTLELGGKSPNIFHEDVAAEDDDYFDKAIEGFVLFALNQGEVCTCPSRAIIHEKIYDKFMERALARVAAIKQGSPLEAATMLGAQASNDQLEKILSYIDIGKAEGAELLIGGERNILGGELAGGYYVKPTVFRGNNKMRIFQEEIFGPVVSVTTFKDEAEALSIANDTLYGLGAGVWTRDGNRAYRFGRAIQAGRVWTNCYHLYPAHAAFGGYKQSGIGRETHKMMLDHYQQTKNLLVSYSPKALGFF

SEQ ID NO: 24934 - protein, 506 aa, Corynebacterium glutamicum
MADPQGFIKYSRREPAHRPVPLRLMDYSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVVASMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 24935 - protein, 207 aa, Vicia faba
DYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTAFAERENTFFMETSALESLNVESAFTEVLTQIYRVVSKKALEIGDDPAALPKGQTINVGSRDDVSAVKKGGCCSA

SEQ ID NO: 24936 - protein, 333 aa, Nicotiana tabacum
MSKARVYTDVNVLRPREYWDYEALTVQWGDQDDYEVVRKVGRGKYSEVFEGINVNSHEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQDRLTAREAMAHPYFLQVRAAENSRMRTQ

SEQ ID NO: 24937 - protein, 333 aa, Nicotiana tabacum
MSKARVYTDVNVLRPREYWDYEALTVQWGDQDDYEVVRKVGRGKYSEVFEGINVNSNEKCIIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQDRLTAREAMAHPYFLQVRAAENSRMRTQ

SEQ ID NO: 24938 - protein, 275 aa, Nicotiana tabacum
MYRDRGGGGGGGGPLDRKRINDALDKHLEKLSPSTSRSLKDKAVPSTSASAGGGGGKSHFDHRNTSKNKCSDEESETDSEESDVSGSDGDDTSWISWFCNLRGNEFFCEVDDDYIQDDFNLCGLSSQVPYYDYALDLILDVESSHEEQNELVESAAEMLYGLIHVRYILTTKGMAAMLEKYKNYDFGRCPRVYCSGQPCLPVGQSDIPRSSTVKIYCPKCEDIYYPRSKYQGNIDGAYFGTTFPHLFLMTYGHLKPQKPTQNYTPRVFGFKIHKT

SEQ ID NO: 24939 - protein, 506 aa, Crocus sativus
MVSTGCSGNGAKGTNGGIVVPEIKFTKLFINGEFVDSVSGSTFETRDPRNGDVIANIAEGDKEDVDLAVKAAREAFDHGKWPRMSGYERGRIMMKFADLIEAFIEELAALDTLDAGKLLSMGKAVDIPAAVHIIRYYAGAADKIHGYTLKLSSELQGYTLKEPIGVVGVIIPWNFPTTMFFLKVSPALAAGCTMVVKPAEQTPLSALYYAHLAKLAGVPDGVINVVPGFGPTAGAALSSHMDVDSVAFTGSAEIGRAIMESAAKSNLKNVSPELGGKSPMIVFDDADVDMAVSLNSLAVFFNKGEVCVAGSRVYVQEGIYDEFVKRAVEAARSWKVGDPFDQSRNMGPQVDKDQFESVLKYIEHGKSEGATLLTGGKPAADKGYYIEPTIFVDVTEDMKIAQEEIFGPVMSLMKFKTVEEGIDCANNTKYGLAAGILSQDLDLINTVSRSIKAGIIWVNCYFGFDLDCPYGGYKMSGNCRESGMDALDNYLQTKSVVMPLHNSPWL

SEQ ID NO: 24940 - protein, 168 aa, Nicotiana benthamiana
ANGKNYLHKRNPPIVHRDLKSPNLVVDKKCTVKVCDFGLSHFKANTFLSSKTAAGTPEWMAPEVLRDEPSNEKSDVYSFGVILWELATLQQPWSDLNAPQVVAASGFRGKRLDIPSGLNPQVATIIEACWANEPWKRPSFSTIMDMLRPNLKSPLTPQSGHTDMQLLS

SEQ ID NO: 24941 - protein, 464 aa, Aneurinibacillus thermoaerophilus
MKLILLSGGSGKRLWPLSNDSRSKQFLKVLKNDNNEFESMVQRVWNQLHTVGLAEDSYVATSKSQVDMLHAQLGTEVPLIIEPERRDTFPAIALAATYLYSMEGVREDDVISVLPVDPYVESRFFDRVKDLETALVQSSAELALIGVKPTFPSEKYGYIVPKKGEHDVVANVLAVDYFVEKPSTSRAQELMKQQAFWNCGIFAFKLGYLISLLKEKKLPTDYEEMLHTYNQLPKISFDYEVVEKAQNIIMLPYEGEWKDLGTWNTLTEEMNTNLLGKGIISEGCENTHLINELDIPVTILGISNAVIAASPDGILVTDKEASPRIKDIMKNFNQRPMYEERRWGWYRVLDHTKVENGNEVLTKRIGVHAGKNLSYQIHHKRSEVWTIISGEGQFVLNDQLYHVKPGDVLQIPVGAKHAIRAITDLQFVEVQTGSELIEEDIIRLCMTWEETLDCCKDCIVKVIR

SEQ ID NO: 24942 - protein, 404 aa, Brassica rapa
MGICMSVQVKAESPSNTGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 24943 - protein, 170 aa, Lilium longiflorum
KMACMKQLVLVLFVALLAMLAESRVSRMDLGLDLDGSGGLGIGTGVSIGLGGGSGSSSGSGSGSGSASGSGSGSGAGSYAGSGAGSSAGSGAGSSAGSGAGSYTGSGAGSSAGSGAGSGAGSGAGQGQGSGSGHGEGYGEGSGEGQGNSSGSGYGEGHGYGSGHGSGQGK

SEQ ID NO: 24944 - protein, 483 aa, Nicotiana tabacum
MDFIIYLFLSFSISLITFLLLRAAAAAHFRRRKTRLPPGTLGLPFIGETLQLISAYKTENPEPFIDDRVSKYGNIFTTHIFGEPTVFSTDAETNRFILQNEGRPFESSYPSSLQNLLGKHSLLLMRGSLHKRMHSLTMSFANSSILKDHLLADIDRLVRLNLDSWTGRVFLMEEAKKITFNLTVKQLMSLDPCEWTEKLMKEYMLVIEGFFTIPLPFFSSTYRKAIQARRKVAEALGLVVKERRKERGGGERLKNDMLEALFEGDGVEGFSDEVIVDFMLALLVAGYETTSTIMTLAVKFLTETPHALSLLKEEHEEIRLRKGDVESLLWEDYKSMPFTQCVVNETLRVGNIISGVFRRTMTDINIKGYTIPKGWKVFACFRAVHLDHEHFKDARTFDPWRWQSNAGSTSSPNVFTPFGGGPRRCPGYELARVELSVFLHHLVTRHSWVPAEPDKLVFFPTTRMQKRYPIIVQRRSLFDPCKE

SEQ ID NO: 24945 - protein, 319 aa, Prunus persica
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEQGYLKKAFYGTNGPTFGTKVSNYPPCPNPELIKGLRAHTDAGGLILLFQDDKVSGLQLLKDGQWIDVPPMRHSIVINLGDQLEVITNGKYKSVEHRVIAQTDGTRMSIASFYNPGSDAVIYPAPTLVEKEAEEKNQVYPKFVFEDYMKLYAGLKFQPKEPRFEAMKAVETNISLGPIATA

SEQ ID NO: 24946 - protein, 214 aa, Ipomoea nil
IRHEGKSDSKCKTVGIQGIAWAFGGMIFALVYCTAGISGGHINPAVTFGLFLARKVSLTRLVYYIVMQCLGAICGAGVVKGFGKTLYNSKGGGANVVNPGYTKGDGLGAEIVGTFVLVYTVFSATDAKRNARDSHVPVLAPLPIGFAVFLVHLATIPITGTGINPARSLGAAIIYNNEHAWNDHWIFWVGPFVGAALAALYHQVVIRAIPFKSS

SEQ ID NO: 24947 - protein, 423 aa, Saccharomyces cerevisiae
MAEIPDETIQQFMALTNVSHNIAVQYLSEFGDLNEALNSYYASQTDDQKDRREEAHWNRQQEKALKQEAFSTNSSNKAINTEHVGGLCPKPGSSQGSNEYLKRKGSTSPEPTKGSSRSGSGNNSRFMSFSDMVRGQADDDDEDQPRNTFAGGETSGLEVTDPSDPNSLLKDLLEKARRGGQMGAENGFRDDEDHEMGANRFTGRGFRLGSTIDAADEVVEDNASQSQRRPEKVTREITFWKEGFQVADGPLYRYDDPANSFYLSELNQGRAPLKLLDVQFGQEVEVNVYKKLDESYKAPTRKLGGFSGQGQRLGSPIPGESSPAEVPKNETPAAQEQPMPDNEPKQGDTSIQIRYANGKREVLHCNSTDTVKFLYEHVTSNANTDPSRNFTLNYAFPIKPISNDETTLKDADLLNSVVVQRWA

SEQ ID NO: 24948 - protein, 309 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAEKNAQKKTN

SEQ ID NO: 24949 - protein, 432 aa, Saccharomyces cerevisiae
MVVDTEYYDLLGVSTTASSIEIKKAYRKKSIQEHPDKNPNDPTATERFQAISEAYQVLGDDDLRAKYDKYGRKEAIPQGGFEDAAEQFSVIFGGDAFASYIGELMLLKNLQKTEELNAEDEAEKEKENVETMEESPADGKTNGTTNAVDAALGNTNEKDDKNKARTTSGNLTVHDGNKKNEQVGAEAKKKKTKLEQFEEEQEVEKQKRVDQLSKTLIERLSILTESVYDDACKDSFKKKFEEEANLLKMESFGLDILHTIGDVYYEKAEIFLASQNLFGMGGIFHSMKAKGGVFMDTLRTVSAAIDAQNTMKELEKMKEASTNNGPLFDKDGNEQIKPTTEELAQQEQLLMGKVLSAAWHGSKYEITSTLRGVCKKVLEDDSVSKKTLIRRAEAMKLLGEVFKKTFRTKVEQEEAQIFEELVAEATKKKRHT

SEQ ID NO: 24950 - protein, 361 aa, Saccharomyces cerevisiae
MISANSLLISTLCAFAIATPLSRRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKSYGIVIEGDYLNSKTTGTATGGVPISNLVMKDITGSVNSTAKRVKILVKNATNWQWSGVSITGGSSYSGCSGIPSGSGASC

SEQ ID NO: 24951 - protein, 400 aa, Saccharomyces cerevisiae
MPFVKDFKPQALGDTNLFKPIKIGNNELLHRAVIPPLTRMRAQHPGNIPNRDWAVEYYAQRAQRPGTLIITEGTFPSPQSGGYDNAPGIRSEEQIKEWTKIFKAIHENKSFAWVQLWVLGWAAFPDTLARDGLRYDSASDNVYMNAEQEEKAKKANNPQHSITKDEIKQYVKEYVQAAKNSIAAGADGVEIHSANGYLLNQFLDPHSNNRTDEYGGSIENRARFTLEVVDAVVDAIGPEKVGLRLSPYGVFNSMSGGAETGIVAQYAYVLGELERRAKAGKRLAFVHLVEPRVTNPFLTEGEGEYNGGSNKFAYSIWKGPIIRAGNFALHPEVVREEVKDPRTLIGYGRFFISNPDLVDRLEKGLPLNKYDRDTFYKMSAEGYIDYPTYEEALKLGWDKN

SEQ ID NO: 24952 - protein, 222 aa, Saccharomyces cerevisiae
MSSSESIRMVLIGPPGAGKGTQAPNLQERFHAAHLATGDMLRSQIAKGTQLGLEAKKIMDQGGLVSDDIMVNMIKDELTNNPACKNGFILDGFPKTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 24953 - protein, 509 aa, Camptotheca acuminata
MAVLLLFLPLIFIFLAYKLYQRLRFKLPPGPRPLPFVGNLYSVKPVKFRCFAEWAQVYGPIMSVWFGSTLNVVISNSELAKEVLKENDQHLADRERNRSSNSFSRGGKDLIWADYGPHYVKVRKLCTVELFTPKRLEALRPIREDEVTAMVDSIFKDSANPDNYGKSLLVKQYIGAVAFNNITRLVFGKRFMNSEGVMDEQGKEFRGIVANGVKIGGLRFIGEHIPWLRCMFPQEEEILVKHEARRDRLTRAIMEEHTLARKHSGGAKQHFVDALLTLQKEYELSDDTVIGLLWDMITAGMDTTSISVEWAMAELIKNPRVQQKAQEELDRVIGYERIMSETDFPNLPYLQCVAKEALRLHPPTPLMLPHKANSNVKIGGYDIPKGSIVHVNVWAIARDPATWKDPHEFRPERFLEEDVDMKGHDFRLLPFGAGRRICPGAQIAINLITSMLGHLLHHFSWAPPEGVKPEEIDMTENPGLVTFMKTPVQAVAKPRLPSHLYKRVAVGAV

SEQ ID NO: 24954 - protein, 465 aa, Vigna radiata
MAVARSDSNSEPCTSYNCYNVAALTETILETSQVSNLKDRYVLGEQLGWGQFGVQDCSDKLTGEVLACKSIAKDRLVTSDDLRSVKLEIEIMARLSGHPNVVDLKAVYEEEGFVHLVMELCAGGELFHRLEKHGWFSESEARVIFRHLMQVVLYCHENRVVHRDLNPENILLATRSSSSPIKLADFGLATYIKPGQSLHGLVGSPFYIAPEVLAGAYNQAADVWSAGVILYILLSGTPPFWGKTKSRIFEAVKAASLKFPLEPWDRISESAKDLIKGMLCTDPSRRLTAQEVLDHCWMESNQTNQEQLGENQIQSCKQWDVGGSSFSASFSPGIRTLAFSLALLHVMLNRPTFTCRSSFSSFLEEPVTPCVLSAGFSFKSVGDSSGLEFSSPIPSMLSFSFLSPSPVVEHKSCKLGCSANMSDVDAIAGEASLESYFYYKILNLCIEHDAKETNRKPTEAKRSIE

SEQ ID NO: 24955 - protein, 374 aa, Bradyrhizobium japonicum
MQAIEIEGHASAHCFAGPDDLSTLNYTGGTTGKSKGALRYHRENAGAAAAILADFEIPEDARYLAVAPISHVAGTKVLPTLMRGGTVHMLKGFDPEAVLATIARERINFTLFVPTMIYVLLDHPALSRTDLSSLELVLYGASAMSPSRLIEGIERIGPVFSQLYGQTECYPISVLRKKDHDPRTPELFLSCGFPIAACEVRILDDNDQEVKTGEAGEICVRAPHVMAEYWKRPDITAETLKNGWVHTGDIARKDERGYMFILDRKKDMIVSGGFNIFPREVEDVLSQHADVAMVAVVGIPDEKWGEAVTAIVVPREGAKPDPDELINFVKTRKGSAHAPKQIQFVKQLPMTGVGKVDKKVLRAGFWSGRDRMVG

SEQ ID NO: 24956 - protein, 205 aa, Shewanella sp. SIB1
MSDLFSTMEQHASYGVGRQIGEQLAANSFEGIDIPAVQAGLADAFAGKESAVSMEELQVAFTEISRRLQAAQEAAAEAAAAEGDTFLAENAKRDGITITESGLQYEVLVQGDGETPTYDSTVRTHYHGTFISGDVFDSSVARGQPAEFPVSGVIAGWTEALQLMPVGTKLKLYVPHHLAYGERGAGASIPPYSALVFEVELLEII

SEQ ID NO: 24957 - protein, 408 aa, Methanococcus maripaludis S2
MATADLFADPTNIVTGLSTLATSGDVMFLVLMGVLVFSMQLGFALLEGGQVRKKNVNNVMMKNMADWLIGAVSWLFIGGVLSVSLVPADFFSWWGQIFTTNFANNGIDLANWFFGLVFAATAATIVSGGVAERIKFKSYLLMSIIITAILYPLFVYLGPWGSGMIPFNDYAGSFVVHGLGGFLALGAIAALGPRIGKFVNKKAISIPGHNIPMSVFGAFVLAIGWYGFNVGSSFAVADISGLVCATTTLAMAGGGIGALLASKDDVLFTANGIVAGLVAICSGTDVVSPIGALIIGLVAGIQVPIVYKIVEKMGLDDVCGVIPVHGTAGILGGILTGVFGMAALGGAGGVSLVNQLIAAGLTVVYGTGLGFGLGKLVGGFTGGLRVTEEEEKMGLDLAEHKLPAYPDE

SEQ ID NO: 24958 - protein, 411 aa, Methanococcus maripaludis S2
MVTADLFNNPTNIMDALNTLANSSDVMFLIFTGAFIFIMHLGFAMLEGGQVREKNVNNAMMKNMGDWIIGCISWLLVGSVIARTLNPADFFIWWGKIASATPFLTNNGLELANWFLGLVFAATAATIVAGGIAERIKFKSYILISIVITALLYPFFSYLGPWGAGVIPFHDYAGSLMVHGVGGFLALGLIAAIGPRFGRFVNKKAITIPGHNIPMSILGAYILAFGWYGFNVGSSLALSDISGLVCATTTLAMAGGGLGGCLFSKNDVLYTANGLLAGTVAICAGTDIVSPLGALIIGFIAGSQVPLIFKIVEKMGLDDVCGVIPVHATSGALGAILAGIFGMTAFGGVGGVSLTEQIIATLICAVYGTGAGFILGKLVGAVTGGLRVKESEEKAGLDISIHKLPAYPKEN

SEQ ID NO: 24959 - protein, 500 aa, Methanococcus maripaludis S2
MVVILFLDKIVSAQRAYTFDDVLLVPNKSFVDPKTTDVSVDIAGLKLNIPIISAAMDTVSEKDLAIALARRGGIAVIHRNMTVEEQLKHVKAVKMAENLVIRDVVTVEPSSSVLDAERIMYEYNVSGLPVVSENKTLVGILTTRDLKFVPDKNVAVETVMTKEVLHVHEDTPYEEILNRLYENKIERLPILDKNTKELLGMVTLRDILKRKKYPDAARDSDGKLVVAAACGPSDFERAEALVLAGVDAVAIDCAHAHNMQVVENVKKLKEILKGTKTKLFVGNIATGEAAEDLIKAGADALKVGIGPGSICTTRVVAGVGVPQLTAVAEVAEVAKKYGVPVIADGGIKYSGDIAKAIAAGANAVMVGSLLAGTEEAPGSLMTINGRKYKQYRGMGSLGAMCGSSGNVADRYFQSGHMKHSKLVPEGIEGAVPYKGPTSDIVYQLIGGLRSSMGYCGAQNLSEMHEKARFVIITQSGQKESHPHDVLITNEAPNYPINAER

SEQ ID NO: 24960 - protein, 427 aa, Methanococcus maripaludis S2
MELNIKMDRSKELFEESKKYLVGGVNSPVRLFKPFPFFVKSAKDCFLYDEDGNEFIDYCLAYGPMVLGHANENILNAVKSQMDLGTAYGVPSEKEITLAKEVINRIPCAEMVRFVNSGTEATMGAIRLARGVTKRNKIIKFEGAFHGAHDYVLVKTGSGALTHGAPNSPGIPEDTTKNTLLIPFNDEEAVRKVISENKEEIACIILEPVMGNVGCIPPKDGYLQFLREITEENGILLIFDEVITGFRLSKGGAQEYYGIKSDLATVGKILGGGFPIGAITGKKEYMEQFSPNGQIYQAGTFNGNPISVTAGIETLKNLDDKFYKETTKKAGILSNCLRETAEKYNIPAKVYNVASIFQVYFNDKEIVTYEDAKSSDTEKFMKYFYTLLENGVFVAPSQFECCFTSIKHNDEVLEKTMNAIDIAMKKL

SEQ ID NO: 24961 - protein, 243 aa, Methanococcus maripaludis S2
MIEMVNIHKKFKEAHVLKGVDLKVAKGEVLVIVGPSGSGKSTLLRCINGLEKTTEGHIFFEGDDITDKKVNINKIRQKIGMVFQQFNLFPHLTVLDNITFAPRKVLNVSKKEAEELARELLKKVGLEGKENQYPIQLSGGQQQRVAIARALAMKPDAMLFDEPTSALDPELVKEVLDVMKQLAYEGMTMVVVTHEMGFAKEVGDRLIFIDDGQILEDGNPSDVFSNPKNERTKNFFGKILSHN

SEQ ID NO: 24962 - protein, 129 aa, Methanococcus maripaludis S2
MDKNIKEIIKNMDLKFRNIDGKKLLLAISTDKQKNVLMTAFMSEESLEKSIETGYMHYYSTSRDKIWKKGEESKNVQKIIDVYRDCDGDALLFTVEQTGWACHEGYMSCFHNKIDLNTGDSTVIGTKLD

SEQ ID NO: 24963 - protein, 430 aa, Methanococcus maripaludis S2
MLRNMDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 24964 - protein, 476 aa, Methanococcus maripaludis S2
MLFIAFAPFGAFALEANSKNDGYSLDDIKYYKIFENEDIPKIMYALRQGDFEIIAELKNEWEIEEEDVSFEYTTSKNPLGELIRDNLYELGQKYEVFEDESDFVSKMNVWATAFTKSMMKKSSEQKDKLIVQTVNALDNLDETLNLFSERLREWYSLYFPEMDNIVKKHDIYVSLVSEYGDREEYTRTKLKKTMPSNVARTISLAAKESMGADVSEFDLKIMKNLADEIKSMYEYRESLQEYLETSMNEIAPNLTKVAGASLGARLISLAGGIERLLRLPASTIQVIGAEKALFAHLRERALPPKHGVIFQHPLIQGSPWWIHGKIARAISCKISIAIRADAFGNDISDMLIEDMNKKVAEIKEKFPEPTRKRRPRPDTRSFGNKGGQDRDRRSQGDRKPSGNRGDSKKGGKPFGKKPAGKDDRRDNRKGDRKPFGGKPKNSGNQPPKERSGEKRRDSTKKVKAERKVIGKTSSQN

SEQ ID NO: 24965 - protein, 230 aa, Methanococcus maripaludis S2
MEKIRVKEIFDNVYSVDFGDGLKRIATKSLVPGKRVYGEKLVYSDSIEYRIWNPNKSKLGAAIINGLKKMPIKKGEKVLYLGASAGTTPSHVADIAENSLVYALEFAPRIMREFIDSCNERKNLIPVLGDANRPQDYSNIVEKVDVIFEDVAQPNQAEILVKNAKWFLKENGYAMISIKARSVDVTKNPREIFAEQKKILIEGGFEIVDEVNIEPFEKDHMMMVGIWKGN

SEQ ID NO: 24966 - protein, 321 aa, Methanococcus maripaludis S2
MDRGAIQLKKTLWKLTKFSEDYFALLVILGSIIGFFNPSIFGWAIPHISLFLGIIMFGMGMTLNKDDFKTVLERPIDVVFGSILQFSLMPLLAFLVITIFHLPTELALGFILLGSCPGGTASNVITYLAKGDVALSVAITTFSTLLAPMITPILVLWFAGAWIDVSAYSMFLSIVKIVLIPVILGVIINNSLGKKIDSIRQVLPLLSVVAIVLIVGAIIGVNSEKIVSSGVIVLLAVIIHNALGLLLGYIGTKLIGMDEKKSRAVTIEVGVQNSGLAVALATIHFSPLAAVPGAIFSVWHNITGPILANYWSKKDKKESFV

SEQ ID NO: 24967 - protein, 433 aa, Methanococcus maripaludis S2
MANFLARYFGFEEHKTNFKVETMAGVTTFMTMAYIIFVNPSILSLAGMDFGAVMVATCISAALGTFIMGVYAKYPFALAPGMGLNAFFTFGVVMGMGLSWQTALGAVFISGILFILLTLTKIRTWIFDAIPDALKYGTAVGIGLFIAFIGLKSAGVIVANEATLVGLGNVLSPATFLALFGLFATAAMMARKVTGAILWGIILTAVIGMGLGVSALPAGLVAMPPSLAPTLMQMDVMGALSFGLINIILAFFFVDLFDTLGTLSALSSQAGYMKDGKLPKAEKALMSDSVATAVGAALGTSTVTSYVESASGIGLGGRTGFVSVVVAALFLLSIFFSPFVAAIPAYATAPALIIVGALMISAIKRIDLDDITESVPAFIALITIPLTYSIATGLQLGFIFYPLIKIIAGRSKEVHPIVYLLAIIFAARFVYIG

SEQ ID NO: 24968 - protein, 467 aa, Methanococcus maripaludis S2
MKSENYSKNDLEKWDKEYVWHPFTQMKEYREGKPLLIESGEGIYLIDVDGKKYMDAVSSIWCNFFGHSEKRIADAISKQALNIGHSTQLGCGNVPSAILAKRYVDFSPEQFKKVFFSEDGAEAIEIAVKMAFEYCKLKGFTNKTKFVSVKEGYHGDTVGAMSVGGSELFHGCFEPLLFEGYHASAPYCYRCKYCNFKNTDERNKQGCEMKCLKEMEDLIRTNKDEIFCVILEAGVMGSAGMIPYPKGYIEGVAKICKKLNIILILDEIATFGRLGRAFYSDMDELKELEKPDILCLGKGITGGYLPLALTLATDEIYNAFLGSFDECKQLFHGHTYAGNQIICASAIETLNILEETNICEEIRPNIKLLHENLDKLKEFPCVGDIRKSGYMIGIELVKDKETKEPYEYSYKAGYKVAGRLLEKGIYIRPIGNTLIFVLPLIIKPEEIKLLTEKIYESISELLDEKVL

SEQ ID NO: 24969 - protein, 318 aa, Methanococcus maripaludis S2
MKIVVLDGYAMNSGDLSWEDLKKLGELSIYDRTLESEVVERISDSEIVITNKVIIGKEVLEKCKNIKYVGVTATGYNVVDTTLAKDHGVIVTNVPAYSTDSVAQLVFSFILEHCQNVSKYTESVKSGDWVNSKDFSYQKFPIIELAGKSLGIIGFGAIGKKVAEIGNAFGMNVLVNTRTVSKTDEINVNFVSKEEIFKNSDFLTLHCPLNNETDKIVNEKTLNLMKKSAILINTGRGGLVNEKDLANALNLEKIAGAGLDVLSTEPPKEDNPLLNAKNTYITPHVAWASYEARKRLMDVTINNVKSFIDGNPINVVNK

SEQ ID NO: 24970 - protein, 270 aa, Methanococcus maripaludis S2
MVKVAVTGALGRMGSGIIKTITETDGLDVVAAIDIPNHPKKGQDVGELTGLGKIGVALSTSDELEAVLKESGAEVLVDFTAAAPCVQTAKTASKLGVNLVIGTTGFTPEQRAEMEDAISKNKVAATISQNYAVGVNIFFKTLELLAQKLGDYDIEILEMHHKFKKDAPSGTALRAAEIIQNNLNRDSNVIYGREGITGERTKEEICIHALRGGDIVGDHSVIFTTEGERLELSHRVTSRQSLVSGAVLAIKFVAQKKEGIYNTFDVLDLN

SEQ ID NO: 24971 - protein, 239 aa, Methanococcus maripaludis S2
MSMIKKLIAECLGTGILVFFGPGAAAMTLMIANNTGTAGIGLLGGLGDWFAIGFSFAIAIAAVIYTMGRISGAHINPAVTIGLWAVKKFPTKDTVLYIIAQLIGAAIGSLLFFACIGIDSVTIGGLGATAPFAGISYFQAILAEFIGTFLLMFVIMGVAVDKRAPDGFAGLVIGLTVGAIITTTGNIAGASLNPARTFGPYLIDSIYGLNLWYYFPIYIIGPVLGAIVAAFTYEYLNRE

SEQ ID NO: 24972 - protein, 258 aa, Methanococcus maripaludis S2
MNKPVLVSFLVSGDPNPDATLKFMKTLDKYSGVIELGIPFSDPVADGPTIQAADVRSLSNNFKIAKSFEVLKEFRKESDTPVILMTYYNPVYKRGIENFVIQAKEAGANGLIIVDLPLQEATEYRKICKKHEMGTVFLAAPNTPEERLKISDEASTEFLYLISTFGITGARDTFEQMTFDFIKRARTTCKGKICVGFGISKGSHAESLIEQGADGVIVGSAFVDIIKNYGDSKEALVKLEELAKELSEGIDKGYEKRK

SEQ ID NO: 24973 - protein, 395 aa, Methanococcus maripaludis S2
MSTLEKEQIISDEKKYVIGTYGRVPVVLVKGNGMSVFDTDGKEYLDFLAGIGVNNVGHCHPKVVEAIKNQAETLIHVSNIYYNVPQIELAKKLVNLSGLDKAFFCNSGAEANEAAIKLARKYAKANGKEGEIITMEHAFHGRTLTTITATPKAKYQEGFEPLPTGFKYIPFNDIDALKAGISEKTSAIMIEPVQGEGGIHPADNEYLKAVRKLCDENNIVLIFDEVQCGMGRTGTLFAYEQYGVVPDIVTLAKGLGGGFPIGAMVAKSEIASAFTPGSHGTTFGGNPLACASSAAALDVISELLDNAVEMGEYFKNSLKTLEEKYEFVKEVRSLGLMVGIELTFNGSDIVSKMFEKGFLINCTSDTVLRFLPPLIVEKEHIDAMISALDEVFSEI

SEQ ID NO: 24974 - protein, 219 aa, Methanococcus maripaludis S2
MVMIGASILSADYGHMAEEVKKAEEGNVDFFHVDIMDGHFVPNLSMGLRVPHYLKSITDVPIDVHLMVENPDLFIPKLADAADMIAFHAESSKYLFRTVDMIKEHDAKPIVALNPSTPIGNVEYVLENLYGVLVMTVEPGFSGQSFINPMIKKIDNLKNKILTEGYDTKIFVDGGINLETAPKAVEAGADGLIAASAIYGKEDVKKAVNDLRNSANFRI

SEQ ID NO: 24975 - protein, 150 aa, Methanococcus maripaludis S2
MITKGDTIKVDYTGRFEEGEVFDTSVETVAKEEGIFEEGRPYMPLEFTVGEGQLIQGFEEAVLGLKVGEEVTVTIPPEKGYGFRDESLIERVPIEAFDQADFEPEEGMVIVAGEEPAVILEVTDEDVALDFNHELAGETLQFTIKIIEKL

SEQ ID NO: 24976 - protein, 446 aa, Methanococcus maripaludis S2
MNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 24977 - protein, 442 aa, Methanococcus maripaludis S2
MDVVIIGSGAGGLTTASNIKKHDKNAKVTVITSDKYIAYSPCAIPYVIGEEIADFDTIIMHTPKDYKAKGIDVIVEAEVLDVVSGENKVIYKKDGTETELKYDNLVLATGGTPFVPPIEGVTLDGVFKVRTIEDGQKITEWAKDTKNVVVAGAGAIGIEIAFGLKEIGLDVTVVEMVPQVFPRALDPDMAETVQKYLEEQGIKIILEKPVGKIIGNDKVEAVLVGEETIPAEMVIMSTGVRSNIELAKSAGCDIGRWAVLTNEKMQTSIPNIYAVGDCVEVIDAITMQNTLSPFGTTAVRQGKVAAKAIVKLEAEIKPVLNSMVSKIGKLEIGGTGMTETAAKMNGIEIVLGYSKALTRARYYPGGKPIYIKMVADKMTKKVIGCQIISEERVAERVDAMSVAISNGMTVEELANQEFCYAPPVSMVIDPIVFAAEDTLDKF

SEQ ID NO: 24978 - protein, 438 aa, Methanococcus maripaludis S2
MQFKSELPPVQVALDLVDLPRAINIAKEAVLGGATWVEAGTPLIKSEGMNAIRELRKNFPTLTIVADMKTMDAGSTEVEMAAKAGANVILILGVGPDSMIKDAVKAGKKYGVLVGTDLIATEDPVKRAVELEEMGVDIINIHVGLDQQVLNVDPVELVKRVSENCKKAKIAAAGGLNSETAVKAYEAGADIIIAGGTLYKSADPEQTARDIVKSLETGKPVKTDKFKKFNEDELGSAFDIVSTSNISDAMHRTGEMKGLKPVWNSERPLKFAGPAVTVRTYSGDWSKPVSAIDNCEAGNVLVIDNCSSEIACWGGLATLSCKTKGVVAVVIDGAVRDVEEILKIGIPVYARSITPTAGEPKGFGEINAVIECAGRTVEPGDWIVGDENGIIVVPKNEAMEIANRAIDVKEREDRVKEEITRGTTLAKTIRLKDWELKK

SEQ ID NO: 24979 - protein, 438 aa, Methanococcus maripaludis S2
MNGELSFKYDNVMEENLGNLGISNGKLESFNNESSKIIEILKEKELNGEFGFLDVLNDNLDKYYELNEYSKNFENILIIGIGGSNLGLRAAETGILGSFTSRYEIPRIYYMDNSDPEKTHDILSNIDLEKTLVFVISKSGNTVETLANFFIVRNLMKKKNIDLEKHVVSITSGGELEKITKKENYIHFEVPENVGGRFSVLSSVGIAPLSCTSVDIKKLIDGAKSIEKSCKCEDIFKNPALMNAVIHKLMYNRGKTVSVMMPYIERLRSFGMWYGQLWAESLGKNGFGQTPVIAVGATSQHSQLQLYMDGPNDKIATFLKVNKYRNDLKIEYEYDHHLSGHNLSEVITSELVGTENSMKHNNIPNVKITLSKLNEITMGKLFLMYEMQTAISGELYGINAFDQPAVEYGKKIAHECLTGSKVDSENKYINGKYIITSK

SEQ ID NO: 24980 - protein, 465 aa, Methanococcus maripaludis S2
MFIDGKWIIREDIDVFDPYTLENIEKITALDREETKNAIEVTEKHKEIMKNLSPSKRYKILMKVAEHLSSKKDFFAKTISIDVGKPIKQSKIEVDRTLTALKLSAFYAKELRGETINSENGLIFTKKEPLGVIGAITPFNFPLNLATHKIGPAIATGNSVVLHPSSKAPIVAIYLTKIIEHVLKQMDIPRGVFNLATGNGEIVGDEISKNDNVNMVSFTGSVEVGESISKNAKMKKVTLELGGNNPMIVLKDSDIKLAAKSAVKSKFLNAGQVCISVGQVLVEEEVVETFTKYVIEETKKLILGNPLDKNTDIGPLISPESALRIENLIKQSVSEGGELLIGGNRQNSLISPAVINIDEENILSKIETFGPILPILTVKDSEEAVNIANNSKYGLQAGLFTNNINNAMKIADELEYGGIMINSSPTFRKDNMPFGGVKKSGLGREGIKYTVEEMSETKTVVIHNI

SEQ ID NO: 24981 - protein, 416 aa, Methanococcus maripaludis S2
MESYIQNLFAERIGGKSFGKEDVIYKFEKIKRAKQAAKLKYPDMELIDMGVGEPDEMADESVVEVLCEEAKKHVNRGYSDNGVQALKDEIPIYLEKIFGVKDLDPVNEVVHSIGSKPALAYITSVFINPGDVTLMTVPGYPVTATHTKWYGGSVETLPLLEKNNFLPELDAISKEVRENAKILYLNYPNNPTGAQATKKFYKEAVDFAFENDLIVIQDAAYAALTYGDKPLSFLSVKDAKEVGVEIHSFSKAYNMTGWRLAFVAGNELIVRGFAAVKDNYDSGQFIPIQKAGIHCLRHPEITEKTRAKYERRLSKMVKILKEAGFNAKMPGGTFYLYVKAPIGTKDGAKFANAEEFSQFMIKEKLISTVPWDDAGNFVRMAACFEAFKDGEISIEEEDRILNEVKRRLTEVEFVFE

SEQ ID NO: 24982 - protein, 268 aa, Methanococcus maripaludis S2
MICCLGPRGSYSEKAAVTFSKAINDSEIQFEDSIYNVFKAVETNPEFFGVVPSENSIGGSVSITQDLLLEFPVKILGEVDISINHCLLGYDIKKVTEVLAHPQALAQCGHYITKNNWNITPVDSNAKAAKIVSEEKDEKLAAICGVENAEIYGLNVLDEYIQDFKNNTTRFFLICNKNKNFKTDLKPKKASIVVELNKNMPGAFYEVLGVFKYRNVNLTRIESRPSKKEIGNYVFYIDYEYYDDNSALLRDLRIWALNVIELGNYFVL

SEQ ID NO: 24983 - protein, 431 aa, Methanococcus maripaludis S2
MLQRTNLTKSRKNGGIIMFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 24984 - protein, 280 aa, Methanococcus maripaludis S2
MKFDAWYTEPQTENLSLSTKLKDILYVGQSEYQEIQVLDTYEFGRVLILENTYQTTERDEFIYHELISHPALFTHGNPKKVLVIGGGDGGSVREVLKHKSVEKIDFVELDGQVVEVAKKFLPTLSCEIDNEKVNTIITDGIKYVAETSEKYDVILVDCPDPVGPAAGLFEKEFYNNLYKCLNDDGIMVQQTESPLLHEKLINKIKGHLKDAGFSTIRPLVCSIPTYPSGFWSFTLASKKNDPLNSDVSEIENKLKDMTTKYYDQDVHKGVFLATPRYLKE

SEQ ID NO: 24985 - protein, 282 aa, Methanococcus maripaludis S2
MYFEDYSKFLTAYDTFNDADFVIFGIPFDATTSYKPGARFGPDEVRNASWGLETFSPILKKDLIDVKICDKYNLLMEGNQSEIINRAYSASKDILEAKKIPVMIGGEHSVTYPVVKAVKSVYDDFAVIHFDAHCDLREEYMGNEQSHASVIRRTYDLTKDIFQFGIRSGDQDEWEFGWENTNISMEMPTKDDIKKIKELEKPIYVTIDIDVLDPAFVPGTGTPEPCGFTPKELINSLYLLEEIKEKIVGFDVVEVSPHYDIGKITSVTAAKIIRELILTISK

SEQ ID NO: 24986 - protein, 447 aa, Methanococcus maripaludis S2
MVEKSTEYRKTKILVTMGPSLDGTFEKSLEFIDGIRFNMSHTNTKHIEKYLDILNKKNIAKLMDLKGNKIRIKKSNFSELIENQVVKLGKDILISYIPECIKKGQNILINDGKIKLIVESVEKDITARVLVGGHIKEKMGVNFPEGCFPNDLTDEDIKNVKFAVENEFEYIALSFVRSETDILNLKNLIKEYSGNCSVIAKIETKEGLKNIDEILNHSDGVMIARGDLGVEVAIEYLPIIQKNIIKLANEKGKLIITATQMLDSMVNNPYPTRAEVTDVANAIFDGTDCLMLSNETTIGKYPIESIKTLDNIARVSENDISKYKQEIEFEEHSIYSGIAYAVEALSKKLNPKIVITPTTSGKTPLRISKFRFNSPIIALAPENIVFRKLRLVWGVIPIKIDEIGDVDEVLEISKKIAKNIIDSGIYVVTLGHPKGEKKTNVIKVESI

SEQ ID NO: 24987 - protein, 473 aa, Mycobacterium aurum
MTIMAPESVNESLDPRDPLLRLSTFFDDGTVELLHERDRSGVLAAAGTVNGVRTVAFCTDGTVMGGAMGVEGCAHIVNAYDTAIEEQSPIVGIWHSGGARLAEGVKALHAVGLVFEAMIRASGYIPQISIVVGFAAGGAAYGPALTDVIIMAPESKVFVTGPDVVRSVTGEDVDMVSLGGPEAHHKKSGVCHIVADDELDAYERGRRLVGLFCQQGHFDRTKAEAQDSDLKALLPESARRAYEVRPLISALLDEGVPFEEFQSRWAPSIVVGLGRLAGRSVGVIANNPLRLGGCLNSESAEKSARFVRLCDAFGIPLVVIVDVPGYLPGVDQEWGGVVRRGAKLLHAFGEATVPRVTLVTRKIYGGAYIAMNSRSLGATKVFAWPDAEVAVMGAKAAVGILHKKKLAAAAPEDREALHEGLALEHERIAGGVDSAIEIGVVDDKIDPAHTRSVLTQALAEAAPRRGRHKNIPL

SEQ ID NO: 24988 - protein, 348 aa, Candida boidinii
MSIPTTQKAVIFYENGGPLEYKDIPVPTPKPNEILINIKYSGVCHTDLHAWKGDWPLATKLPLVGGHEGAGVVVAKGSNVTNFEIGDYAGIKKLNGSCMSCEYCQQGAEPNCPDADLSGYTHDGSFQQYATADAVQAAKIPKDCDLATIAPILCAGVTVYKALKTADLRPGQWVCISGAGGGLGSLAIQYATAMGLRVIAIDGGDEKATFCKSLGAETFVDFTKTKDMVKAIQEATNGGPHGVINVSVSDAAISQSVEYVRPLGKVVLVGLPAHSVVKSPVFEHVVKSIEIRGSYVGNRLDTAEAIDFFSRGLVKATIKIIGLSELPKVYELMEQGAIIGRYVVDTTK

SEQ ID NO: 24989 - protein, 375 aa, Candida boidinii
MLSQTFLRRTPIIRKSPISLALRLQSTFQIPEKQMAVIFETNGGPLEYKEIPVPKPKPTEILINVKYSGVCHTDLHAWKGDWPLATKLPLVGGHEGAGVVVAKGESVTNFEIGDYAGIKWLNGSCMSCEYCEQGHESNCPDADLSGYTHDGSFQQYATADAIQAAKIPKEADLAEVAPILCAGVTVYKALKTANLQAGQWVAISGAGGGLGSLAVQYAKAMGYRVVGIDGGADKGELVKSLGGEVFIDFTKEKDLTKAIQDATNGGPHGVINVSVSEAAISQSCDYVRSTGKVVLVGLPAGAVCHSPVFQHVVKSIEIKGSYVGNRADTREAIDFFSRGLVRSPIKVVGLSELGDVYEKMEKGAILGRYVVDTSY

SEQ ID NO: 24990 - protein, 371 aa, Candida boidinii
MLSQVFRRSMINRSSLMTRFQSTFTIPEKQMGVIFETNGGPLEYKEIPVPKPKPTEILINVKYSGVCHTDLHAWKGDWPLPVKLPLVGGHEGAGVVVAKGESVTNFEIGDLAGIKWLNGSCMSCEFCEEGNESNCLDADLSGYTHDGSFQQYATADAIQAAKIPEGTDLAEVAPILCAGVTVYKALKTADLAAGQWVAISGAAGGLGSLAVQYAKAMGLRVLGIDGGAAKKELFHSMGGDVFIDFKEEKDIVKAIQDATNGGPHGVINVSVSEAAISQSCDYVRPTGKVVLVGLPAGAVCKSPVFQHVVKSLEIKGSYVGNRADTREALEFFSRGQVKSPIKIVGLSELPMVYGLMEKGAILGRYVVDTSY

SEQ ID NO: 24991 - protein, 461 aa, Streptomyces coelicolor A3(2)
MTKEFDLAALLAERGAERYELHARHLNHQLPRMLHTIGFDKVYERAEGAHFWDADGNDYLDMLAGFAVMGLGRHHPVVRKALHDVLDASLADLTRFDCPPLPGLLAEKLLSYSPHLDRVFFGNSGTEAVETALKFARYATGRQRILYCPHAFHGLTAGSLSVNGEDGFRKGFAPLLPDTAVPLGDLDALARELKKGDVAALIVEPVQGKGVHEAPPGYLLAAQELLHRHKALLIADEVQTGLGRTGKFYAYQHSDGVEPDLVCVAKALSGGYVPVGATLGKDWIFQKVYSSMDRVQVHSASFGSNAQAMAAGLAVLSVMENEEIVANAAAVGERLKSRLAELVDRYELLADVRGRGLMIGIEFGRPRSLKLRSRWTMLQAARKGLFAQMVVVPLLQRHRILTQVSGDHLEVIKLIPPLIVDTDDADRFVDAFTEVMEDAHHGGGLMWDFGKTLVKQAVANR

SEQ ID NO: 24992 - protein, 363 aa, Streptomyces coelicolor A3(2)
MRRARAAVVREPGAPFTVLEVELEDPRPREVLVRMTAAGVCHTDLGIQAGWPRRLTPMVFGHEGAGRVEAVGAEVTGLVPGDTVCLTFASCGGCGQCTAGHPAYCDAARDLNLSGGRGDGSTPLRLDGAPLHGGFFGQSSFATYAVVHEHGVVRVPADLPATLAAPLGCGGQTGAGTVLNRLRPEPGTSLVVLGAGGVGLSALMAAVAVGCDPVLAVDPVASRRDLARALGARAALPPDDALVAAVRQLTDGGAHHVVDTTGRPGMLDRAVAALRPRGALALLGLGGEVTFDMMRLMTKGVRLHGVMEGDSDPARFVPELIALHRRGLFPVDRLVTTFAFEEIGAAVAAMRDGSAVKPVLTFS

SEQ ID NO: 24993 - protein, 247 aa, Trifolium repens
NIAVGTPAEATHPDTLKAGLAELISTFIFVFAGSGSGIAYNKLTDNGAASPAGLISASIAHAFALFVAVSVGANISGGHVNPAVTFGAFVGGNITLFRGIVYIIAQLIGSVLASLLLVFVTASSVPAFALSEGVGIGPALVLEIVMTFGLVYTVYATAVDPKKGNIGIIAPIAIGFIVGANILVGGAFTGASMNPAVSFGPAVVSWSWSNHWIYWAGPLIGGGIAGIIYEVLFISHTGHEQLPTTDY

SEQ ID NO: 24994 - protein, 1501 aa, Candida albicans
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLPTSTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 24995 - protein, 165 aa, uncultured archaeon
MFRLYGRVSPGGVQSNIRFWAPNPIYFSRALGSRVWSIDGVEYVDLITGYGSVILGHGDPLVKKTVEEALEAGLTTGLESELAYKVVDLIHGMVPSAEMVRLSVIGTEAVMHALMIARAATGRLRIVKAEGCYHGWYDQVYVSLHPPLDKAGPRDEPNVVPISRG

SEQ ID NO: 24996 - protein, 409 aa, Yersinia pestis biovar Medievalis str. 91001
MGSVMTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGCTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHYGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 24997 - protein, 124 aa, Yersinia pestis biovar Medievalis str. 91001
MRIVNYALMSSLFSMCSLPLITTILSTVPTAVYAANGNGGNGGDGSNSGNGGNGGNAGTDSNGNGGHGGSGGNNGGNGGRGGNGDGSGNGGRGGDAGWGGGSGGSGGRGGASGQDGSSGTSTAR

SEQ ID NO: 24998 - protein, 184 aa, Yersinia pestis biovar Medievalis str. 91001
MVSQVRMGLMDYQTQIVKMEGTAVKALYILIMARVEMGGMAQQIMLRVEMAVMAAMVLPMVAPAGMEGMDKYLLSKLIFTVLLGISLSSEAALNIYSHNLIKTVGDGGAGGNGGNGVGGGNGGHGGNAGSGQNSHGGAGGNGGNSGGRGSSGGNGGGGGNGGSGSNSSGGQGGDGGNAGNSGLT

SEQ ID NO: 24999 - protein, 369 aa, Yersinia pestis biovar Medievalis str. 91001
MDKLFTPFKVGDTELVNRVVMAPMTRSRATVGDTADELTAKYYQQRASAGLIITEGSQISVQGQGYLFTPGIYNDAQVKGWERVTNAVHNAGGKIYIQLWHVGRISHTGLQNDGQAPVSSVAVKAKNSTCYARDENGQPGLVPVSEPRALSVSEIKDIVQDYVQAADNAIRAGFDGVEIHAANGYLLEQFINGGLNTRQDEYGGADPENRLRFVLEVTDAISQAIGAGKTGIRLAPFGRLFDMHPFEGEEETWLLLAKELSTRSLSYVHLSDQQTLGEQAIPAGFIEKFRAAYDGPLIIAGGFDKQRAEQYLQQGKADLIGFGRPYIANPDLVERMVNDWPLNQVDRATMYGGDEKGYTDYPVWSDTQA

SEQ ID NO: 25000 - protein, 490 aa, Yersinia pestis biovar Medievalis str. 91001
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPQALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELGSFNSVF

SEQ ID NO: 25001 - protein, 486 aa, Yersinia pestis biovar Medievalis str. 91001
MALRLVTGVILQTGVFLMSKQQIGVVGMAVMGRNLALDIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 25002 - protein, 459 aa, Yersinia pestis biovar Medievalis str. 91001
MILRHPIERVITTMNIYKKISADGWQPQQLTIKDVKFATWLAFFAWVFAVYDFILFGTLLPEIGDHFGWDEIEQAKLATWVAAGGAVVALTVGPIVDRLGRRLGIVFTVTGAAISSLLTAIGGAWGKGVLVGIRSIAGLGFAEQTVNATYLTEMYAAINDPILNRHKGFIYSLVQGGWPVGALVASGLSALLMPIIGWQGSFIFAAVPSFIIALLALKLKETPQFQIHQHIRRLTEAGQPEKARQVAKDYHFEYADHQRTGLSAIFRGTSLRTTLVLGGALMINWFAIQIFGVLGTTVITKVHDVSFESSLWVLVLSNLVGYCGYLAHGWLGDRFGRRNIIALGWMLGGLSLATMLYGPADFSLIVILYSAGLFFLIGPYSAALFFFSESFPTAIRATAGAFIIAMGPIGAIIASMGATSILSSGGNWQTAALLFGAIPCFISGVIMLFAHHVAPQSVK

SEQ ID NO: 25003 - protein, 1318 aa, Yersinia pestis biovar Medievalis str. 91001
MGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 25004 - protein, 330 aa, Yersinia pestis biovar Medievalis str. 91001
MTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 25005 - protein, 268 aa, Yersinia pestis biovar Medievalis str. 91001
MERYQQLFKQLAAKKEGAFVPFVQLGDPSPAMSLNIIDTLIAAGADALELGIPFSDPLADGPTIQNAALRAFAAGVTPGICFEILAEIRQKHPTIPIGLLMYANLVFHNGIDHFYQRCAEVGVDSVLIADVPFEESAPFRAAALRHGIAPIFICPPNADDDLLREIASHGRGYTYLLSRAGVTGAENHGQLPLNHLVDKLREYNAAPALQGFGISEPAQVKASLAAGAAGAISGSAIVKIIEKNVAQPVEMLVQLTRFVTEMKAATRS

SEQ ID NO: 25006 - protein, 365 aa, Yersinia pestis biovar Medievalis str. 91001
MKTAKLFSPLKVGALTLPNRVFMAPLTRLRSIEPGDIPTPLMAEYYRQRASAGLIITEATQISFQAKGYAGAPGLHTQEQLNAWKKVTQGVHNEGGHIAVQLWHVGRISHNSLQPGQQAPVAPSAIAADTRTTVRDETGAWVRVPCSTPRALETEEIPGIINDFRQATANAREAGFDYIELHAAHGYLLHQFMSPASNQRTDQYGGSIENRTRLTLEVVDATAAEWGADRIGIRISPLGPFNGLDNGEDQEEAALYLIDQLNKRNIAYLHISEPDWAGGKPYSDTFRAAVRAHFNGVIVGAGAYSAEKAECLIQKGFIDAVAFGRSYISNPDLVTRLQQHAPLNEPDSNTFYGGGAKGYTDYPTL

SEQ ID NO: 25007 - protein, 166 aa, Yersinia pestis biovar Medievalis str. 91001
MPARYLIDGNQLTTRYQELQRQFHPDRFATQPERERLASMQQAATINDAYQTLKHPLKRAEYMLSLQGFDLGNEQHTMRDTAFLMEQLELREELDAIERKPDAETLLAEFSRRVAQMTTTRTQQMVEQLDAQLWVQAADTVRKLRFLDKLQQQVEQLEERLFDDFA

SEQ ID NO: 25008 - protein, 363 aa, Yersinia pestis biovar Medievalis str. 91001
MSIEINNISKYFGRTKVLNDITLDIPSGQMVALLGPSGSGKTTLLRIIAGLENQNAGRLSFHGTDVSRLHARDRRVGFVFQHYALFRHMTVFDNIAFGLTVLPRRERPNAAAIKQKVGQLLEMVQLGHLAERFPSQLSGGQKQRVALARALAVEPQILLLDEPFGALDAQVRKELRRWLRQLHEELKFTSVFVTHDQEEAMEVADRVVVVSQGNIEQVGTPDEVWREPATRFVLEFLGEVNRLSGEIRGSQLFIGAHHWPLDLAPMHQGSVDLFLRPWEMEVSTQSSDRCPLPVQVLEVSPRGHFWQLTVQPIGWHQDPISVVLPEGNIDAPVRGNRYYVGGLNARLYSGNQLLQPIALAQSA

SEQ ID NO: 25009 - protein, 364 aa, Yersinia pestis biovar Medievalis str. 91001
MCAMRTYVSFKNIKKSYDGDKLVVKNLNLDIHEGDFLTLLGPSGSGKTTSLMMLAGFETPTQGEITLRDKPLHNLPPHQRGIGMVFQNYALFPHMTVTENLAFPLTIRRLNKADIKEKIDRILDMVKLKNLADRYPAQMSGGQQQRVALARALVFEPKLVLMDEPLGALDKQLREHMQLEIKQLHKMLELTIVYVTHDQSEAMTLSNRVVVFNDGIIQQMDSPSVIYEQPSNTFVAQFIGENNCLLAVNQGSDGEYYRAMLDDGTRLQALKVCPSSPGKKIMLCIRPERVSVNHPAAGSQQIKARIQQFIYLGDHVRMMTEVAGQGNFMVKLSAAHIEPHWQPGSEVLLSWMPAHLRALEGVTH

SEQ ID NO: 25010 - protein, 487 aa, Yersinia pestis biovar Medievalis str. 91001
MKTLNVDVAVIGGGTAGLGAYRAAKLLTPNVVMIEGGEYGTTCARVGCMPSKLLIAAAEAVHQIEKAPGFGIHPQGKPLINGREVMDRVKRERDRFVGFVLEGVETIPAADKIQGYARFIDDNTLQVDDHTQLTSQKIIAQRIVIATGSRPSWPASWNELGDRLIINDDVFNWDDLPESVAVFGPGVIGLELGQALHRLGVQVKMFGVGGAVGPLTDSIVRDYAAKTLGDEFYLDPDVKVELMQREGDKVFIRYLDKSGRPQEIMVDYVLAATGRRPNVDKLGLENTSLILDERGVPQADRLTMQTNVPHIFIAGDASNQLPLLHEASDQARIAGVNAGGFPEVVPGLRRSPISVVFSDPQIAMVGATFRELAQKFSACGCFEIGEVSFENQGRSRVMLKNKGILRIYGEQGTGRFLGAEMMGPSAEHIAHLLAWAHQQQMTIDQMLDMPFYHPVIEEGLRTALRDLQSKLKLGADEAERCLRCPGE

SEQ ID NO: 25011 - protein, 338 aa, Yersinia pestis biovar Medievalis str. 91001
MKYDGYNWLECVMKPSIVLYKSIPTDLHQRLAQHFTVNSFDGLTPDNQPELLAALQQAEGLIGSGGKIDQDFLQLAPNLRAASTISVGYDNFDVEALSQRGIALMHTPTVLTETVADTMMALMLSTARRVVELAERVKAGEWQESIGDDWFGVDVHHKTIGILGMGRIGMALAQRAHFGFSMPVLYTSRRPHEAAEQRFGARHCSLDTLLAEADFLCITLPMTEQTYHMIGREQLAKMKSSAILINAGRGPVVDEQALIAALQDGTIHAAGLDVFEQEPLPVDSPLLTLRNVVAVPHIGSATHETRYNMAACAVDNLINALTGTVKENCVNPQVLITH

SEQ ID NO: 25012 - protein, 279 aa, Physcomitrella patens
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWDDHWIFWVGPFVGAALAAAYHQYVLRAGPFKQLGSFRSAPSRV

SEQ ID NO: 25013 - protein, 115 aa, Mycobacterium avium subsp. paratuberculosis
MTLDPQIAARLKRNADGLVTAVVQERGSKDVLMVAWMDDAALARTLETREATYYSRSRGQQWVKGETSGHTQYVHSVRLDCDGDTVLLTVDQVGGACHTGDHSCFDADVLLHPQD

SEQ ID NO: 25014 - protein, 131 aa, Bifidobacterium longum
MTDTTYDNSTELDPRIAARLKRDAKGLVAAVIQQYDTREVLMVGYMNDEALRRTLTTGRVTFWSRSRQEYWRKGDTSGHVQYVKGVSLDCDGDALLVEVDQVGAACHTGKRSCFLEGGPLPVVEGHRPAEQ

SEQ ID NO: 25015 - protein, 289 aa, Bacillus halodurans
MRFDEAYSGKVFIMSRSNYEKSKAVIFGMPMDWTVSFRPSSRFGPNRIREASLGLEEYSPYMDKHLEEVAYFDAGDMLLPFGNPQRSLEMIESYVDKLLADQKMPIGLGGEHLVSWPIFKAMHKIYPDMAIIHIDAHADLREEYEGEPLSHSTPIRKACSLIGPENVYSFGIRSGMREEFQYAKDSGMYMAKFEVATPLKEVLPKLAGRNVYVTIDIDVLDPAFAPGTGTAEAGGISSKELLEAIVAIAHSDVNVIGADLVEVAPAYDPSEKTPIAASKFVREMLLGWV

SEQ ID NO: 25016 - protein, 444 aa, Capsella bursa-pastoris
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHHLKSVIEKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTTECGKEVQIVGDDLLVTNPKRVAKAIAEKSCNALLLKVNQIGSVTESIEAVRMSKKAGWGVMTSHRSGETEDTFIADLAVGLSTGQIKTGAPCRSERLAKYNQLLRIEEELGSEAVYAGVNFRTPVEPY

SEQ ID NO: 25017 - protein, 388 aa, Aspergillus parasiticus
MVLPTAPEPPTLLGYHRILSPSAGVRVSPLCLGTMSFGNGWKGVMGECDQATSFNMLDTFYESGGNFIDVANFYQGGDTERWVGEWMAQRQNRDEIVLSTKYTMGYTMFGPQKIKSNFQGNHAKSLRLSVKASLQKLQTDYIDLLYVHMWDFTTSVEEVMRSLNHLVANGKVLYLGVSDTPAWLVVKCNAFARANGLTPFSVYQGHWSSAFRDFERDILPMCESEGMGLAPWGVLGRGQFRSAEEFSREGRKMGPQDEKHRRLGEKLDQMAQQKNTKATSIAQAYVMHKAPYVFPVIGGRKVEHLKENIEALGLVLSEEEIREIDDAEPFDVGFPMNFLFETPTQSYRTNMTSKDIWQLSCNTRLETVPKQQPIEPLQGAKYFGSASK

SEQ ID NO: 25018 - protein, 382 aa, Aspergillus parasiticus
MSTSAPLLSRYRQLSPAASIRVSPLCLGAMTFGVSDGEMFGECSKEMAFAILDHFYQQGGNFIDTANGYRAGESEMWLGEWMASRKNRDDIVLATKYAAGYRGHEKNRIQVNYGGTGTKSMRLSVDASLQKLQTSYIDLLYVHWWDYTVSIPELMHALNDLVASGKVHYLGISDSPAWVVSKANQYARDHGLRQFVVYQGLWNAAKRDLERDILPMCLDEGMGLCPYGVLNQGRFRTEEGFRDRDQTNNAGGRNIIPLSEHDRSVSRVLDIVATSKGVPLLQVALAYVMQKAPYVFPIVGVRKVDHLTGVEPAVHISLTDEEVNAIENAYEFDPGFPHTFLSGSMFAQGPPKGGYSPDVVWWTKMLGTFDWVEGAKPIRPQP

SEQ ID NO: 25019 - protein, 314 aa, Aspergillus parasiticus
METPFAGPWHQFVEDLGQTPCLPGKDLDSILAGWGQLAGTLATRYGFPPPDESVATEDVQLDGLWLRCYTPANATGQEPVGLYFHGGGWVMGGVKEEDGFCRVISRQCQMRLVSVEYRKAPETRYPGALNDGVSAALWAQSRYENQPLVLMGTSAGGNLAFGTALRLIDQDMADKVSGVVALAPITVHPDAVPEHLKEQYTAYEENAELTVNSRAAMQVFFDCYKAPVDDVYTSCLLHPRLLALPKVYIAELGLDTLRDDARLMKGALDTAKVPVMYDAYPGYPHCSFMFPFKSLGEHQRTFLGGVAKAVRWMS

SEQ ID NO: 25020 - protein, 492 aa, Aspergillus parasiticus
MPEFSLLAGHFGTLKKTIQGMPSDATLHSIMLKISQQFSSGIFYINMWPFSGTWMVVSTPSAASQIQKLNLTKPVILRRPLETVTGGPSMMSMHGETWKKWRALFNPGFNPGYIIGLAPNITDEVATFWLSCAKGQQGEVFPLESLTTRLTVDSICSVVLDTQLHHQIKDHPLATALQRQIDWTTFGTTFNPLKRYLTIRPLVLWYNNKVMDRIIGGEVDRACRTPPDHPSKSVISLALREYLQEQASTNSTRSLAEFKRLVAPQLRVFLFAGRNTTSSTLIYSYYLLAQHPEVLAKIRAEHEDVLGADPAEAQGRIKEDVQLLNKLPYTTAVIKETLRLFPPSASMREGRPDAEIIGEDGQRYPTVGCNVWTLTVALHHNSDYWDQVENFIPERWLVGPEDPLYPVKGAWRAFEFGPRSCIGQTLAMLELRIALAMTIRQFDITPAYDEWDSIHPATTAKEVNGHRAYQAERGAGGAHTADGFPCRVKERC

SEQ ID NO: 25021 - protein, 444 aa, Aspergillus parasiticus
MARAGQAVDPSPLGQPLEFHFARRSAPNRFLKAGMSERMCSWTEENPSARGIPSRELIETYRTWGRGNIGAIVTGNVMIDPNHIEAEGNPTIPPNALFSGERFDQFANLAAAARANGSLILAQISHPGRQTPSHRQPEPISASDVPLDTENMGNTFAVPRAATENEIKNIITGFAHAAEFLDRAGYDGVELHAAHGYLLNQFLSRATNLRTDKYGGTLTNRMRLILEIRAAITEKVRPGFIVGIKINSVEFQPNGIVPDEACELCCALEEHRFDFVELSGGKYKNLEEDDNAKHIISKRHEAFFLDVAQKVVSSLTKMKSYLTGGFRSTAGMVDGLQTVDGIGLARPFCQEPYLCHDILRGKIPGAIIPVMDQLNYQLTVAAACIQMRQIGNKVQPVDLSSQDAVDAITAAAEGWLKRKAIDRSEEAFKPPLLSGDAAPLSVEA

SEQ ID NO: 25022 - protein, 355 aa, Metarhizium anisopliae
MSRSNPPNAGGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPTPEEFFDFDKHKDTLSKEQLKQLIYQEIMR

SEQ ID NO: 25023 - protein, 504 aa, Medicago truncatula
MGLVSRTTTTTTQEGLPVSVSTTVPKKKWSNLMPLFVALVVIAEIAFLGRLDMAKNAATVADLFYRSRAVVEGDDFGLEMVGGDKNLELESESCEEWLGREDAVPYSRNFTKEPVFVSGAEQEWKSCSVGCKFRFNGDRKPEAAFSLPQQAGTASILKSMESAQYYAENNIAMARRRGYHIVMTTSLSSDVPVGYFSWAEYDIMAPIKPKTEKALAAAFISNCGARNFRLQALEALEKTNISIDSYGSCHRNRDGRVDKLEALTRYKFSLAFENSNEEDYVTEKFFQSLVAGTIPVVVGPPNIQDFAPSPGSFLYIKELEDVESVAKSMRYLAENPEAYNQSLRWKYEGPSDSFKALVDMAAVHSSCRLCIHLASKSREKEEKSPDFKRRPCKCTRGSETVYHIYVRERGTFEMESIYLRSSNLTLESFKTAVLTKFTSLNHVPVWKPERPEILKGGDELKVYKIYPAGLTQRQALYTFKFNGDVDFRSHLESNPCAKFEVVFV

SEQ ID NO: 25024 - protein, 505 aa, Hordeum brevisubulatum
MAAPPAIPRRGLFIGGGWREPTLGRHIPVINPATEATIGDIPAATAEDVELAVAAGGPVLARRREHWARASGAVRAKYLNAIAAKIKEKISYLALLETVDSGKPKDEAVADMDDVAACFEYYAGLAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKMIMTAAAQMVKPVSLELGGKSPLVIFDDVADIDKAVEWAMFGCFFNGGRVCSATSRLLLHEKIAARFLDRLVEWVKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDNLERCERIAKVIHSGIVWINCSQPTLVQAPWGGNKRSGFGRELGEWGLENYLSVKQVTRYCKDELYGWYQRPSKL

SEQ ID NO: 25025 - protein, 423 aa, Aspergillus oryzae
MADLRGRKIFKVFNQDFIVDERYNVTKELGQGAYGIVCAATNIQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKIPFQRLFPSANPDALDLLDRMLAFDPSSRISVEEALEHPYLHIWHDASDEPTCPTTFDFHFEVVDDVQEMRRMIYEEVVRFRAAVRQQSQAQAAAAAQQQQIAQQTNVPIPENQQGVWKQEEPKPQEALAAGGGVHNDLESSLQRGMDVQ

SEQ ID NO: 25026 - protein, 215 aa, Sodalis glossinidius
MSAQQQAVILAHCRQHGIWIVSDEVYSRIVFDGPPEGCAPSFLDIADPDDRLLVINSFSKSWLMTGWRLGWVVAPPALMYELGKLIEYNSSCAPGFVQKAGLVAVNQGEAVRQETVALFQASRDYLYQRLGTLPDIEVPLPAGAIYLFFRVRGLDDSLAFCKALVAEAGVGLAPGSAFGDAGEGCLRWCIASSIEKLEQGADRFSRFLHRSPLRR

SEQ ID NO: 25027 - protein, 279 aa, Rhizobium etli
MTARMDKRFAELKAEGRPALVTYFMGGDPDYDTSLGIMKALPEAGSDIIELGMPFSDPMADGPAIQLAGQRALKGGQTLKKTLQLAADFRKTNDLTPIVMMGYYNPIYIYGVEKFLDDALAAGIDGLIVVDLPPEMDDELCIPAIRKGINFIRLATPTTDEKRLPTVLKNTSGFVYYVSMNGITGSALPDPSLVSGAVQRIKQHTELPVCVGFGVKTAEHAKVIGGSADGVVVGTAIVNQVATSLTKDGKATPDTVQAVATLVRGLSSGARSARLVAAE

SEQ ID NO: 25028 - protein, 324 aa, Anabaena variabilis ATCC 29413
MDIKNGFVGTVGNTPLIRLNSFSEETGCEILAKAEFLNPGGSVKDRAALYIIEDAEKKGLLKPGGTVVEGTAGNTGIGLAHICNAKGYKCLIIIPNTQSQEKIDALTALGAEVRPVPAVPYKDPNNYVKLSGRVAAELDNAIWANQFDNLANRLAHYETTGPEIWTQTDGKVDGWVASTGTGGTFAGVAMYLKDQNPAIKCVVADPLGSGLYSYIKTGEIKIEGNSITEGIGNSRVTANMEGAPADDAIQIDDHEALRVVYQLLRKDGLFMGGSTGINVAGAVALAKQLGPGHTIVTILCDSGSRYQSRIFNRDWLASKGLTVD

SEQ ID NO: 25029 - protein, 476 aa, Anabaena variabilis ATCC 29413
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKTAGGLDAKQLHEVFAQWNTTDELNSFLIEITANIFPYVDPDTKLPLVDLIVDAAGQKGTGRWTVQTALELGVSIPTITAAVNARIISSIRDERIAASKQLTGPSGKYDGDTKEFINKVRDALYCSKICSYAQGMALLSTASTTFNWNLNLSELARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 25030 - protein, 116 aa, Anabaena variabilis ATCC 29413
MNQNLLWFEKLKFNNQDLIPAIAQDYRDGTVLMMAWMNSESIQKTLSTGEAHYWSRSRSQLWHKGATSGHIQKVKELFYDCDGDTILLKVEQIGDIACHTGARSCFFNAVPIYPQS

SEQ ID NO: 25031 - protein, 390 aa, Anabaena variabilis ATCC 29413
MQFAKRLEKIPPYLFAEINRKREALIAQGVDIINIGVGDPDKPTPAHILQAMREAIDEASNHNYPPYEGTQEFREAAVKWMERRFGVVDLNPNTEVVSSIGSKEAIHNTFLAFVEAGDYTLIPDPGYPVYRTSTIFAGGEPFTMPLKAENKFLPDLDLIPEEVARKAKMLWVNYPNNPTGALATLEFFEELVAFCQQHSILLCHDHAYSEMAYDGYKPPSVLQIPGAKDIAIEFHSLSKSYNMTGWRIGFAVGNAYAIQGLSQVKTNVDSGVFKAIQKAAIAAYNTDEVELQAVMSVYQNRRDIIVKGLQSLGWPIEPPKATLYVWVPVPPGYTSTEFTTLLLDKCGIVVPPGVGYGVSGEGYFRIALTICEERLHEAIQRMQDAGIRYS

SEQ ID NO: 25032 - protein, 137 aa, Anabaena variabilis ATCC 29413
MPKQKKIEPLVGEELLKKVKELENLSKEEKAKQCGYYTVTKNGIERVNMMKFLNALIDAEGIQLDSAPNANGRGGRSASYRISVQSNGNLLIGSAYTKQMNLKPGDEFVITLGKKHIRLRQVDGEEREILEIAEATA

SEQ ID NO: 25033 - protein, 140 aa, Anabaena variabilis ATCC 29413
MAQTQETTTKTHTLPLPTTITSRSVAATELRPWGSFTVLEEGRGYKIKRIEVKPGHRLSLQMHHHRSEHWIVVSGTARVVCGEKEILLSNNQSTYVPQCTAHRLENPGVIPLVLIEVQNGEYLGEDDIIRYQDDYSRTSN

SEQ ID NO: 25034 - protein, 439 aa, Anabaena variabilis ATCC 29413
MEKASLQHRDMFTAEVIGFGDTVVFVSHPQGIQTIFANDRKKLVAVGEANRILYPLVGNNSMFLLEGVKHKQRRQLLMPSFHGERMREYGHLIRNITETLFSQLQQNVTFSALTAMREISMQVILQAVFGFYEGERCQQFKHLLPVFLSELFQSPLASSILFFPFLQKDLGNLTPWGRFVRQREKIDKLLYEEIAERRQEINSDRIDILSLLISSRDETGNSMSDQELRDELITLMISGHETTGTAMAWSLYWILQTPEVFQRLIQELDSLGDSPDPMSIFRLPYLTAVCNETLRINPVAMLTLPRVVKEPVELLGNRLESGTTVVGCIYLTHHREDLYPESKLFQPERFLKREFSQYEFMPFGGGVRGCIGQAIAMFEMKIVLATVLSRYQFALADGKPERPQRQGFTLTPANGVKMLITGKHQRQNYSTAASTTFTT

SEQ ID NO: 25035 - protein, 333 aa, Anabaena variabilis ATCC 29413
MAATDFKDYYAILGVSKTATPEEIKQAFRKLARKYHPDVNPGNKQAEASFKEVNEAYEVLSDAEKRQKYDQFGQYWRQVGEGFPGGGAGVDMGGVDFSQYGNFDEFINELLGRFGGAAPRGGRQGYSYRTSGGRPGGGFGGFNDFGFQDVGTAGGGQDAEATISLTFAEAFAGVQKRFNLGNETIDVRIPAGTKPGTRLRVRGKGQFNPMTQQRGDLYLKVEFQPHSFFQIEGDNLACEIPITPDEAALGASIDVPTPDGSVNVKLPAGVRSGQSLRLRGKGWPIAKGGRGDQFVKVAIVPPKDMSQQEREYYEKIRAIRSYNPRSHLQQVKL

SEQ ID NO: 25036 - protein, 266 aa, Anabaena variabilis ATCC 29413
MTAISDRFETLKQNQECALIPFITAGDPDLETTAAALKILDSNGADIIELGIPYSDPLADGPVIQAAATRALQNGTKLESVLEMLKVTTPSLQAPIVLFTYYNSILHRGIDNFLEQVAAAGVAGLVVPDLPLEEAAGLLKPATERGIDLILLIAPTSSSERIEAIARSSQGFIYLVSVTGVTGMRSQVEGRVLDLLQKVRQVTDKPLGVGFGISQPAQATQVRDWGADAAIVGSAFVQRLATGTPAEGLSAIAEFCQSLKAAIKTS

SEQ ID NO: 25037 - protein, 404 aa, Anabaena variabilis ATCC 29413
MQFSQRLQPLQSNVFADMDKAKALALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFTDIPTDVLARSRMMVLSYPHNPTAAIAPLSFFKEAVAFCQEHNIALVHDFPYVDMVFEDSSNWDQNLSQSPIPNHRSLVPSILQADPDKSVSIEFFTLSKSYNMGGFRIGYAIGNAQMIQALRQIKAAVDFNQYRGILNGAIAALTGPQAGVEAAVSTFRQRRDAFIHALHHIGWYVPTPKATMYIWAKLPSSWSQNSIEFCTQLVKQTGVAASPGAGFGKSGEGYVRFALVHEPSILRTAVERISNFL

SEQ ID NO: 25038 - protein, 427 aa, Anabaena variabilis ATCC 29413
MSLQTLIEQATNPPESGSAASSPFSTDSFDASVMSTYGRFPLALERGAGCRVWDTQGREYLDFVAGIATCTLGHAHPAMVEAVTRQIQKLHHVSNLYYIPEQGELAQWIIQHSCADRVFFCNSGAEANEAAIKLARKYAHTVLDIEKPIILTANASFHGRTLATITATGQAKYQKYFDPLVPGFHYVNYNDISAVEAAISELDEGDYRVAAILIEPLQGEGGVRPGDVEYFQKLRQICDDTGILLMFDEVQVGMGRSGKLWGYEYLGVEPDIFTSAKGLGGGIPIGAMMSKKFCDVFQPGEHASTFGGNPFACGVALAVCQTLERENILQNVEDRGEQLRAGLRALAAKYPHHLTEVRGWGLINGLELAADIQLTAADVVKAAINEGLLLVPAGPKVVRFVPPLIVTEAEINTALKLLEKALATVTA

SEQ ID NO: 25039 - protein, 217 aa, Anabaena variabilis ATCC 29413
MTVTQLSAQELFRAAYDNRYTWDKDFPGYSADITFKDDDKVITGQVIVNAELKAEVLGVDDESAKKAIHGQAWEIAIHRVRRTFEETHGANTFRYGATDENGEVEILMGGKAEGDRYKVQNNVVTLVHRHIHGVVVTINTFGVHDTGEGYLSHTYDSVYHEPKTGEQRGGVSNFVDEYEKVGNYFILNRREIRTETAGKIAIQEFAFSNIKLLTPVA

SEQ ID NO: 25040 - protein, 329 aa, Anabaena variabilis ATCC 29413
MAQDRKSTVIVTGASSGVGLYAAKALAKRGWHVVMACRNLEKAEQAAQEVGIPKDSYTIIHIDLGSLDSVRQFVNDFRATGKSLDALLCNAAIYMPLIKEPLRSPEGYELTMTTNHLGHFLLCKLMLEDLQKSSAADKRLVILGTVTHNPDELGGKIPPRPDLGNLEGFAQGFKPPISMIDGKKFEPVKAYKDSKVCNVLTMRELHRRYHESTGITFTSLYPGCVAETPLFRNHYPLFQKIFPLFQKYITGGYVSQELAGERVADVIAAPEYKQSGAYWSWGNRQKKDGKSFVQKVSPQARDDEKAERLWDLSEKLVGLESQKPVALNS

SEQ ID NO: 25041 - protein, 507 aa, Anabaena variabilis ATCC 29413
MAKPKTFYICNECGAESPQWFGKCPACGTYNSLEEQITIQSSVDVLKGGVSGWHASQNNGKAPVKPAKPRASLTFDQITDRQIARWESGYGELDRVLGGGVVPGSMVLIGGDPGIGKSTLLLQVSNQLAQRYRILYVTGEESGQQVKLRASRLGVAKTLSVVGDDQREESEQTPLVSIADGVGADLYVLPETDLEEILREVDSLKPNVAVIDSIQTVFFPALTSAPGSVAQVRECTAALMKVAKHEDITMLIVGHVTKEGAIAGPKVLEHLVDTVLYFEGDRFASHRLLRTVKNRFGATHEIGIFEMVQNGLREVPNPSELFLGNRDDPAPGTAIVVACEGTRPIVVELQALVSPTSYPSPRRAGTGIDYNRLVQILAVLEKRVGIPMSKLDSYVASAGGLNVEEPAVDLGIAIAIVASFRDRIVDPGTVLIGEVGLGGQVRSVSQMELRLKEAAKLGFKKAIVPKGQKFPDFDIEIIPVAKVIDAIIAAIPHQELTEEDFNLDEDQ

SEQ ID NO: 25042 - protein, 485 aa, Anabaena variabilis ATCC 29413
MTIDYDVVIIGGSLTGRYAALTATQMGAKVALVESQQNNSLIIHQAIGEIANLTQNLHNLASCGIDAVHVDTSEKCQISLALSSAQGIAANVQEQMSLAHLSAQGVDVIVDSGQFQSSPHLAFAVTHRLLRGRTYLLASGSLPAIPKIEGLQTTDYLTPANIWQYLYKQHSQFSELPHNWVIIGGTPQSIEISQTLARLGCNITLVVKSPHLLPQLDPEIAQFLQAQLEVDGVRVLTQKMVTQVKRIDNKKWVQAGEKAIETDEILIAIGHKPNIESFNLPEVGVKWHQHRLLVNDKLQTTNHRIYACGDVIGGYDFPNIANHEARIALNNALFFPRWQVNYQNIPWAILSYPVLAQVGLTDIQAKHQFSQQEVIVLRHYYKSIAAAQLRNEITGICKLVVLRNGKILGATIFGTEARELINLIALAMSQNIPVKHLGNLSVVYPSFSEILEQTARNFSQQRFNSNTVWQDWLEGFFYLRRNWNL

SEQ ID NO: 25043 - protein, 319 aa, Anabaena variabilis ATCC 29413
MRIANDVTELIGGTPLVKLNKIPQAEGVVARIVVKLEGMNPASSVKDRIGVSMINSAEAEGLITPGKTILVEPTSGNTGIALAMVAAARGYRLILTMPETMSQERRAMLRAYGATLELTPGTEGMRGAIRKAEELVASTPDAHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMVQPSFGERYLSTPLFQDLTNETAGVR

SEQ ID NO: 25044 - protein, 135 aa, Anabaena variabilis ATCC 29413
MTQSENNGQLDANDSSSHSGLRYWGNVEVIEEGESYRISRIEIKPRHGIKPQIHYHRNEHWVVVSGVAKVTCGDDEVLLGRNQSTYVPAATLHKVDNPGSIPLVILEIQNGEYLGEDDTERPYDLNLVKPGVEIK

SEQ ID NO: 25045 - protein, 509 aa, Anabaena variabilis ATCC 29413
MSNSELDRVIVRPVDEYNQKLVAYVHPPNWVNPQPADSYDLVVIGAGTAGLVVAAGAAGLGLGLKVALIEKHLMGGDCLNVGCVPSKTIIRSSRVVGEIWNGKNLGINIPSQIDIDFPAVMARMRRIRADISHHDSAERFASLGVDVFLGSGKFASSDIVEVAGKTLKFKKAVIATGARATKPAIIGIEQAGYLTNETVFSLIQRPEKLAVIGGGPIGCELAQAFRRLGSEVVLIHSGSHLLNKEDNDAAQVVQQTLIKEGIRLVLNAKVEEVVTVTEGKRLYFSTNGYRDSVTVDEILVGAGRSPNVEGLNLEAVGVKYDKRRGVEVNDYLQTTNPKIYAAGDICMDWKFTHAADAAARIVIKNTLFSPFGLGRSKLSSLVMPWVTYTDPEIAHVGLYESQDVETIKIPFSSVDRAIADAQEDGFLKIHHKKGSDEIVGATIVATHAGEMISEITTAIVNKIGLNKLSNVIHPYPTQAEAIKKAADTYRRTLLTPRTKKLLGFLTKFS

SEQ ID NO: 25046 - protein, 458 aa, Anabaena variabilis ATCC 29413
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDTHTVEVGDRKYTADKILIAVGGRPLKPELPGMEYGITSNEIFHLKTQPKHIAIIGSGYIGTEFAGIMRGLGSEVTQITRGDKILKGFDEDIRTEIQDGMTNHGIRIIPNTVVTAVEQVPDGLKINLSGDQEPIIADVFLVATGRVPNVDGLGLENAGVDVVASSVEGPGYSTMNAIAVNEYSQTSQPNIYAVGDVTDRLNLTPVAIGEGRAFADSEFGNNRREFSHETVPTAVFSNPQASTVGLTETQAREKLGDEGVTIYRTRFRPMYHSFTGKQERIMMKLVVDTNTDKVLGAHMVGENAAEIIQGVAIAVKMGATKKDFDATVGIHPSAAEEFVTMR

SEQ ID NO: 25047 - protein, 418 aa, Anabaena variabilis ATCC 29413
MNPDESQTPEPIDEWLEQIQQENPKLENPENSSEESVLDIEGQTLLVEPLSVSNEELANSTDNLTAESTDDLVQQLETETTLLGSELPNNPLYTEAEQRIAELQRTEAALTEEIANLQAAYKILQGQVSETQTALGRIVQESLAQLEQRKQALQISVEQLERRQERIRNEMRTTFAGASQDLAIRVQGFKDYLAGSLQDLAASAEQLQLVPAVVEREKAPVKETKPAEPQAGTPQFAQQQFQDTTKQIRRLIDQYRNKPDYYGPAWQLRRTFEPVHAERVANWFFNQGGRGALRTMGSRLQNILIASAAISILHKLYGDRVRTLVLANTPERLGEWRRGLQDCLGIGRPDFGPDRGVVLFEAPDALAQKADRFVKANQLPLILIDDSEEQISLALLQFPLWLAFAPDPKLMRNTEDDF

SEQ ID NO: 25048 - protein, 246 aa, Anabaena variabilis ATCC 29413
MAETTSIIIAEDVHKWYGKFHVLQGVSLTVNRGEVVVLMGPSGSGKSTFIRTFNALEAYQKGRITIDGITLSHDLRNIDAIRREVGMVFQQFNLFPHLTVLQNITLAPIWVRRAKKAQAEELAMQLLERVGILEQANKYPGQLSGGQQQRVAIARALAMQPKIMLFDEPTSALDPEMVREVLDVMRSLARDGMTMVVVTHEVGFAREVADRVVLMDSGHLVESASPDNFFTKPQEERTRKFLSQIL

SEQ ID NO: 25049 - protein, 369 aa, Anabaena variabilis ATCC 29413
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSLNGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVKVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 25050 - protein, 320 aa, Anabaena variabilis ATCC 29413
MKIARNITELVGRTPLVRLNNIPQAEGSVADIVVKLESMNPSASVKDRIGVSMVESAEEAGLIHPGKTILVEPTSGNTGIALAMVAAAKGYHLILTMPETMSTERRSMLRAYGAQLELTPGLEGMRGAIARAEQIVTELPNAYMLQQFRNPANPKVHRQTTAEEIWSDTDGQVDIVVGGVGTGGTLTGVAQVLKERKPSFQAIAVEPSNSQVLSGGKSGAHKIQGIGAGFIPAICRLELIDQIIAVSDEDAIAYSRRLAREEGLLSGISTGAALYAAIQVAKRPENSGKLIVMVQPSFGERYLSTTLFKDLSELEISALN

SEQ ID NO: 25051 - protein, 403 aa, Anabaena variabilis ATCC 29413
MSFDWITPADRIQQLPPYVFARLDELKAKAREQGIDLIDLGMGNPDGATPQPVVDAAIQALQNPANHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALGRIKQAGIRYRPEALVSTPE

SEQ ID NO: 25052 - protein, 475 aa, Anabaena variabilis ATCC 29413
MSHEFDYDLVIIGAGVGGHGAALHAVSCGLKTAIIEAGDMGGTCVNRGCIPSKALLAASGRVRELRDAHHLKSLGIQIGNVEFDRQAIANHANNLVSKIQGDLTNSLKRLGVDIIRGWGKIAGTQKVTVTGDGGEKTITARDIILSPGSVPFVPPGIEVDGKTVFTSDQGVKLETLPEWVAIIGSGYIGLEFSDIYSALGCEITLIEALDQLMPGFDRDIAKLAERVLITPRDIETKVGVYAKKVIPGSPVVIELADFKTKEVVDVIEVDACLVATGRIPATKNLGLESIGVELDRRNFIPVDDRMAVLSAGEVVPHLWAIGDANGKMMLAHAASAQGIVAVENIIGKERTVDYRSIPAAAFTHPEVSYVGLTETGAKELGQAEGFEIATSRSYFKGNSKALAENEADGIAKVIYRKDTGEVLGVHIFGLHASDLIHEASAAVANRQTVQTLAHLVHAHPTLSEVLDEAYKRAIV

SEQ ID NO: 25053 - protein, 161 aa, Anabaena variabilis ATCC 29413
MKSQEEELLDKQGEDLKPDSSWNQALLATTAPLIQNISQTQLQQISPAALAYVGDAIYELYVRMFYLLPLQRSDAYHRLVVAQVRAETQALHLRSLTPYLRASELEIVRRGRNAAAGRPKRVDPEIYQQATSLEALIGYLYITDFPRLTELLQKIHLEKEE

SEQ ID NO: 25054 - protein, 152 aa, Anabaena variabilis ATCC 29413
MADFLPSPEQEDNRSGFEPELGGFLRDAPERSGFEPELGGILRQKGVYVDEITCIGCKHCAHVARNTFYIEPDYGRSRVIRQDGDAEEVIQEAIDTCPVDCIHWVDYTELKNLEEDRKFQVIPVVGYPVDHAVATTEKRRKKQKSKNKKSRY

SEQ ID NO: 25055 - protein, 387 aa, Anabaena variabilis ATCC 29413
MEIQLGRGKTARRAYGIDEIALVPGNRTLDPSLADTRWKIGNIEREIPIIASAMDGVVDVKMAVRLSQLGALGVINLEGIQTRYADPEPILDRIASVGKDEFVSLMQELYAEPIKPELITKRIQEIKEQGGIAAVSATPVGASKYGEVVAQAGADLFFIQATVVSTAHLSPESVVPLDLAEFCRSMPIPVILGNCVTYEVTLNLLKAGAAAVLVGIGPGAACTSRGVLGVGVPQATAIADCAAARDDYYRETGNYIPIIADGGLITGGDICKCIACGADGVMIGSPFARAAEAPGRGFHWGMATPSPVLPRGTRIRVGTTGTLEQILTGPAGLDDGTHNLLGALKTSMGTLGAKDIKEMQQVEVVIAPSLLTEGKVYQKAQQLGMGK

SEQ ID NO: 25056 - protein, 341 aa, Anabaena variabilis ATCC 29413
MKVAVFSTKAYDRQFLEAANAPKQHDLVFFEPRLNQDTAILAAGFPAVCVFVHDQVDAATLEILASRGTRLIVLRCAGFNNVDLKAANKLGVNVVRVPAYSPYGVAEHAVGLILSLNRKIHRAYNRVREGNFALDGLLGFNINGRTVGIIGTGKIGLILGQIMKGFGCRLLAYDVYHNPEMLALGGEYVELPELFANSDIISLHCPLMPQTHHLINAEAIEQVKPGVMLINTSRGALIHTQAVIEGLKTGKIGSLGVDVYEQESELFFEDLSGEIIQDDIFQRLTTFPNVLITGHQAFFTEDALRNIAETTLNNIADIEQGRSCPNEIRYQPEVEAKVLVS

SEQ ID NO: 25057 - protein, 260 aa, Anabaena variabilis ATCC 29413
MKQPLIQLKGVSKSFGNNQVLDNVDLTIYRGEALGIIGPSGTGKSTILRIIAGLITPDAGEIYVQGVKREGLIEDGQDPVGIGMVFQQAALFDSLTVEENVGFLLYQHSRLERSRIRELVAEKLEMVGLRGIGHLYPSELSGGMRKRVSFARAIMSNPDNPAEGPEVLLYDEPTAGLDPIASTVIEDLIRDLQCTHGVCSTYAIVTHQDSTIRRTSDRLVFLYQGQVQWEGTVSDIDTTDHPLINQFVSGSVQGPIQVVG

SEQ ID NO: 25058 - protein, 325 aa, Anabaena variabilis ATCC 29413
MSNPRVLCLGEVLFDCLADQLGLKLEEVKSWTAYPGGAPANVACALVKLGTPAGFIGAVGEDEPGNALVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSQHGIHNLNDAETAKRIITYASAVGALTTTKAGAIASQPTAVEVETFLASHKI

SEQ ID NO: 25059 - protein, 228 aa, Anabaena variabilis ATCC 29413
MCPLPQQPSHITKSPRDVLDGIFAFPPNRDTLGGTSYLIVGNEGNILIDCPALDQTNLDFLRSHGGVKWLFLTHRGAIGRTAEIQQNYGCEVMIQEQEAYLLPGLTVTTFTQEFDLTPTAKAIWTPGHSPGSSCLYYNYQGGVLFSGRHLLPNQQGEPVPLRTAKTFHWPRQIKSLQTILEAFTPETLQYICPGANTGFLRGKRSIDTAYQRLASLDLKALLQTQPLI

SEQ ID NO: 25060 - protein, 458 aa, Anabaena variabilis ATCC 29413
METADVIVIGSGQGGIPLAADFANEGRKVVLFERDALGGSCINYGCTPSKAFLAAAHTAGRANQGKKLGIHTEVEVDFPAVMERVREIRSSFNQGIRQRLESAGVKVICAEASFVGERTVKGGDVTLQAPLVIINTGTSSLIPDIPGLAGTPYLTNRNFFDLNTLPARLLVIGGGYIGLELGQGLARLGSQTHLIVRGDRVLGQEEADVSEVLAEALKQDGIGLHFGVNVNHVAHENNVFKLTLSSGEQLQGEALLVVIGRKPNTGALNAANSGIELDDKGFVKIDDQFHTTCSGVYAIGDAAKQPAFTHVSWEDYRRLKAILCGENRTRSDRVLGYAVYTEPQVGRVGMTLEQAQKQGINACAVTLPMSQIARAIEWGHDLGFYRMVIDSDTDKILGATLVGYETAELVHVFLSLIEAGATWQLLERSVHIHPTYGEALPSLARLLLGDNMPGCPNM

SEQ ID NO: 25061 - protein, 307 aa, Synechococcus elongatus PCC 7942
MQSSFLSAVLLPLALVIIMFGMGLTLTVQDFRRVWIAPKAVAIGLIAQLVMLPLLGFAIASLTPLSPELAVGVIILAACPGGPTSNLFTFLAAGDVALSITLTAISSLITVFSIPWVVNLGLQAFLDQTSTFQLPFGPTVVQIAVVAIIPVVLGMLVRHYAPQLAQRTDRSLRWISTAFLAAVIVGFFAQERQNILAFFQSVGGVVLLLNLLAMALGVGLASLTRLGYARATTIGLEVGIQNGTLAIAIAASPTLLNNPAMAIPAAIYSLVMFMTGGIFVWLRQRYQPTRAVQTAAEVPAAVGSHLE

SEQ ID NO: 25062 - protein, 338 aa, Synechococcus elongatus PCC 7942
MMSNTMRAVVLEMPGGPEQLQLQSLPWPAIAHPSEVLVQLQAAGLNPIDTKLRQRGSFDPDRRPAILGCDGAGWVAAVGSAVDRFAVGDAVYFCHGGLGLEPGTYADYAVVDQAWLAPKPERLSFVEAAGVPLALITAWEALYDRGRLQAAQTVLIHAGAGGVGHLAIQLAKLRGARVATTVSTPEKAAIAEHYGADFVIPYRDRDWVAAVLDWTDGKGVDLAFDTVGGAVLEQTFPAVRLYGDLVTILAPDAATNWKVARDRNLRISLELMLTPQLQRVTEARQHQTQILTTASRWFDQEQLHIHIGQVLPISEISQAHQFLERQQGAGKIVIDLTA

SEQ ID NO: 25063 - protein, 291 aa, Synechococcus elongatus PCC 7942
MSERAIAHLGPVGTYAEMAALRFQAWLTQQDQQPSRLLACRSIPATLQTLADGAVDYAVVPVENSVEGSVAATLDSLWQLPQLSIQRALILPIAHALISFESDRTAIRQVLSHPQALAQCQQWLQRHLPQAELIPANSTTEALQDLERHPQRAVIASTRAAELYQMPIQSFPINDSPDNRTRFWVISRSPTPGGACTSLNFSLDANVPGALVKPLQILADRRINLSRIESRPTKRSLGEYLFFLDLEADLRDPAIAAAVQAVADCTEQLRVLGSYDSLDFTQSVLVPAQAR

SEQ ID NO: 25064 - protein, 382 aa, Synechococcus elongatus PCC 7942
MRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHASTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEEALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 25065 - protein, 160 aa, Synechococcus elongatus PCC 7942
MAPQVTDIAVTTIDGAAKSLSDYAGQVLLIVNVASYCGYTSQYSGLEALYRQYRDRGLQVLAFPCNDFGAQEPGSNEEIKTFCSTRFDVSFELFDKVHAKGADQHPLYAALTQTDPAGDVAWNFEKFLVGKDGTVLARFKSGVAPNDASLIQAIEAALAA

SEQ ID NO: 25066 - protein, 511 aa, Synechococcus elongatus PCC 7942
MAALSLADRVVVTAEQMQAIESRLFAAGMPVAALMEKVAGLLSQRLQMAYPDRTQRWGIWVGPGHNGGDALVVARELHLQGYPVQIWHPFERRKPLTEAHLQFAQHLGISIACDYPEHCDRWLDGGFGFGLNRPLNEATQTAIAQLNDSGKPILSIDLPSGLDTDSGEPLGAAIRAERTYCLGLWKQGLLQLVAAPWHGELERVDFGIAEADIVAVLGAVPDRQILTDEAAIAALPLPIAADAHKYRRGQLLLIAGSQRYRGAALLAALAARSSGVGMMTLAVPASLSAIAIAQVPEALVVACPETETGEIAELPIDCDRYNAIAIGPGVGTGPTIRTILHRVLQQSTPFLIDADALTVLAQHPEDWALRPAEARTVITPHAGEFQRLFGSAPTPASLSSAASERSLILVRKGPSPTVVTPVGASWALVDSTPALARGGSGDVLTGLLGGLLAQTDAVSAAIAATWWHSRTAQAIAQKQTALGVTPTELAAQLTPWLGQRLQSEIAQYLAS

SEQ ID NO: 25067 - protein, 320 aa, Synechococcus elongatus PCC 7942
MRIAQNITELIGRTPLVQLNRIPVADGCLARIVVKLESFNPSASVKDRIGISMILEAERKGLIAPDRTTLVEPTSGNTGIALAMAAAARGYRLILTMPDTMSSERRAMLRAYGATLELTPGIEGMAGCIQRAQEIVASHPEAYMLQQFKNPANPKIHRETTAEEIWADTDGTVDILISGVGTGGTITGVAEVLKERKPSFQAFAVEPANSPVLSGGRPGPHKIQGIGAGFVPEVLATQLIDEVVTVSDDEAIAYGRRLAREEGLLSGISSGAAVAAAVQVARRPENTDKLIVVILPSFGERYLSTPLFQEPELVSVSSNG

SEQ ID NO: 25068 - protein, 469 aa, Synechococcus elongatus PCC 7942
MLVPVILSGGSGSRLWPLSRESYPKQFHALLSDYSLLQETLLRLEGLPGLASPLLICNEQHRFLVAEHLRAIGQTAAAIVLEPEGRNTAPAVAIAALQAQSQGEDPLLLVLPSDHSIADPAAFRATVQTAIALATAGHLVTFGIVPEAPETGYGYIKAGSDLDLGGFAIDRFIEKPNLATAENYVASGCYYWNSGMFLIRASVYLSELARYAPEMFTACEAAWQKRQADLDFVRLDPATFAQCPSDSIDYAVMEHTQQGAVLPLQAGWTDVGSWSSLWQALEQDGAGNVTVGDSLALDCRNVYLRSEGRLVVGVGLEDVVAVETDDALLIAHRDRTQTVKQVVEALQREARRESRAHRKIYRPWGRYDSLDLGDRFQVKRITVNPGASLSLQMHHHRAEHWIVVKGTALVTRDNEEVLLTENQSTYIPVGCKHRLSNPGRVPLEMIEVQSGSYLEEDDIVRFEDHYGRS

SEQ ID NO: 25069 - protein, 392 aa, Synechococcus elongatus PCC 7942
MPNFRLSQRLAPLQRNVFADMDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAGGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 25070 - protein, 221 aa, Ralstonia eutropha JMP134
MRLILLGAPGAGKGTQAKFICEKFGIPQISTGDMLRAAVKAGTPLGVEAKKVMDAGGLVSDDIIIGLVKDRLKDADCKNGYLFDGFPRTIPQAEAMKEAGVAIDYVLEIDVPFDAIIERMSGRRVHVASGRTYHVKYNPPKTEGVDDETGEALIQRDDDKEDTVRKRLDVYSQQTRPLVDYYSDWAAKGDATAKVSPPKYRKIAGVGDVDSITARVFEALK

SEQ ID NO: 25071 - protein, 233 aa, Ralstonia eutropha JMP134
MSTPTYRIAPSILSADFARLGEEVRRVTEAGADWIHFDVMDNHYVPNLTVGPLVCEAIRPHVTAPIDVHLMVRPVDRIIPDFAKAGANIITFHPEASEHVDRSLALIRDNGCQAGLVFNPATPLHHLDHVMDRLDVILLMSVNPGFGGQSFIPETLNKLRAVRQRIDAYTERTGRKILLEVDGGVKVDNIAEIAAAGADTFVAGSAVFGKPDADGGYRGIISALRGELAKVGQ

SEQ ID NO: 25072 - protein, 269 aa, Ralstonia eutropha JMP134
MSNPIRVAVGGVTGWAGGELARGVAHAADMTLVAGLSRGAAGQPLAQLTGHADTPGVAAASIEALGSTPYDVYVEYTKPAVAKHNILQAIAHGAHVVVGTSGLTDEDYAEIDAAARKADRGVLACGNFAITVVLLQKFAEMAARHLDHWEIIDYAKAGKVDVPSGTVRELAFRLGEIKAAQQAVPVDQVNGPRETRGATMSGTQVHAVRLPGYQLGVEVIFGADGQRLHLKHEAGDGSKPYVSGALLAIRRVHTVRGVVRGLDKVMEGI

SEQ ID NO: 25073 - protein, 468 aa, Ralstonia eutropha JMP134
MTAPSAPNGAAAAPARNAVNVREFIDAARLSPLQLRIMLLCFAIVALDGFDIAIIGFLAPHIRSEWSLSMVALGPLFSAGLLGLMTGAFLCGPLADRIGRRRVLMLSVAWFGAACAASAVAPGIGWLIALRFLTGLGLGGAMPNAITLTAEFSPSRRRGTLLTVMFCGFSLGSAIGGVVTAYLIDQVGWRGVLALGGALPLALVPVLALALPESVRYLATREGMQARIAAILARIDARRITADMHYVADEPEGPGSPVSQLFAPRYRMGTLWLWLAFFCSLLLLYLMINWLPILVQRSGLSLKEASMLAGLLQGGGVLGAIVLGMLLDRFNPYAVVAGAYTLGAISVACLASVSAPLAMAAAIFVTGFCVSGSQVCANVLASAFYPTSSRATGVAWALGIGRVGAIAGSLGGALLLSAGWSNAALYLLLAIPAVAAGISIFRVGRVQVAIGAEERDTTSNNPQDVVQA

SEQ ID NO: 25074 - protein, 461 aa, Ralstonia eutropha JMP134
MSDLSPSVADAVRNAPSHRTVPATHTTDSIAVGKLFEQFPLTREHLKSCLALFMVFAIEAWEMMIIVYTAQLIGKEFQLDAAALGNLIGAIFVGMLIGSLWWGKISDRIGRKRAIILSLVLYGLISVASAMATSYGMLYALRLLSGIAAVGMMVVTFAHFEELLPVKVRGTCTVYLASGWPVGMLMALGVSMWLLPWGWRGIIAVSSLAAVWAFVVARWVEESPYWLAAVGRDDEAKAVIGRLSRGAVIVPPSTRLHVEKGAHGGTHRELFSGSALRITLLQIAVNFTFSWGYWGLQTWLPTLLQQRGLNLPQSYGFIAISAICMIPGYIAASFLTGKFGRKRVIVGFVGMSVIAGYVFANAQTMEMLYAGNFALAFFSMGAWGVWDTWIGELYSTRLRTLGYSWAVFAQRVANIAAPSLIGMLLVRGWSFNTTTTMINAFMLATVLLALFMPETEGKELD

SEQ ID NO: 25075 - protein, 473 aa, Ralstonia eutropha JMP134
MKTLDRFYIQGEWVTPAAGSTLVDVINPATEAPVARLAMGTTADADRAVAAARDAFGTWSQSTREERIALLERIAEQYRARVPELAEAVRLEMGAPVTLCNAMQAPIGLVHIQNTLEVLRNFAFETTHGKTWLRREPVGVAALITPWNVPLNQIAAKVAPALAAGCTVVLKPSEIAPLDAVIFAEIMHAAGTPLGVFNMIFGDGPSVGAALSSHPDVDMVSITGSTRAGVEVAKNAAPTVKRVAQELGGKSPLVVLDDADMKTAVTTAVAQCMVNTGQVCVAPTRLLVSRTRYDEALAIAAATAGALQVGDPADPATKIGPLSNRAQFEKVQQMIGIGIEEGARVIAGGPGRPDGIERGFYVRPTVFADVHNSMTVAREEIFGPVLCVIPYDSEEDAIAIANDTVYGLAAYVASGDAERARRVAARLRAGTVRVNFAPADLTAPFGGVKRSGNGREFGAEGLVEFLEWKAISL

SEQ ID NO: 25076 - protein, 413 aa, Ralstonia eutropha JMP134
MAAAELRKLGHAERIVMVGGERHAPYERPPLSKAVLADASQQGQVGVHPAGFYAERDIELRLCTTVSAIDAARSVATCTDGSEIRFDACLLATGGRARTLPHLPAGTPNVHYLRTLDDAARLREAMQGADEVLVIGGGFLGLETASTAVDLGLKVTILESADRLLARAAPAELSDWLAQRVRARGVDLRLGCRITAIEPQAQGVQVRLADGTTWHIPVLVVAIGLTPNTELAAIAGLALHPGNGGIQIDEQGRTSVPNIYAAGDCASQFQPLFGAEMRMESWQSANEQARIAATSMLGLQAALAATPWFWTDQFGCNVQMLGAALPGMRYVWRDMPASGAASPKSMLLGTLDGCLRHAIAVNAGGDLRQLRSLFDLPVNEHLARLCDAALPLRQIVREVQAEISSRTASLTTN

SEQ ID NO: 25077 - protein, 459 aa, Ralstonia eutropha JMP134
MTMIALGGVIGAGLFVGSGVVIKSAGPAAVLSFLITGLLVVLVMRMLGELACAMPGGGSFYEYAREAWSDRPAVGNLASFLTGWMYWYFWVIVVALEAVAGADLVRYWLPDVPNWTISLVLLVMLTLTNLISVKSFGEFEFWFASIKVAAIMVFLFVAGVYVLGLAPGAHGMNVANLTANGGFMPNGIVPVLTGAVAATGFYFGAEIVTIAAAETAEPQKAVARATNSVITRVLVFYVGSVLLVVCLVPWNATGIATPYVSALNVMGIPAAAQIMNAIVLTAVLSALNSGLYASSRMLFALTKRGDAPRSLARVSRNGVPTRAILVATLFGYGAVVMSYVSPDKVFAFLVNSYGTVAIFVYILIAVSQLRLRARLEREAPHLLKVRMWCYPYLTWLAIFGMLAIVVAMAFIPDQRTPLALGVASLGLLVSAYIVRHLFRRGVQQVVPLAEMPRPDLHEY

SEQ ID NO: 25078 - protein, 506 aa, Ralstonia eutropha JMP134
MNMAEIAQLGVTNPYKQQYENYIGGAWVPPAGGEYFEAITPITGKPFTRVPRSKQEDVDAALDAAHAAKAAWGRTSTTERANILNRIADRIEANLTLLAVAETIDNGKPVRETMAADLPLAVDHFRYFAGCIRAQEGGISEIDAETIAYHFHEPLGVVGQIIPWNFPLLMATWKLAPALAAGNCVVLKPAEQTPASILALMEVIGDLLPPGVVNVINGFGLEAGKPLASSPRISKVAFTGETTTGRLIMQYASQNLIPVTLELGGKSPNIFFEDVLAADDAYFDKALEGFAMFALNQGEVCTCPSRALIQESIYDRFMERALKRVAAIRQGHPLDKGTMIGAQASAEQLEKILSYIDLGRKEGAQCLAGGERNQFDGDLAGGYYVKPTVFKGHNKMRIFQEEIFGPVVSVTTFKDEEEALAIANDTLYGLGAGVWTRDGARAFRMGRGIQAGRVWTNCYHAYPAHAAFGGYKQSGIGRENHRMMLDHYQQTKNLLVSYSPNALGFF

SEQ ID NO: 25079 - protein, 339 aa, Ralstonia eutropha JMP134
MMKAAVVRAFGAPLTIDEVPVPQPGPGQVQVKIEASGVCHTDLHAADGDWPVKPTLPFIPGHEGVGYVSAVGSGVSRVKEGDRVGVPWLYSACGYCEHCLQGWETLCEKQQNTGYSVNGGYGEYVVADPNYVGLLPDKVGFVEIAPILCAGVTVYKGLKVTDTRPGQWVVISGIGGLGHVAVQYARAMGLRVAAVDIDDAKLNLARRLGAEVAVNARDTDPAAWLQKEIGGAHGVLVTAVSPKAFSQAIGMVRRGGTIALNGLPPGDFGTPIFDVVLKGITIRGSIVGTRSDLQESLDFAAHGDVKATVSTAKLDDVNDVFGRLREGKVEGRVVLDFSR

SEQ ID NO: 25080 - protein, 475 aa, Ralstonia eutropha JMP134
MYQDLALYIDGEFIKGGDRKEQDVLNPATQEVLGKLPHASRADLDRALAAAQRAFESWKKTSPLERSKILRRVGELARERAKDIGRNITLDQGKPLAEAVGEVLVCAEHADWHAEECRRIYGRVIPPRQPNVRQIVVREPIGVCAAFTPWNFPFNQAIRKIVSAVGAGCTLILKGPEDSPSAVVALAQLFHDAGLPPGVLNIVWGVPSEVSTYLIESPIVRKISFTGSVPVGKQLAALAGAHMKRVTMELGGHSPVLVFDDADIEPAAEMLARFKLRNAGQVCVSPTRFYVQEKAYDKFLARFTEVIGSIKVGNGLEDGTQMGPLAHERRVFSMEQFLDDANQRGGKVVAGGSRIGDKGYFFAPTVVTDLPDDAKLMVDEPFGPVAPVTRFKDTAEVLRRANSLPFGLASYVFTNSLKTATEVSNGLEAGMVNINHFGMALAETPFGGIKDSGIGSEGGQETFDGYLVTKFITQV

SEQ ID NO: 25081 - protein, 486 aa, Ralstonia eutropha JMP134
MTNRTIELKHPRQLYIDGVWVEPSTGGVFDVLDCSTEQVVATVARAESADMQRAVAAARKAFDDGPWPRMTPLERAGFLEKIAVRLEALNDEFARIWSLETGIVYKVAQPRIGLFISGAFRQYAAMASTFPFTQPCQSVTGNDAYRVYEPVGVVAEIIPWNGPAGLLAYKTAPALLAGCTLVIKSPPEAPCSGYLFAQVCEEVGLPPGVVNVITAERDVSEALVRSPEVDKITFTGSTAAGRRIASIAGDRVARVTLELGGKSPAVILDDYDVETAAATLGNSYFSYNTGQICHSLTRIIVPRAKHDAMVEALSAIAREIVLGDPLAATTTSGPLANARQRDTVERFVAMGVAEGAVLATGGKRPPHLARGFFFEPTVFGNVDNRSSIAQQEIFGPVLSVIPADDEASAIRMANDTPFGLNAAVFTNDRDRALAVARQIRAGTVGHNGPRTDFSIGFGGFKQSGIGREGGVEGLTAFMESKTIVLS

SEQ ID NO: 25082 - protein, 399 aa, Ralstonia eutropha JMP134
MNPRLDLLQPYPFEKLRVLFAEVKPADKPAISFGIGEPKHPTPEFIKKALAESLAGLANYPTTAGSDALRQCIATWLERRYGLPKVNAATEVLPVTGSREALFAFAQTVVDGTRSGALVLCPNPFYQIYEGAALLAGATPVFANSDPARNFAPAFDRIADDVWKNVQLLFVCSPGNPTGAVLSLEDWKQLFALSDKYGFVIASDECYSEIYFDESRAPLGALEAAHKLGRGFERLVMFSSLSKRSNVPGLRSGFVAGDAALLKKFLLYRTYHGGAMNPAVQTASIAAWNDEAHVRENRAAYVRKFSEVTPMLAEVLDVALPDAGFYLWADVSRTGLNDVEFAAQLLAAQNVTVLPGSYLAREADGINPGANRVRMALVATPEECLEGARRIVEFCKSLG

SEQ ID NO: 25083 - protein, 421 aa, Ralstonia eutropha JMP134
MDTVMAGRASASDLAAVGLGGSIYITVYISLMGVLQALAPIAGQLYGAGRSDEIGSEVRQAAWLGLALSVPGVLLLAFPEPLLAFAKAPPELVGKASQYLHIGAFGLPAALGFRIYSALNNALSRPVMVTMLQIVGLALKVPLNAWFINGGFGVPAMGGPGCALASTLISWTWCIAGLLILRYSAVYRSLKIFSAWSWPVATQLRALLRLGVPMGLTYLIEITSFTLMSIFITRMGTVMLAGHQIIANLGAVAYMLPLSLAIATSTLVAQSIGARDMAGASRLAWRGICLAAALAMLTGCLLWLLRETVLHAYTKDGAVVAAALPLVLFIAFYQAFDAVQVMTAFILRAYKIALIPTLIYAGSLWGIGIGGGYVLGFGLIDTLPPFTRGASGFWIANSASLAVAGFFLVRYFMRISAAERH

SEQ ID NO: 25084 - protein, 306 aa, Ralstonia eutropha JMP134
MANQRNVGFIGLGIMGAPMAGHLRAAGHTLFVHDVNPAPQALVDAGVTVCTSAEEVAKRADIIVIMVPDTPHVEAVLFADKGVAAALKAAGKEASYSKIVVDMSSISPIATKDFAARINKLGASYLDAPVSGGEVGAKAASLTIMVGGPEEAFDQVKPLFELMGKNITLVGGNGDGQTTKVANQIIVALNIQAVSEALLFASKAGADPARVRQALMGGFAASRILEVHGERMVKRTFDPGFRIELHQKDLNLALQGAKALGVALPNTATAQELFNTCAANGFGKADHSALCRAIEIMSNHDIASAK

SEQ ID NO: 25085 - protein, 487 aa, Ralstonia eutropha JMP134
MRRQRKAKIVATLGPASTDIAVIRQLFEAGADVFRLNFSHGTHEDHRARYDAVRQIEAETGRPIAVLADLQGPKLRIGVFAAGKVAVRAGDSFVLDSDPTPGDGTRVHLPHPELFHAAQPGQSLLIDDGKVRLAIESVASGSITTRVVNNGTLSDRKGVNVPDAVIPIPALTEKDRKDLDFALSLGADWIGLSFVQRPSDIVEAREIVGTRAGILSKIEKPAALQQLEEIVRVSDSVMVARGDLGVELPPERVPGVQKRILRVCRQLGKPVVIATQMLESMIDSPVPTRAEASDVASAIYEGADAVMLSAESANGRYPVPAVSMMNRIVTEVERDPLYRNLLDAQHETPLNTRQDAICAALREVTQIIGAVATVTYTSSGATALRAARERPCAPIVSITPNLEIARRLAIAWGIHSTVSPDVKSVDEMVEAATRAALVEGYAAPGDQITIAAGMPFGQGGTTNLLRVAEVGGNAVAGVESVRESATV

SEQ ID NO: 25086 - protein, 463 aa, Ralstonia eutropha JMP134
MERVPRSRGKGGKPMRTRKADFVVIGGGSAGVACARRAASHGASVVLIERDEIGGTCVNRGCVPKKMLSYGATWAAILSGCLSHTGGHEDWRDAIVRVNAEVARLNVVYAQRLLEAGVDILRGDAVVTAPDEVRVGDEVIRAKRILIATGARPKTLDIPGGELASNSDDVFTWQTVPGSIAVIGGGYIGVEQASILSRYGVKVDLLVAGDRLLPHFDAEIAEALAGALETKGVRLHLNASVNLISQANGALEVCYRPGNKPGQTESIRAQAALVAVGRVSNVDGLGLDAIGVKLGDKGGIKVDRQFRSSVRSIHAIGDAIEGLHLTPVATSQGRWLADRLFGRRGERADFDFVPTAVFCEPAIGAVGLTEAQAIEEAGKPERIRTVVKRFVSLENRFGGNGMQSVFKLVLNARTGRVLGVHLMDNAAPEIVQAMAVALRLGVRESHLETTLQLHPTVAEELFG

SEQ ID NO: 25087 - protein, 212 aa, Ralstonia eutropha JMP134
MNRRQTAFAASVRRAMFATALALAAASAALLPHPARAADKPAAMPAAAPAGNCPASLNFQFPRLQDEAPQNLCQYAGKVVLVVNTASYCGFTPQYEGLEALYSKYRDRGLVVLGFPSNDFSQEPGSSKEIADFCYNTYGVKFPMLGKSHVRGGDVNPMYALLAKETGTAPKWNFYKYLIDRSGNVVGSYNSMTKPDDKQFVAKIEQLLSSPR

SEQ ID NO: 25088 - protein, 372 aa, Ralstonia eutropha JMP134
MNVPQDDAGNITEDTRIRASVPAIEACLAAGAAVMVTSHLGRPTEGEFKPADSLAPIATRLSELLGKPVKLVQNWVDGVEVAPGQVVLLENCRVNKGEKKNSDELAQKMAKLCDVYVNDAFGTAHRAEATTHGIAKYAPIACAGPLLAAEIDALGKALGQPARPLVAIVAGSKVSTKLTILKSLADKVDNLIVGGGIANTFMLAAGLKIGKSLAEADLVADAKTIIDIMAKRGASVPIPVDVVCAKAFSATAAATVKDVKDVADDDMILDIGPKTAAQLADQLKAAGTIVWNGPVGVFEFDQFGNGTKVLAEAIADSKAFSIAGGGDTLAAIAKYGIADRVGYISTGGGAFLEFLEGKKLPAFEVLEQRAAG

SEQ ID NO: 25089 - protein, 478 aa, Ralstonia eutropha JMP134
MTRSTKIVATIGPASSSLEVLTRMIAAGVDVVRLNFSHGTAQDHIDRATLVREAAQACGREVAIMADLQGPKIRVGKFESGKVTLKPGDPFVLDSSCQLGNQERVGLDYQDLPRDVGPGDLLLLNDGLIVLVVDRVLGTEIFTTVRIGGDLSNNKGINRQGGGLSAPALTAKDMDDIKTAMALGADYVAVSFPKNATDMEMARQLAAVAGQPYGRKARMIAKIERAEAINPGVLEEILQASDGIMVARGDLAVEVGNAAVPALQKRMIKLAREANKLTITATQMMESMIVNPVPTRAEVSDVANAVLDGTDAVMLSAETAAGRYPVETVEAMAAVCIEAEKSEVVQLDTDFLNQTFSRIDQSVAMGALFTAYHLQVKAIAALTDSGATALWMSRHRIHVPIYAMTPNVASQRKMQLYRNVVPLPLDASTDRDTALEQAEELLLAQGVVQRGDFIVLTIGEPMGQPGGTNTLKIVRVGS

SEQ ID NO: 25090 - protein, 307 aa, Ralstonia eutropha JMP134
MLGRDVYIKRDDTTPLAFGGNKLRKLEFLAADALSKGADTLVTAGAIQSNHVRQTAAVAARLGLRCHALLENPINTTDVDYLRSGNRLLLDLFDAHGEPVATLDNADAQLQALAERLRGDGYQPYIIPIGGSNPLGALGYVHAGLEMAQQADAMGVSFAAVVLASGSAGTHGGLALALAHAMPDAQVVGITVSRPVEAQAPKVAGLIDGTAELLDIEVPAELRLELWDEYFLPRYGEPNRAALDAIRLLARTEGVLLDPVYTGKAMAGLLDGVMRKRFAGEGPLLFLHTGGAPALFAYRDALPAVLI

SEQ ID NO: 25091 - protein, 447 aa, Ralstonia eutropha JMP134
MPASQTINISAFIDRQPLSPFQVMIVVLCFLIVAIDGFDTAAIGFIAPAIRAEWQLTPAHLAPLFGAGLGGLMAGAFLFGPLADRFGRKSVLVFSVLFFGVASLASAWSGGLWELIALRFLTGLGLGGAMPNTITLTSEFCPEKRRSFLVTTMFCGFTLGSALGGLASAGLIEAYGWRSVLVVGGVLPLVLSVLLALLLPESVRYLVMARRAPERIAATLRRIAPQANLDGATFTVSESRSTSSPVRHLFKPELVRGTLLFWLTFFMSLLVIYLLSSWLPTLLRGTGLSLRTAALVTTMFQVGGTLGAIVLGWLMDRFNPHYVLAISYALAGVFVAAIGSLADTPMLAGVAVFLAGFCVSGSQVGANALSAGFYPTDCRATGVSWANGVGRMGSVVGSVGGATMLSMDLGMPTLFLLIGIPALLAGGTMLSLGLARRAPVRQELAAS

SEQ ID NO: 25092 - protein, 488 aa, Ralstonia eutropha JMP134
MIQTQLYIDGRWQSPLEGSTRDILSPADESVIAQAAEGTRADARIAIAAARRAFDGPWRQTTIRDRARLLNRIAALIDRDAEELARFESLNTGKTLTESRTDMGDIAATFRYFAGLVASESGAVNEAPHHVISRTLREPVGVCGLITPWNYPLLQAAWKIAPALGAGNTVIIKPSNLTPLTTHHFTKLIAELDLPAGVFNLVTGGAEVGAELAESRDVDLVSFTGGAFAGESIMKAATGNFKRIGLELGGKNPNIVFADADLDVAVDYALNAAFFHAGQVCSAGSRLMIEDSIYDAFVAKLAERLPRIAIGNGFHAETQMGPVQSAQQHEKILRMVQAGVAEGARLVYGGKRPEGDVYRKGYWLQPTLLADVTADMNIAKDEIFGPVVTAERFRSEDDALRAANDTPYGLAAAVWTRDLDKANRMSRALRFGTVWVNDYHPYFPEAPWGGYKASGIGRELARIGLDEYTELKHSYINLAPKAMGWFGA

SEQ ID NO: 25093 - protein, 437 aa, Ralstonia eutropha JMP134
MSPTITIEQGIRAAGVGRFQYRLFVIFGLVWLADAMQVLSIGFTAPSIAKTFGIPVPTALQSGTMFFVGMLIGAFVFGRLADRIGRRPVLMMAVVIDAICGVASSFAPDFQWLLVLRFLTGIGVGGTLPVDYTMMAEFLPSDRRGRWLVLLESFWAIGTILLAVLALIAVSRGDAAWRLIFLVTGIPALVGVVCRFFVPESPLYLNKSGRSAEARAVLQRVATANRVSVEIGALEPQQMERKSVLALFASGFRRRSISLLVAWALISIAYYGVFVYLPVKLAGQGFGFMRGQVFLILLALVQLPGFALAAHGVERWGRKPTLIGFLLLSAAGCMLYSLGQSPALVVGSTLLMSFSLLGTWGALYAFTPEVYPTDLRASGMGTAGAMARFGGLFAPAIVAPVMATQFTLALVLLSTCLAVAALAIYMVDIESKDRALD

SEQ ID NO: 25094 - protein, 478 aa, Ralstonia eutropha JMP134
MHAQHFVANRLIAPDNGLRIKVFDPSNGEPFAEIARGNATDINVAVHAARQAADGAWGAMAPAERVRLLNRVALTLVAHEEELTALETRDTGKPVRQARADARAVARYFEFYAGAVDKLHGQTIPYNPGYTVFTLREPHGVTGHIIPWNYPLQIFGRSVGAALAAGNACVVKPAEDACLSLLRVAELAAEAGLPEGALNIVTGYGHEAGAALARHPGINHISFTGSPQTGKLVSQLAAENHVPVTLELGGKSPQIVFADADVDALVPVIVNGIVQNAGQTCSAGSRVLVERPLYNALLDRIASVFESLRVGPSELDLECGPLISRKQQQRVWDFVSDAQHAGISVMAQGQIVAEAPESGYYQVPMLFRDVPPAHRLAQEEVFGPLLAAMPFDSEAEAVALANGTPYGLVAGLWTRDGGRQLRLARKLRAGQVFINNYGAGGGVELPFGGTGQSGYGREKGFEALYGFTTLKTIAIQHG

SEQ ID NO: 25095 - protein, 429 aa, Ralstonia eutropha JMP134
MSRNQQLFDRAQQTIPGGVNSPVRAFRSVGGTPRFITCAEGAYMWDADGQRYIDYIGSWGPMIVGHAHPDVVRAVQETAAHSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVAQLEEAFAQHRGEIAAVIVEVVAGNMNLVRASDAFLKAMRELCTRDGAVLIFDEVMTGFRVALGGAQSHYGITPDMTCLGKVIGGGMPAAAFGGRRDIMAKLAPLGGVYQAGTLSGNPLAVAAGLTTLRLIQAPGFYDKLTAQTRKLADGLSEAARAAGVPFAADAIGGMFGIYFRDGVPGSFAEVTKSDTARFNRFFHAMLDNGVYLAPSAFEAGFVSACHDDAILQATLDAARKAFAA

SEQ ID NO: 25096 - protein, 292 aa, Ralstonia eutropha JMP134
MTATQSTTVAFIGLGAMGSHMVRHLLAAGHTVRAFVRRPEAAEAARALGAEPFFTPAEAARGASVVFTNVTSSEDVREVLLGENGVIHGAAPGTVCVDHSTISPIVTREIATALAARGIDALDCPVSGGTAGAEAATLTIMVGGKPEVLERVRPLLALLGKSITYIGGNGAGQVAKLCNQIVQVVNIEGIAEAMHFAAAQQVDTGRVLQAISTGFAGSRMLDLMGPKMVEREFAAGIEARLHDKDFGLARDIAQEIGLKLPAMQATSAQLKSLMEHGWGKDDTSSLLRVLEN

SEQ ID NO: 25097 - protein, 384 aa, Ralstonia eutropha JMP134
MYITNRPELVFTEGKGSWLTDHNGKRYLDFVQGWAVNCLGHSNQGMVDAVVAQAGKLINPSPAFYNAPMIKLAKQLTDNSCFDKVFFANSGAEANEGAIKLARKWGRKHKNGAFEIITMDHSFHGRTLATMSASGKAGWDTIFAPQVPGFPKADLNDLASVEKLITDKTVGIMLEPVQGEGGVLPATREFMQGLRALADKHKLLLIVDEVQTGCGRCGTLFAYELSGVEPDIMTLGKGIGGGVPLSALLCKAEVASFEAGDQGGTYNGNPLMTAVGSAVIEQLTAPGFLDDVKAKGEYLKEQLLALCSEFGLAGERGEGLLRALQLGKDIGPQLVEEARDMGPDGLLLNAPRANLLRFMPALNVTREEIDQMIGMLRTLLKKLA

SEQ ID NO: 25098 - protein, 180 aa, Ralstonia eutropha JMP134
MMTAEQARELWANSEEIVSAQEVQASLDRMAKDITAKMGDAFPLVLSVMGGAVVFTGMLLPKLQFPLEFDYIHLSRYNNKTVGGEMQWRVAPRESVRDRVVLVLDDILDEGETMAAIRQRIMDMGAKEFHAAVLCEKTLTKLKPMHPDFCGFQVPDRYVFGCGMDAKGYWRNLGTIRALM

SEQ ID NO: 25099 - protein, 231 aa, Ralstonia eutropha JMP134
MLDREGFRPNVGIILINARNEVFWGKRIGEHSWQFPQGGIKYGETPEQAMYRELHEEIGLLPEHVRIVGRTRDWLRYEVPDKFIRREIRGHYRGQKQIWFLLRMAGRDCDVHLRATEHPEFDAWRWSDYWVPLEAVIEFKRDVYQLALTELSRFLNRNPRVPLSPYGVHHGRHGSGQRYAQQPGQPPTLAQRRPLQPVTQVAPVAPAAEAVQAVESDAVLPATPAPNPTES

SEQ ID NO: 25100 - protein, 311 aa, Ralstonia eutropha JMP134
MSIDILAYGEPLVEFNQQPDDPTRYLQGFGGDTSNFCIAAARQSATTGYISAVGADSFGERLMALWTRERVDTRHVRVDPVAPTGVYFVSHDNHGHRFDYLREGSAASRYQHEHLPLGAIAQASFLHLSGISLAISTSACDAGLAAMEHARKAGTKVSLDTNLRLRLWSLARARGIMREAFSLTDVCLPSWDDITVLTGLDDRDAIVDYLLGCGIGLVALKLGEEGAYVATPESRTLVQPFAVKPVDATGAGDCFGGSFIARLAAGADPFEAARYANVAAALSTTGYGAVAPIPSAETVLARLAQSVSVIA

SEQ ID NO: 25101 - protein, 482 aa, Ralstonia eutropha JMP134
MLKLQDPSLLRQQCYIDGRWTDGERRIDVTNPATGELVAQVPQFGVAETRHAIEAANRALPAWRARLAKERSALLRKWFELILANQDDLARIMTAEQGKPFAEAKGEIAYAASFIEWFAEEGKRVYGETIPAPVSSQRIVVTKEPIGVCAAITPWNFPAAMITRKAGPALAAGCTMVVKPASQTPLTALALAVLAERAGIPAGVLSVVTGSAGAIGGELSSNPLVRKLTFTGSTEVGRVLMAQTASTIKKVSMELGGNAPFIVFDDADLDAAVEGAIISKYRNAGQTCVCANRIYVQDKVYDAFAQKLVAAVAQLKVGNGMEDGVRIGPLIDEKAVAKVEEHIADALGKGARVLEGGHRHGLGHTFFQPTVLADVAPNMLVAREETFGPLAPLFRFKTEDDVVAMANDTEFGLASYFYARDLGRVWRVSERLEYGMVGVNTGLISNEVAPFGGVKQSGVGREGSHYGIEDYLVIKYTCMAGI

SEQ ID NO: 25102 - protein, 1121 aa, Ralstonia eutropha JMP134
MKRLTEPANALLLNADPLWYKDAVVYQLHIKSFYDANGDGVGDFAGLLAKLDYLVDLGIDTIWLLPFYPSPRRDDGYDIADYRNVHPDYGTLAEARRFVGAAHARGIRVITELVINHTSDQHPWFQRARKAKPGSAARRYYVWADNDQAYAGTRIIFCDTEKSNWSWDPVAGAYFWHRFYSHQPDLNFDNPQVMNEVLSVMRFWLDIGVDGLRLDAVPYLVEREGTTNENLPETHTAIRHIRSHLDSHYQGRVLLAEANMWPEDAQQYFGRSSTGDKGDECHMAFHFPLMPRMYMAIAREDRFPITDIMRQTPELPTDCQWAIFLRNHDELTLEMVTSSERDYLWEVYASDRRARINLGIRRRLAPLMERDRRRIELMNSLLFSMPGTPVIYYGDEIGMGDNIHLGDRDGVRTPMQWSPDRNGGFSHADPERLVLPPLQGPLYGYEAVNVEAQARDPHSLLNWMRRMLALRRKHRAFGRGTLRFLFPGNRKILAYLREYEGEHILCVANLSRAPQAVELDLSAFNGRVPVEMMGATPFPAIGTLTYLLTLPPYGFYWFVLSEDAHPPAWHVSAPEQMPDQITLVLQNKGRPELTEAARRMLNDEVLPPYIRRRRWFGAKDDSIQRATLAYMAPFTKGTTGEEIYLGEVEVRLSGGRTERYQLPLGVLWDRESADSVSQLAHGLSMARVRQGSRVGLATDGFVLEPFAREVIRALRADAELQGPQETIRFRSEPGLSAVQPEQEEIQWMSAEQSNSSLAYNNTAVLKLVRRLSGGTHPEVEMTRYLTAQGYPHSPPLLGEVVRTGADGVPHTLMMVQGYILNQGNGWDWTLDYLSRVIDDALPAQESADEFAEAMNGYATMAGTLGRRLAELHAVLARPTDDPAFAPRPATDAETRQWAEQAMAAITHALALLEKRAQNDPKSASKRFMADVDTLLKARDALPALVNRLAAAAPGSLQTRFHGDFHLGQVLIAQNDTYLVDFEGEPGQPLDWRRRKTSPLRDVAGLLRSIDYAAATVGTDRQERTHAELPPALAERRGGLLERFRETASDAFLGCYRRHMEASGTPWADNAQFQPLLDLFLLERAAYEVEYEAANRVAWIDLPASGLARMVRKLMAGNLEAQ

SEQ ID NO: 25103 - protein, 297 aa, Ralstonia eutropha JMP134
MHIAFIGLGNMGAPMARNLLKSGHTLTVFDLNATAVASLCAEGAASADSARKAVAEADFVMTMLPAAAHVRTAYLGDEGVLAGVRAGVPLVDSSTIDPATVRELAAAAAAHGNPLADAPVSGGTGGAQAGTLTFMVGATPDLFEQVKPVLANMGRNLVHCGDTGTGQVAKICNNLILGISMIGVSEAMALGVRLGIDANVLAGIVNTSTGRCWSSDTYNPHPGVIETAPSSRGYTGGFGADLMLKDLGLAADAARSVKQPLFLGALAQQIYQAMSQAGDGQLDFSGVIRQYQPKSGA

SEQ ID NO: 25104 - protein, 461 aa, Ralstonia eutropha JMP134
MVESNNDGTLKRGLKNRHIQLIALGGAIGTGLFLGIAQTIKMAGPSVLLGYAVAGIVAFFIMRQLGEMVVDEPVAGSFSYFANKYCGHFAGFMSGWNYWVLYILVSMAELSAVGIYVQYWWPGIPTWISALAFFLIINAINLSSVKSFGEMEFWFSIIKVAAIIGMIGFGGYLLMSGNAGPQASITNLWQHGGFFPNGLGGLVMAMAVIMFSFGGLELVGITAAEADQPEKSIPKATNQVIYRILIFYVGALAVLLSLYPWENVVTGGSPFVLIFHALNSNWVANVLNVVVLTAALSVYNSGVYCNSRMLFGLAQQGNAPKSLLKVSKRGIPLTALGVSAAATGLCVLINYFMPGKAFELLMGLVVSALIINWAMISIIHLKFRADKRKAGQETRFKSFGYPLTNYLCLAFLGGILVVMYLTDGLRISVYLIPVWLAVLGISYRLRQKNAVPALQGSVSAQ

SEQ ID NO: 25105 - protein, 343 aa, Ralstonia eutropha JMP134
MDTASELQATIRAMVQPGKGLLAADESGPTIAKRFTTIGVESNEENRRAWRSLLLSTPGLGAHISGVILYEETLGQRADDGTPLPELCARQGIVPGIKVDKGKVPLVNAPGDEITEGLDGLPKRLEAYRQQGARFAKWRAVFNVSDTLPSALAVQANAQVLAAYAAICQASGIVPIVEPEVLMDGDHGLARSAAVTERVLHAVFHALHRYGVVLEHMVLKPSMVIAGKKSAQQTSVQDVATETVRVLKRTVPGAVPGIFFLSGGQTPEQATANLDAMNRLGPLPWPLSFSYGRALQEPPLAAWRGQAANVGKAQQALLQRSLLNGEACQGQYEAAQESMEKVG

SEQ ID NO: 25106 - protein, 423 aa, Ralstonia eutropha JMP134
MSWKDRPSAVLTGLLAIHLLAHIDRNMLLGFSPQITTDLALSNAQYGFLVGAVWVLSFGVMALFMGALADRFSRTRVIAAGVLVWSACTWASGHAESFEQMVMARFFVASGEAALVPAAVGLLAELFSEKRRSSAMGVFFMGIPMGIGCSFLLAGTLGASHGWRNTFYVLGAIGVGIAIVLAFLKDERDQQAHQERGAPFVRQVASIMAVLRERPSLRLIIAGFVLVHMLFAGLAFTQLWLARERGMDATGIATNIGMLQLLFGTLGSVVGGVLGDRLGRRLPGSQATLMALLVALCSAPMIAYRFAAPGSVIFYVGMCAGFFLPLALYGPVNAAIVSMVPQQTRSTISGFSMLCINVFAIAIGNLAVGWAIDDFGARGMPMPITHILLATDVLGISSALLFAFAARASSRQHISGSTVKWVQ

SEQ ID NO: 25107 - protein, 419 aa, Ralstonia eutropha JMP134
MHDEQPRGATANVPTSTIVIVGAGQAGGWAAQTLRNEGFTGRLVLIGDESHPPYERPPLSKAVLAGEAEPSSTQLLRPDAFEALGLEWWPDIPVNHIDRHAKRLEMTDGKTLAYDKLILCTGGRARTLTVPGADRARVHTLRTIGDALSLAQEFRPGRSVAVIGGGWIGLEVAATARQRGAEVTVIEAQGRLCERSVPPEISEHLLGLHATHGVHIRLGVHISGIARGADGRPALTLADGDTLTCDAIVAGVGLVPNDDLARDAGLDCDGGIIVDERCCTSDPDIFAAGDVAVTPNPWAGRRMRLESWQNAQEQGIAAARAALCLPVVYQPLPWFWSDQYDMNLQIYGVPLPSHRIVTRGMPGDNSFALFYLEDDVIKAALGANAARDLRFARRLIEQSKPVDVKRLADADVPMGKLSA

SEQ ID NO: 25108 - protein, 305 aa, Ralstonia eutropha JMP134
MKADNILQTIGNTPHIRIRRLFGNGHEVWIKSERSNPGGSIKDRIALSMVEDAERRGVLKPGGTIVEPTSGNTGIGLAMVAAVKGYKLILVMPDSMSIERRRLMLAYGATFDLTPREKGMKGAIARAEELIASIPGAWMPQQFENPANIDVHARTTAQEILADFPEGLDALITGVGTGGHISGCAQVLKQKWPQLKVFAVEPTASPVISGGAPAPHPIQGIGAGFIPENLKTDLLDGVIQVDAEPAREMARRCAREEGILVGISSGATLAAIASKLPELPAGARVLGFNYDTGERYLTVEGFLPA

SEQ ID NO: 25109 - protein, 349 aa, Ralstonia eutropha JMP134
MDLEGPRAGEVLVEIKATGICHTDYYTLSGADPEGIFPAILGHEGAGIVTDVGAGVTSLKPGDHVIPLYTPECRQCKFCLSRKTNLCQAIRATQGKGLMPDGTSRFSIDGQPIFHYMGTSTFANHIVVPEIALAKIRPDAPFDKVCYIGCGVTTGVGAVIFTAKVEAGANVVVFGLGGIGLNVIQGAKMVGADKIIGVDLNPEREAMARKFGMTHFINPKDVGNVVDHIIQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 25110 - protein, 422 aa, Ralstonia eutropha JMP134
MRAFHLTWMAFFVCFFAWFACAPLMPVIKGEFGLTPAQIANINIAAVAVTILVRLVIGPMCDRFGPRKTYTGLLVLGALPVIGVAFAQSYETFLAFRLLIGAVGASFVITQYHTSVMFAPNVVGTANAAAAGWGNAGGGAAQALMPLLLGAVLMLGVDHAMGWRVALLVPGVLMLVMAVVYWCFTQDCPEGNYSDMRARGQAITGKDGGKGGGWASFRAASANYRVWLLFVTYGACFGVEIFIHNIAATFYVDHFGLSLKAAGLAAGSFGLLALFARALGGWLSDKAARRRGLDARSTLLFVLILGEGLGLLWFAQAGNVVMAVTAMLLFGLFTHMACGATYALVPFIDRKALGGVAGIIGAGGNVGAVAAGFLLKGLGDLQQTLTVLGVLAALAALCAIAIRFSAEHKAQEQALYDSALAN

SEQ ID NO: 25111 - protein, 460 aa, Ralstonia eutropha JMP134
MIEQPYPSVTEVDSARPEVKNKLDAYFQITARGSTQRQELVAGVTTFMAMVYAVFVVPGMLGKAGFDTSAVFVAVCLTTAFGSLLMGVWAKLPIAIGCAISLTAFMAFGLVLGQGLSPAVALGAVFLMGVVFTAISVTGVRSWILRNLPAGVAHGAGIGIGLFLLLIASNDVGLVVKNSGAGLPVALGKITAFPVVMSVLGLAAIFGLERRRVPGGILLVIVAISVLGLIFDPAVKFTGVFALPSLSAPGHQSLIGAMDIRGALSAAVLPSVLALVMTAVFDATGTIRAVAGQAGQLDANGHIRNGGRALTADSVSSIFSAIFGGAPAAAYIESTVGVAAGAKTGLTAVVVGLLFLAVMFFSPLAGLVPSYATAPALMYVGLLMLSSVSRLHMDDLVDALAGLVCAVFIVLTCNIVTGIMLGFCTLVVGRIVAGEWRKLNVGTVAIAVALAAFYAGGWAI

SEQ ID NO: 25112 - protein, 461 aa, Ralstonia eutropha JMP134
MDGIGVTAAHKKIIFLIMLGVMFDVFEQNAVGLVGPILREQWGISVAHIGFLNTLTFSAAALGRVASGYIADRYGRRAMLNANLLLFTLGAVICALAPNYTVLAAGRFIVGIGLGGEISVAVTILAELCSTRFRGTAVGMVSVGSGGLGNMLAPAFGLAVFALFPGPDSWRWLFGCLVVPAIFVVFYRRFIPETPRFLLSKGRVDEANRVLSGLASGRLGKLRGEPTQYIREAVQDDSPRARVRLRDVFQGRLGRRTVALGIAVSMTYGAQISVLTLMPTILMSQGYTISKSLLFTMVMQSGSLFGALAASYCGYHFPRKRVLTIGAGLACAAGLSFGFLTFNVGLVLLFGACFTFCVVLLNTSIWIFAPEQYPTDVRAFGTSLILALGTLAGALTPLISGRVFESYGVGGMFSMLAAMYAVFALSVQFAPETFGRPMGEPEPEDTAELAVGTGTASASGS

SEQ ID NO: 25113 - protein, 328 aa, Ralstonia eutropha JMP134
MKAIDFEDFGEADVLQLRDLPVPEMRPQDLLVRTHAAGVNRADIIHRRGGYGRASFGDSTVMGLEIAGEVIAAGAAVAGFATGDRVMGIVGGGAYAEVARIDYRQAMRIPDGLDYVHAAAIPEVFVTAHEALLHLGRLQAGDKVLIHAGASGVGSAAVQLARAAGARVFATANSGKLPRVRGFGADVLIDYKAEDFGEVVKRETGGKGVDVIVDFIGGSYLERNVLSLANGGRLVQVGLLGGAEGANLPLERLLYGHLQIIGTVMKSRTPEVKRQMVARFAQRWLPGFTESGLVPVVDSVYPLAQAAEAHRRMESNQSVGKIILSTGA

SEQ ID NO: 25114 - protein, 446 aa, Ralstonia eutropha JMP134
MHRLDVHKLVDEAKFNSFHWSVLIWCFVILVLDGYDLAVAGTALPSIMKAMNVEAATAGFMASSALFGMMFGAIALGALADKIGRRWAISICVFLFSAFTAAAGFTNDPITFSVMRFLAGLGIGGAIPNAAAQMTEYSPKKVRSVMVTLMCCGYAVGSILAALLGKQFIETYGWQSVFIAAGAAVVLIPFILKYMPESLPFLIKQHDHTHLREVVRKIRPDMPLEPHEEFPVPAEDKAEGPTVGRLFLDGRGFSSVMFWVAYMTCLFMLYALSSWLVKLMGMAGYSLGSALNFLLAYNAGAVVGAVGGGWLADKLNIKWVTGAFFAVAAVSLTLLGYGAQPLFLIVAVVGASTLGTQILLYAYAGQFYPTAIRSTGLGFASGVGRIGAIAAPIVIGLLVSMKLPLVQNFLAIAMAALIGGVAVTLIKHKSSASSHSHEASAVGQQP

SEQ ID NO: 25115 - protein, 318 aa, Ralstonia eutropha JMP134
MPLDPQARAMLDAMAAMPSPDFTTLRAADYRAAVAAMPAFAPGDSVAAQQDLTIDGAAGPLPARLYRPDDSAGPPLIVYFHGGGFVLCGLDSHDNICRSLARRSGALVLSVDYRLAPEARFPAAADDAVAAVRWAAGHAAELGVDPARLAVAGDSAGGNLAAVVCQQLRGSGIALKHQLLLYPYLDCTDAAADSASYRACAEGYFLSARELDWCRAQYLANPDAAADVRASPLHQRDLQGLPAATIITAEFDPLRDQGEAYGEALRGAGGAATVRRWPGQFHGFMSMQGVLDAASHALDAAAASLRQAFAASGTQEAA

SEQ ID NO: 25116 - protein, 232 aa, Ralstonia eutropha JMP134
MIDKLYGTARDAVNDVPDGATIAIGGFGGAGMPDELIDALIEHGATNLTVVSNNAGNGETGLAALLKARRVRRLVCSFPRQRDAHVFEALYRAGEIELEVVPQGTLAERLRAAGSGIGAFYTPTGYGTLLAKGKETRVINERGYVLEYPIHVDVALINAAAADRWGNLVYNKTARNFAPVMAMAASQTIAAVARICELGELDPEAVVTPGIFVSRVVLRDSAAMQANLMHAS

SEQ ID NO: 25117 - protein, 509 aa, Ralstonia eutropha JMP134
MNARVEPQAFESLATVMAARAAQWPDQPYLLSPDSGHALTFGALSADADALCERYAAAGLASGQTVSVYLPNGEQTARLLLGTMACGLVVNPINLLCQPAQLRYILTHSDTRLIFTWPGGEAAIREALREATLDVPVVITAPDATNLPALPVVRNDAPPLPLPEPDAPALLMYTSGTTGTPKGVLLTHHNLATNGANVSREHALGPADRVLATLPLYHINGLVVTAIAPLVHGGSVVMPTRFSASSFWHDITRHGCTWLNVVPTIIAYLLNDPDGKAPAGVRFCRSASAALPPEHHREFEDRFGIGVIETMGMTETAAPAFSNPLDPQQRRIGSIGRPSGTHARVLGRDGKPVDDGQIGEIVLQGENVMAGYYKAPDVTRDAFTHDGWLRTGDLGYRDADGYFYITGRAKELIIKGGENIAPREIDEALLRHPAVLEAAAVGVPDPAYGQEIVAFVVMRDATPCDDAALRAHCLRELGRYKTPKEFRFISELPRGPSGKVQRLKLLDPA

SEQ ID NO: 25118 - protein, 397 aa, Ralstonia eutropha JMP134
MAANAEFHWADPLLLDQQLTADERAVRDASAAYCQDKLMPRVLQSFRNEKTDVEIFREMGELGLLGPTIPEQYGGPGLNYVSYGLIAREVERVDSGYRSMMSVQSSLVMVPIYEFGTEAQKQKYLPKLATGEWIGCFGLTEPNHGSDPGSMVTRAKKVNGGYELTGAKMWITNSPIADVFVVWAKLAGEDGKEDIRGFILEKGWKGLSAPAIHGKVGLRTSITGEIVLDQVFVPEENIMPGVKGLKGPFTCLNSARYGIAWGALGAAEFCWHTARQYTLDRKQFGRPLAQTQLVQKKLADMQTEITLGLQGCLRLGRMKDEGTAAVEITSIMKRNSCGKSLDIARVARDMLGGNGISDEFGVIRHVVNLEVVNTYEGTHDIHALILGRAQTGLQAFF

SEQ ID NO: 25119 - protein, 443 aa, Ralstonia eutropha JMP134
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 25120 - protein, 265 aa, Ralstonia eutropha JMP134
MPPLPLIEPNTALFLDFDGTLADLAPRPELVQVEPELVGTLRRLYDRLDGALAIVSGRPIIELDHFLQPLLLPAAGVHGAELRTAGAQIEMKPAPGLEPLIPPLEALVRRHPGLRLERKSVAVAIHYREAPELEGLVRAAVTDVLRHANGLEGMPGKMVVEIKPAGINKGDAIAAFMNMPPFAGRGPLFAGDDVTDEAGFAVVRKLGGVGVLVGQRETMATVSVTGPAALRCWLHRSARAFDGTPAPDERPAVSDPQRDLEGDSL

SEQ ID NO: 25121 - protein, 469 aa, Methylobacillus flagellatus KT
MAVADVLKLVKENDIKFVDFRFTDTKGKEQHVTVPISAFDEDKFTEGHAFDGSSIAGWKGIQASDMLLIPDPNTANIDPFMDEPTLFLTCDVVDPTDGKGYDRCPRSIAKRAEAYLKSSGIGDAAFFGPEPEFFIFDSINWSVDMSGSSVKINSEEAAWASNEKFEGGNTGHRPGVKGGYFPVPPIDSLHDIRSAMVVALEELGVPVEVHHHEVATAGQCEIGTKFSTLVQRADWTQILKYVVLNTAHAYGKTATFMPKPISGDNGSGMHVHQSVWKDGKNLFAGNGYAGLSEFALYYIGGIIKHARALNAITNPGTNSYKRLVPGFEAPVKLAYSAKNRSASIRVPFVQSDKARRIEARFPDPTANPYLAFSALLMAGLDGVQNKIHPGEPATKDLYHLPPEEDAAIPTVASSLEQALEALDKDREFLTRGGVFSDDWISAYIDLKMEEVTKLRQTPHPIEFSMYYSV

SEQ ID NO: 25122 - protein, 268 aa, Methylobacillus flagellatus KT
MSRIQATFATLKSQGKKALIPYITAGDPHPKHTVALMHALVQAGSDIIELGVPFSDPMADGPVIQCATERALAHKVGLINVLEMVREFRRVDDRTPVVLMGYANPIEAMGQAKFAERACAAGVDGVLTVDYPPEECQDFVQLLKSQQLDPIFLLSPTSDSSRVDMIVHQAAGFVYYVSLKGVTGSQNIDIAEVGTRVKAIRSRTDLPVGVGFGVRDAATAKAVAEIADAVVIGSRMIQEIENSSEDALLSNVAALTQSMRTAIDDAKT

SEQ ID NO: 25123 - protein, 355 aa, Methylobacillus flagellatus KT
MSDILKGCRDQIDAIDEQLLELINARAALAREIGELKGEGPIYRPEREAQVLRRLLEKNTGPLSAEAVTAIFRSVMSNCRALERELSVAFLGPQGTYSEEAAIKQFGGLNNPKPCMSIDEVFRMVESGNADYAVVPVENSTEGAVGRTLDLLTTTSLHICGEVALPIHHCLLRRRHADGEIRRIYSHAQSLGQCHEWLNLNLGGVERVSTGSNAQAAELAAQDAFAVAIAGRRAADIFGLDILAENIEDDPKNVTRFLVLGKHEAAPSGQDKTSLLLATKNVPGAIVGLLTPLAEHGVDMTELGSRPSKLGIWDYVFFVDIKGHYQDPAVARALHELEQRASMFKILGSYPVAVI

SEQ ID NO: 25124 - protein, 472 aa, Methylobacillus flagellatus KT
MATLGPASSEEAVIERLVDAGMDVVRLNFSHGSAQDHIARAELVRDISRRSGRPVGVLCDLQGPKIRIGKFENDRILLKAGDRFILDAACKLGNQERVGLDYKTLPSEVEPGAVLLLDDGRIVLNVEAVNGGEVHCTVAAGGVLSNNKGINRKGGGLSAPALTLKDQEDIRTAVALEADYIAVSFPRSGADIELARHLVREAGGHAAIVAKIERAEAIDALEEIIDAADVIMVARGDLGVEVGDAAVPGLQKRMIRTARMRNKLVITATQMLESMISSPIPTRAEVSDVANAVLDGTDAVMLSGETAVGHYPVESIQAMHRVCLEAEKEYDSHHLQAPINDEFEFIDEAIAMASVYAAEHLNVKAIAALTKSGSSVTWLSRSNTNVPIYALTTERDTRRKLTLYRGVYPYHVEFASQELSKILYDAEETLLRLGAVQRGDLMMLTFGEPIGKAGGTNTLQIVRVGEHRRERH

SEQ ID NO: 25125 - protein, 307 aa, Methylobacillus flagellatus KT
MSTALVSHPDTLLHVMDGLHPESPARITAIMDALAEHRLLDKLQRHEAPQATDEALLRVHDAAYIKHIRSIAPRAGIVRLDPDTAMGPMSLSACLHASGAVIKAVDLVMQKQVTNAFCCVRPPGHHAGRARAAGFCIFNHIAAGVAYALASYKLKRIAVLDIDVHHGDGTEDIFRNDPRVMLCSTFQHPFYPHSGADTRLDHIVNVPLPAESDGAAFREAFLLRFEPALQRFQPQMVFISAGFDAHANDPLAQLMLKGEDYHWITQFAMRIAEQHADNRIVSLLEGGYHLPSLAESATIHVRTLAGL

SEQ ID NO: 25126 - protein, 218 aa, Methylobacillus flagellatus KT
MRVILLGAPGAGKGTQATFIKEAFDIPQISTGDMLRAAVKAGTQLGLEAKRYMDSGGLVPDDVIIGLVKERIKDADCQQGFLFDGFPRTIPQAEAMKQAGVDIDYVVEIDVPDEEIIKRMSGRRTHLPSGRTYHVVFNPPKVAGKDDVTGEDLVQRDDDKEETVAKRLEVYHRQTKPLVDYYSNWAANGAANAPKYVRISGLGEVSEIRRQVLQALGK

SEQ ID NO: 25127 - protein, 437 aa, Methylobacillus flagellatus KT
MTTSNASLLQRSLAAVWHPCTQMKQHEALPLVPVKRGEGVWLEDFDGKRYLDGVSSWWVNLFGHNHPHIKQAIKAQLDQLEHVILAGFTHEPVVRLSEQLSLLTGLGHSFYASDGASATEIALKMSFHYWRNHGETAKTRFLSLQNGYHGETLGSLSVTDIALFKDTYAPLLREESIALPSPDWRRAEPGESAEQYALRCAGQAEAYIAQHHAGIAAVIVEPLVQCATGMAMYHPVYLQRLRALCDRYQVHLIADEIAVGFGRTGTMFAIEQAGIKPDFICLSKGITGGYLPLSVVQTTQDIYAAFYDDSVTRGFLHSHSYTGNALACSAALATLDIFAQHDVLNSNRRKAGYLNRRLAAWRDLPIRHLRNTGMIWAFDVTPSRPGFQQRFYQAALQRGLLLRPVGNTVYFMPPYIISEEEMDWMLEQARGALEESL

SEQ ID NO: 25128 - protein, 177 aa, Methylobacillus flagellatus KT
MSTIQQNYFELFGLPVQFALDTALLDQRYRTLQAEVHPDRFVAASANERMQSMQWATQANEAYRILKHPTSRARYLLQLHGVDTEEESNTVMPADFLMLQMEWREAVEEAFDNGDVTTLESLLKEMREQARTLEQSLEDTLDRQRAWQASTEIVRKLSFIDKISNDVEHKISKLEDE

SEQ ID NO: 25129 - protein, 356 aa, Methylobacillus flagellatus KT
MAKLFTPIRFRDTEIKNRIFVSPMCQYSAEEGIANHWHLVHLGGLAVGGAGLIIVEATAVAPEGRITPFCLGLWSDAHTQAFKPIVDFIKQQGAIPAIQIAHAGRKASCDAPWRDGKFLPPEQGGWQTFAPSAIPVTPEHGTPHALSREEIQQVAAQFHAAAKRALDAGFEVLELHCAHGYLLHEFLSPLSNRREDEYGGSLENRCRLALDIARDLRTLWPQDKPVFVRISATDWVEGGWDIDQSIQFAKWLKEAGIDLIDCSSGGLILDAKIPAGPGYQTEFAQRIRHETGIATGAVGLITSAVQAEHILVSGQADVVMLARKLLSDPHWPLHAAKELRTDVTWPAQYVRAKHIE

SEQ ID NO: 25130 - protein, 311 aa, Methylobacillus flagellatus KT
MALTQRDFKKNNGHAVAIFGEVLADVFPDGSVLGGAPFNVARHLQAFGLHPVMITRVGQDDLGRELLEEMQRLGMDTSGVQIDPVHPTGQVKVHLSPSGHQFEILPAQAYDYIHAGVTHMVTMATKPDLVYFGTLAQRNMESRLALDNFLNYGTSPRFLDINLRDPWYDKHTVRRSLLRADLVKLNDEELAILVKMLRLPGRSPQEHAAALIKRFNLDLLLVTEGDKGSWLMNAAGQVEAVEGAEPPQTFVDTVGAGDAFASAFILGILKGWPADVTLARANQFAAALCSVRGAAPSSLAFYVPYKQEWQL

SEQ ID NO: 25131 - protein, 428 aa, Methylobacillus flagellatus KT
MSRNQQLFEQSQTLIPGGVNSPVRAFGSVGGTPVFFKRGLGARLWDEDGKEYIDYVGSWGPMILGHAQPDVIAAVQATAANSLSFGAPTALELEMAQLITQLVPSMEQVRLVSSGTEATMSAIRLARGFTSRSKILKFEGCYHGHADSLLVKAGSGALTFGQPSSAGVPPELAAHTLTLPYNDVQALEHLFEELGKEIACVILEPVAGNMNLVRPTPEFLGALRSLCTHSGTLLIFDEVMTGFRVALGGAQQLFGIKPDLTTLGKVIGGGLPVGAFGGRADVMAFLAPLGPVYQAGTLSGNPVAVAAGLATLKQLQRPGFHEELALKTRQLTDGLARAARDAGVTFSAQSVGGMFGLYFSAECPASFAEVMQSDKQAFNRFFHGMLEAGVYLAPSAFEAGFVSIAHSEADISQTIVSAQGVFSRINDQ

SEQ ID NO: 25132 - protein, 293 aa, Methylobacillus flagellatus KT
MGGNMARRLLKHGIEVVGFDFNQDAVNQISLTNGMIPASSVEDAVSKLSGEPRKIVWIMLPSGDITENQIKDLVPLLSKGDIIVDGGNSNYKHSQRRGAWLAEHGIEFIDCGTSGGIWGLDNGYCLMYGGSKDAADAVVPIMQALAHADRGWAHVGPVGSGHFTKMIHNGIEYGMMQAFAEGLDLLKGKEEFNLDLAQITELWRHGSVVRSWLLDLTAEALAHDQELSAIAPYVADSGEGRWTVVEAVDQGVAAPVLTLALQMRFASQEDTGYSYKLLSMMRNAFGGHAVKTK

SEQ ID NO: 25133 - protein, 218 aa, Crocosphaera watsonii WH 8501
MSVTTLEARELFRTAYENRYTWDENFPGYTADVTFKDNDRTFNGQVRVNQDMSTEVFNIEDEQAAAQVKSQLWETSIHRVRRSFEQVHGKNIFSYGNTDESGAVEILMGGKAEGDRYKLRDNEVCHVHRHIHGVVVSIDTFSSHNTEEGYLSHRYDSIYRDPKTGDLKAGKTDFEDNYEQVGGYYILTSRVITAEENGETVTKDFGFSNVKLLQPAMV

SEQ ID NO: 25134 - protein, 264 aa, Crocosphaera watsonii WH 8501
MTSVSDCFQSLRDRGQCALIPFITAGDPDLDTTAKALRVLDASGADIIELGVPYSDPLADGPVIQAAATRALGRGVKLEDVLKIVKEVQPEIKAPIILFTYYNPIFYRGVEPFLQQIKAAGVQGLVVPDLPLEEAETLLKPAAAMGIEVTLLVAPTSPIERIQAIATQSQGFIYLVSVTGVTGMRTQVGSRVEELLKNLRSTTNKPIGVGFGISEPEHALQVKNWGSDAVIVGSACVKRLAQGTPEEGLNSLATFCQSLKQALL

SEQ ID NO: 25135 - protein, 138 aa, Crocosphaera watsonii WH 8501
MVQTKENKKSEVAAIPFSVAHTGVAATEMRPWGSFTTLEEGPGYKIKRIEVNPGHRLSLQMHHHRSEHWIVVSGTAKVTCGDKEEILAANQSTYVPQCTSHRLENPGVIKLILIEVQNGEYLGEDDIIRFQDDYSRHK

SEQ ID NO: 25136 - protein, 490 aa, Crocosphaera watsonii WH 8501
MVTATRPENKVKIGPTQLLINNKWVESASGKRFETINPSTGEVICDVAEADAADVDKAVIAARNAFNQGDWPKLSATQRGQLLYKLADLIEANIEELARLETLDNGKPYQDSLNADLQLVIACYRYYAGWADKIQGKTIPINGPYFCYTRHEPVGVVGQIIPWNFPLLMQAWKLAPALAAGNTVVMKTAEQTPLSALRLGELILEAGFPPGVVNLLSGYGPTAGQAIARHHDIDKVAFTGSTEVGHLIMEAAAQTNLKRVTLELGGKSPNIVFADANLEQAIEGAHFGLFFNQGQCCCAGSRLFVEEKCYDEFVAKSVERAKQRIVGDPFDDNTAQGSQVDRTQFDKVMEYIESGQREGAKLLCGGGRVGDRGYFIEPTVFAEVKDNMKIAQEEIFGPVMSIIKFKDMDEVIQRTNDTVYGLAAAVWTQDISKGHAIANALRAGTVWVNCYDVFDAAAPFGGFKQSGMGRELGEYGLQQYTEIKTVTVKL

SEQ ID NO: 25137 - protein, 249 aa, Crocosphaera watsonii WH 8501
MSQTAPENAIIAQDVEKWYDNNFHVLRGVSLTVTQGEVVVVMGPSGSGKSTFIRTFNALEPYQKGSITIDGIKLSHDLKNIEAIRREVGMVFQQFNLFPHLTVLNNVTLAPIWVRHWKKEKAEAKAIQLLEKVGILEQAEKYPGQLSGGQQQRVAIARALAMEPKIMLFDEPTSALDPEMIKEVLDTMRSLADGGMTMVCVTHEVGFAREVADRVVFMDGGKIVEIATPEDFFNAPQEERSQKFLSQIL

SEQ ID NO: 25138 - protein, 243 aa, Crocosphaera watsonii WH 8501
MAVGKIIIAGNWKMHKTQAEALEFLTVLKSKVEETNETREIVLCVPFTALSILSKSLHGGKVRLGAQNVHWEDKGAYTGEISGPMLTELSVDYVVIGHSERRQYFSETDETANLRVITAQRHGLTPILCVGESKQQRDAGEAESVIINQLQKGLVDVDQSNLVIAYEPIWAIGTGDTCESTEANRIIRVIRDQLSNKNVTIQYGGSVKPNNIDEIMAQSDIDGALVGGASLDPVNFARIINYQ

SEQ ID NO: 25139 - protein, 353 aa, Crocosphaera watsonii WH 8501
MTQPLIPVILAGGKGERFWPLSRRQRPKQFLSLDGSGESLLQATANRLLPLADNWDNLWVITASPIADGVREQLPNLPSNNLLVEPQGKDTAPAVAWTTLEIAKRYGKDAVIGFFPADHWIKETDEFEKTLNAASQLAIAEDAIVTLGIKPNYPSTGYGYIEQGNLTNNFNDLPVYKVTRFTEKPDLETAKSFLETGRFSWNSGMFIFRAGVVLQELEKHTPQVLKPLQEKGEAAYEELEKTSIDYALMEKTDLTYVLPANFGWDDLGNWNSLERLVDSNGDNVELGNHVTLDSKGAIIYNSDEQEVIATIGLEDVVIVRDKNVTLVVNKNRTQDIKKLLKELQKDSQLDKLL

SEQ ID NO: 25140 - protein, 173 aa, Crocosphaera watsonii WH 8501
MPRTQRNDNFIDKSFTVMADILLKILPANKKAKEAFVYYRDGMSAQADGEYAEALDNYYEALKLEEDGNDRSYILYNIGIIHASNGEHEKALNYYQEAVELNPQMPSALNNIAVIYHYQGEKAKSEGDTNEAEALFDKAAEYWKQAIRIAPNNYIEAQNWLKITGRSEMDVFF

SEQ ID NO: 25141 - protein, 324 aa, Crocosphaera watsonii WH 8501
MDIKEGFVGTVGNTPLIRLKSFSEETGCNILGKAEFLNPGGSVKDRAALYIIKNAEEKGLLKPGGTVVEGTAGNTGIGLAHICNAKGYKCLIIIPETQSQEKIDLLRTLGAEVRTVPAVPYKDPNNYVKVSGRLAEELDNAIWANQFDNLANRQAHYETTGPEIWQQTNGKVDGWVSATGTGGTYAGGALFFKEKNPNIKCIVADPMGSGLYSYVKTGEIKPEGSSITEGIGNSRITANMQDVPIDDAIQIDDHEALRIVYQLLSQDGLFMGGSVGINVGAAVALAKEMGPGHNIVTILCDGGARYQSRLYNQEWLASKGLSLG

SEQ ID NO: 25142 - protein, 151 aa, Crocosphaera watsonii WH 8501
MKPVDFLLIIHPALAVIFVFPLIGIVSYYSWQTRQRRLALANKEKSKIPPIVGTEHVKIGRWLSTGVVAITLFGLAYPIGEDIIKKQLWGTNFFQFIFLILMFVLTAVSLYFLHNAREAKWRGIFATLTGMGIVILGCQDNVFRRTNEWYN

SEQ ID NO: 25143 - protein, 137 aa, Crocosphaera watsonii WH 8501
MSQSRPGVYFQVMMAAKDYETIDRLSPAFLAYIGDAVYELYVRTCYLLPPRKVGVYHNQVVAQVRAETQAKALQKLTPLLTTVEQDIVRRGRNAATGCPRRLKPEIYQQATSLETLIGYLYLRDTERLSELLNILIT

SEQ ID NO: 25144 - protein, 144 aa, Crocosphaera watsonii WH 8501
MTDFSLTPDRSGLEPELGGIFRDAPERTGFEPELGGQLRQKGVYVDELTCIGCKNCVHFAPNTFYVEENYGRARVYNQDGDEEDTIQEAIDTCPVDCIHWVDYTELEELEDVRQHQQIKPLGFPQTHRTSKRRKKFPRRRLRHE

SEQ ID NO: 25145 - protein, 126 aa, Crocosphaera watsonii WH 8501
MTPDKPLTGTALVDKVKELGDLSKEEKARACGYYTQTKNGIERVNMMKFLNALIDAEGIELDSNAEGQGRGGRSASYKISVQSNGNLLIGSAYTKQMGLKSGDEFEITLGRKHIHLKQVGAPNEDD

SEQ ID NO: 25146 - protein, 321 aa, Crocosphaera watsonii WH 8501
MVENRQSTVVITGASSGVGLYAAKALADRGWYVVMACRNQPKAHQAAQSLGIALDAYTVMHIDLGNLDSVRQFAQDFRATGKTLDALVCNAAIYMPLLKEPLRSPEGYELSMTTNHLGHFLLCNLMLEDLSHSSAPEKRMVILGTVTHNPDELGGKIPPRPDLGNLEGFADGFKEPISMVDGKNFEPVKAYKDSKVCNVLTMRELDRRYHESTGIVFTSLYPGCVADTPLFRNHYPLFQKIFPWFQKNVTGGYVSQELAGERVADVVTKPEYGESGSYWSWGNRQKKDRQAAFVQNVSPQAQDEAKAEKMWNLSEKLVGLA

SEQ ID NO: 25147 - protein, 392 aa, Crocosphaera watsonii WH 8501
MHFAQRIQALEKNVFADMDRAKSQAISKGKKIIDLSLGSSDLPADPEAIATISASLEDPSTYGYLLHHGTLNFRETVGQWYSNRFGVEVDPQREVLTLIGSQEGTAHLPLALLDPGDFALLLDPGYPSHAGGVYLAGGQIYPMPLLAENDFLPVFEDIPSQVLGQAKLMVLSYPHNPTTATASLSFFQEAVNFCRNHGLVLVHDFPYVDIVFEGMTQPPSILQADTQKSLSIEFFTLSKSYNMGGFRIGYAIGNAEIIQALRQVKAVVDFNQYQGILNGAIAALTGEQTTVKKTLARFQSRRDAFIKALNNIGWQVTPPQATMYVWAKLPQTWENKSVEFSTELVAATGVAVSPGAGFGKQGEGYVRFALVHDPHVLELAVEKIAQFLATRT

SEQ ID NO: 25148 - protein, 190 aa, Crocosphaera watsonii WH 8501
MSTGKGLIFLGPPGSGKGTQAQELSKELNIPHISTGEMLRAAIAKQTSLGQKAQVYMDKGELVPDELLLGLIEERLKEKDAENGWILDGFPRNVAQAEFLDKLLHKLAKFSEQAINLDVPDPVIIDRLLLRGQKEGRKDDNEETIRRRLEVYREKTQPVLDYYRQQDRLSSVDGNRELQEVTKTLKAVVT

SEQ ID NO: 25149 - protein, 472 aa, Crocosphaera watsonii WH 8501
MPQATKAGFNAGVQDYRLTYYTPDYTPKDTDLLACFRMTPQPGVPPEEAGAAVAAESSTGTWTTVWTDNLTDLDRYKGRCYDIEPVPNEDNQYFCFIAYPLDLFEEGSVTNVLTSLVGNVFGFKALRALRLEDIRFPVALIKTFQGPPHGITVERDKLNKYGRPLLGCTIKPKLGLSAKNYGRAVYECLRGGLDFTKDDENINSQPFMRWRDRFLFVQEAIEKSQAETNEVKGHYLNVTAGTCEEMMKRAEFAKEIGTPIVMHDFITGGFTANTTLAKYCRDNGLLLHIHRAMHAVIDRQKNHGIHFRVLAKCLRLSGGDHLHSGTVVGKLEGERGITMGFVDLMREDYVEEDRSRGIFFTQDYASMPGTMPVASGGIHVWHMPALVEIFGDDSCLQFGGGTLGHPWGNAPGATANRVALEACIQARNEGRSLSGEAGNQVIREACKWSPELAAACELWKEIKFEFEAMDTL

SEQ ID NO: 25150 - protein, 390 aa, Crocosphaera watsonii WH 8501
MTSDVPQSSNPDLTPDTPQENTFIEEIEGLEPLNIPDIEGDNPLLDPSDQLLYLTEESSKSVDLENTIEELTQEVEILKQQKQGLIAEIESLEVTKAQKISEKTQTVEETLEKMIVEGLKELQQKKQTLELSVEQLERRRDRIREEMKTNFAGISQDLAIRVQGFKDYLVGSLQDLAAAAEQLDLPSQQSWEQPSEPVNSPSVSGSNAQFAPQEFAEQTRKIQQILEQYRKNPDYYGPPWQLRRTFEPIHTERVQKWFFSQGGRGTVKSMGSRLQNILVASAVISILNELHGDRTRFLILANTPERLGEWRRGLQDCLGISRGDFGPERGVVLFESPNALVQKAERLVEEDFLPLVIIDEAEEQISLSLLQFPLWLAFAPDPEQMSSYLY

SEQ ID NO: 25151 - protein, 216 aa, Crocosphaera watsonii WH 8501
MNLNTIKSPKPPRLLLEDLFAFAPNREILGGTSYFIGEKSGNVLIDCPVYHPDYLSFINKQGGVKWLFLSHRGGISPSLKSWQQALNCHVIIQEQEAYLLPTMTVTSFEKEMAIAESMTIIWTPGHSTGSSCLYWQRHGGVLFTGRHLLPDRKGFPVPLKLDKTFHWGRQLQSVALLCDRFSPDTLHYICPGANTRLLGETGLIDDAYQSLTRFAE

SEQ ID NO: 25152 - protein, 261 aa, Crocosphaera watsonii WH 8501
MEKEPLIELRGVSKAFGGYPILDEIDLTIYRGEALVIIGPSGTGKSTILRLVAGLLPVDAGEVYIKGKRRKGIIEDGHQPMRIALVFQQAALFDSLTVDENVGFFLYEHSKLPRNRIRELVEAKLAMVGLQGMSDRYPSQLSGGMRKRVSFARALIANPDNPLDDPEIVLYDEPTAGLDPISSTVIEDLVRRLQNASGGCDTYVMVSHQDSTIRRTADRVIFLYGGKIQWEGKVDEIDNTTNPIVRQFFSASVKGPIRMID

SEQ ID NO: 25153 - protein, 184 aa, Crocosphaera watsonii WH 8501
MTQLESKKPASLPPGDKGLPLIGESLSFLFDPDFGKKKLKKYGHVYKTNIFGNNAVIMIGAEANQFLFRNENQYVVSTWPKSTRILLGKLSLSTNDGTFHTSRRKLLAQAFKPRALNSYIPKMTEITQQYIDKWLQTKELTWYPELRDYTFDVACSLLISIDNASQTKLASYFETWVKGLFRVC

SEQ ID NO: 25154 - protein, 328 aa, Crocosphaera watsonii WH 8501
MSIKAFVTGGTGFIGANLIRLLLKKGYEVRALVRPQSSLENLKPLDIEIIKGDLNDINLSEKIRGCNVLFHVAAHYSLYQADKEQLHNSNVLGTRSILQAAKQANIERIIYTSSVAAIGVGNPGEIVNETHQSPVNELVGHYKKSKYWAEQEAKKAIIKGQDIVIVNPSTPIGPLDIKPTPTGEIILRFLRRQMPAYVDTGLNIIDVRDVAQGHLLALEKGKTGERYILGNKNLSLKALLEELSQLTGLKAPQQTLPLWLPLTVAWVEETLLSPLGKKPSIPMDGVKMSKQPMYYDPSKAINELGLPSSPIKNALQDAINWFTNNGYV

SEQ ID NO: 25155 - protein, 161 aa, Crocosphaera watsonii WH 8501
MNPLFSARTSVEQVEEGLFLAPKFDGNGLIPVVTTDVNTGEVLMHAYMNEEALVKTIETGEAHYYSRSRQQLWHKGKSSGLVQKVAQLTIDDDQDCLWMQVRVAGSGASCHVGYRSCFYRSIPTGKSAIDSQQPLQLTFTETEKTFDPKAVYGDAPNPTQL

SEQ ID NO: 25156 - protein, 338 aa, Crocosphaera watsonii WH 8501
MIDMEDNIFKDNSTGYMDYKDYYATLGINKSSSADEIKKAFRKLAVKYHPDRNPDDKPAEERFKEISEAYEVLSDPEKRKKYDQFGQYWKQAGQSTWPGGGANVDMGNFDFSQYGNFEEFINELLGKFSTPGGGRTGNYGYGNQGTGYSGYSGGYGNQTPAPNREATLKLTFSEAFRGVQKRLNLGNEIIDVRIPAGAKNGSRIRVKGKGGNSPYSQNRGDLYLNVELTPHNFFAFEDDNLVCEVPISPDEAVLGSTIDVPTPDGMVTVKVPPGIRSGQCLRLRGKGWVNQKKGRGDQLVKIIIDTPQHITDTERNYYEKIRDSRSYQPRQHLQTISL

SEQ ID NO: 25157 - protein, 154 aa, Crocosphaera watsonii WH 8501
MPLPTSLVTLEGTALPLSELENKVILFVNVASKCGLTPQYSGLVQLDKKYGERGFKVVAVPCNQFGEQEPGTPAEIKEFTSTKYDVEFTLLEKQDVNGSNRSPLYQFLVKDGEDIAWNFGKFLVGRDGEVVARFEPATAPDDAQLEAAIDKALG

SEQ ID NO: 25158 - protein, 275 aa, Crocosphaera watsonii WH 8501
MTVETPIPVVVNGAAGKMGREVIKAVAQAEDMMLVGAVDKNPDYRGQDVGEVAGCGELEVPIVDDLESILVVATQEQVQGVMVDFTHPDGVYDNVRSAIAYGVRPVVGTTGLSNKQLQDLAEFADKASTGCLIIPNFSIGMVLLQQAAIQASQYFEHVEIIELHHNQKADAPSGTAIKTAQMLSDLGKTYNPPSVQETESIPGAKGSLVGDNIRVHSVRLPGLIAHQEVIFGAQGEIYTLRHDTSDRSCYMAGVLLSIRKVTELKSLVYGLEKIL

SEQ ID NO: 25159 - protein, 474 aa, Crocosphaera watsonii WH 8501
MAETPQEVLKMIQDNNIQIIDLKFIDLPGIWQHCSFYHNQIDEDSFDAGVPFDGSSIRGWKAINESDMCMVPDPKTAWIDPFYEEPTLSLICSIKEPRTGEWYSRDPRTIAKKAVEYLQSTGIGDTAFFGPEAEFFVFDDVRFDQTENKAYYSVDSVEGRWNTGREEEGGNLAYKPGYKQGYFPVSPTDTLQDMRTEMLLTMAKCGVPIEKHHHEVATGGQNELGFRFATLIDAADYLLTYKYVIKNVAKKYGKTVTFMPKPLFNDNGSGMHVHQSIWKGGQPLFWEEGTYADLSKLATHYIGGILKHAPALLAFSNPTTNSYKRLVPGFEAPVNLVYSQGNRSASIRIPLTGSNPKAKRLEFRCPDATSNPYLAFAAMLCAGIDGIKNKIEPAEPLDVDFYELSPEELSKIPSTPGSLEQALECLGKDHAFLTDGGVFTEDFITNWIEYKLDNEVNPLRLRPHPYEFALYYDV

SEQ ID NO: 25160 - protein, 450 aa, Crocosphaera watsonii WH 8501
MSYDFDLFVIGGGSGGIATARRAAEYGAKVGLAEYNRLGGTCVNVGCVPKKLMVYTSHFSAQFQESQGYGWSPVKSTLDWSKMITAVNEETQRLNGIYLRMLDNSKVKLYRDYAKLLDPHTIEVGNSKITADKILIAVGGHPVRPDIPGIENTIISDQMFTLAEQPKRMVIWGGGYIGVEFACIMRGLGSDVIQVIRRDKILRGFDEDIRSTIQESMENHGIKILKNCTITAIEKTSQGLKIAVQGDQNNEMVLVDTIGLAATGRKPSLDNLGIENTAVEVNNGAIAVDQYGCTAQDNIYAVGDCTDRINLTPVAINEGRAFADTHFGGKSRVMSYENVPSAVFSTPEAATVGLTEEEAKQQYGEDAIKVYRSKFRPMYYVLPGKEEKTLMKLIVHQESEKVLGAHMVGDYAAEIIQGVAIAVKMGAKKSDFDATVGIHPTSAEEFVTMR

SEQ ID NO: 25161 - protein, 280 aa, Crocosphaera watsonii WH 8501
MSKSPTLLSPCQVGNITLKNRVVMAPLTRSRAGEERMPNDLMKQYYSQRKSAGLIISEATVISPQGCGWLNSPGIYSDAQMKAWQPITQALHETETPIFLQLWHCGRASHSSFQENNQLPVSASAVKPNGDYIHTPIGKQSYKTPRALETEEIPPIVEDYRLAAERAKDAGFDGVEIHAANGYLIDQFLQSKTNQRTDKYGGSIENRYRFLKEIIEAVLTVFSAGQIGVRLSPNGVFNDMGCPEYRELFIYVAQQLNSYNLAYLHLLDGLGFGFHELGVQ

SEQ ID NO: 25162 - protein, 400 aa, Crocosphaera watsonii WH 8501
MSKKTIANLSAADLAGKRVLVRVDFNVPFDNGSITDDTRIRAALPTIKELISNGAKVILCSHMGRPKGKVVDSMSLTPVAARLGELLGQKVTMCDDCVGESVTAAIGGLENGQVALLENLRFHSEEEGNDPEFAKQLAANADLYVNDAFGTAHRAHASTEGVTHYLSPSVAGYLIEKELQYLQAAIENPQRPLVAIIGGSKVSSKIGVIETLLEKCDKLIIGGGMIFTFYKARGLNVGKSLVEDDKLELAKSLEAKAKEKGVDFLLPSDVVLADNFAPDANAKTTSIDNIEDGWMGLDIGPDSIKLFQDALSDCKAVIWNGPMGVFEFDKFAAGTEAIARTLAELTGTGTTTIIGGGDSVAAVEKVGVAEKMSHISTGGGASLELLESKVLPGIAALDEA

SEQ ID NO: 25163 - protein, 2629 aa, Crocosphaera watsonii WH 8501
MLLALKQARLQLEALERQKNEPIAIIGMDCRFPGNANSPEAYWELLRNGIDAITDIPSDRWDVESYYDSDPEIPGKMYSRYGGFIEGVDQFDPQFFGISPREALSLDPQQRLLLEVSYRALERAGQPLDSLQGSKTGVFMGICFDDYSRFTLNSGDPTLIDAYSSLGNTRSIAVGRIAYVLGLTGPVIQLDTTCSSSLLAVHLAAQSLRTGESNLALAGGVNLMLSPEVSIGFSKLKALAPDGRCKTFDEKADGYVRGEGCGIVVLKRLSDAIADGDKILGTVFGSAVNHDGQSNGLTAPNGSAQETVIRQAIENAKVDPTQIQYVEAHGTGTSLGDPIEVLALSKVLGKNREQDNPINIGSVKTNFGHLESAAGVASLIKVILSLQHQEIPPHLHFKNPNPYIPWEKLPINVPTKLTPWPAKKGRRLAGVSSFGMSGTNVHLILGESPKVEENIETQNVESSLHLLTLSAKTETALQAQIEQYKTYLNTHQNIPFADICYSANKRRSHHNYRFSIVASSTLEAAEKLNNSLYPNSPPLTRGSSGGSPFYSPPLTRGGWGGSSPPIAFLFTGQGSQYVGMGQQLYQTQPTFKTTVDHCCDILQSYLGWDLKEVIFSEQGTGNGEQETGRLGDGETCYNLDSTINTQPALFVIEYALAKLWLSWGIQPNIMMGHSIGEYVAATLAGVFSLEDALKLITARGRLMQKLPQNGSMIAVFTDLETVEKKISNYKNQVSIAAINHHKNIIISGNNTAIKEIIGKLESQGIKSQVLNVSHAFHSPMIEPMLREFEAIAKQINYSPPKLKLVSTVTGTVMSDEIATPKYWCRQIVEAVKFSQGMEYLVEQDIKIFLEIGAKPTLSNIGQIVIENSNKDQDFSFLASLHPKQENWQTILFTLGQLYVNGFSINWEEFYKYSQINYINNLPTYPFQKQRFWLEKKVNRSFLNQQKQQHPLLGQKINLAGSKNIYFENQISENIPIFLREHRVFDTAILPLAGFLEIALTAGINIFKTQECYLEDVVIQQGLILPPDTIKTIQINLVSETTNNYSFEIYSLNNEQDQDNDWILHSSGQLKQKQIVTSTINLEEEKERFSQGLQIDDYYQKCQERGINYGKRFQGIKHIYKLEREALAYIELPLEIINSSAYQIHPILLDNCLQVTGIVLIEENSLETYLPVALESFVSDNKQDINSSKIYTYAKLNTEKNSIDLKLLSENGEAIADIKGLKLRKASPETLLGKEENDSLENWLYGVKWNKQPLTANILLNPQKIESYLEPKLQNLKDKSDVIEYQELLSELETISFNYILEAFLKLGFKFELETRFTNSQLQEKLGILPTYKRLCDRLLNILAEEGILRKIGEEWQVIKVFEGTGNRERGTGKSPDSSAELTLLQRCGSQLAEVLRGDCDPVQLLFPDGDLTLTTQLYQESTGAKMMNNLVKQVILTALSNKTPESPLKILEIGAGTGGTTAYVLPELDQLSTEYVFTDVSSLFTEKARQQFQAYSFVDYRVLDIEKDPTTQGFLLQHYDIILAANVVHATQDLQQTLTHIRQLLTSQGMLVLLEGTRPLRWLDLIFGLTEGWWRFTDTDLRPTYPLISPSQWQQLLEKNGFVESIVLSPDSNPDSFLSQQGVMVARNAEDINTEAKNWLILGDRQGIASHLVQTLESKGENCIVAYSDSHYQQIGAKDYQVNPQNEQDISRLLEKKQFDQIIYLWGLDDPSEEDLTIDTLETGSENHCRSILQLIQNSYNKPPRFWLVTKGVMATDKNDPVVSITQSSLWGLGKAISLEHPEFNSVCVDLEINTELKQQVKVLLEEINANSPENQIAFSKNTRHVARLVPQKLSTATTQPRQLTISQRGTLENLQWQPLNRHSLKSGEVEIRVKATGLNFRDVLNALDLYPGDAGPLGCECVGEVISKGEDVELMNIGQEVMAIASGSFRDYVIVDAGMVTPKPDSLTIEEAATIPVTFLTAYYTLHHLAKIKKGDRVLIHAAAGGVGQAAIQIAQKVGAEVFATASVGKWNTLRQLGVSHIMNSRTLDFAEEILTITEDEGVDIVLNSLSGEFISKSFAILKDNGRFVEIGKSLKLEGKYPTQPSQEEIPPTPLGKGSQLPTQLSQEGKAEGLDIHSQLKPDAAYFQVDMFKVCQEEPELVQSMLCHLREQLQTGNFQPLSYQVFPREDAISAFRYMQQAKHTGKVIVSYSDRELGDWETGRLGDWETGRLGESETEGNDQSSLKFSEDGTYLITGGLGDLGLLVAQWMIEKGAKNIVLMGRNEPKLEQKQKIKALETLGGNITIAQGDVSNKEQLATILKAISPSPHLPVPPSPRPPLSPSPLSPLKGIIHAAGVLDDGVLKQLTWERFNKVMSPKVQGAWNLHNLTKDKPLDFFVLFSSAASLLGSPGQANHVTANTFLDTLAHYRRSQGLPALSINWGLWSDIGAAAKRQVKRQGVGAIAPDEGITILEMLMKDSLAQVGVVPIKWDEFLQIEQNIPFFSNFKQQKATSTNSSSNFLQQLEDIPPEEKENYLREHIRAEISQVLGFNPSDVDMEIGFFDLGMDSLTAMEFKNRLQNTFACTFPSTIAFDYPTGDALVSYIATEVLQLTEETIEPLEEDDTENLSQDDIADLLAQELSEIQGGDE

SEQ ID NO: 25164 - protein, 116 aa, Crocosphaera watsonii WH 8501
MPLIQVKTSVSQPESKVVDSLLTTLSAKLAQHLGKPESYVMTSFDADVKMTFAGSFDPVCYLEIKSVGSMSSQQTKSMSEDFCQVVENTLGVDKNRTYIEFADAKGSMWGWNGRTF

SEQ ID NO: 25165 - protein, 475 aa, Crocosphaera watsonii WH 8501
MSLDYDLVIIGNTNQAFFAASEAIKFNARVALVLGNIHDDSWQEIDSLIFNYLTYIERHWHNLNNWYLNINLDSWLDFNQLQKWSNEVKKDIKATNNLESLANLGVDIIEESGEFCRLPKLGFVLKNRTLRSRRYLLATGAIYNIPQIQGLTEVGYITPERLDIDQLPNRLVILSQTALGIELAQQLNRLGKEITLIFDNSNILPLEDPDIIQLIQAILETGGIKLLMNCPITQVREIEGTKWIQAGNEAIETDEIIIADKIKQQTQGLNLEGVRVKIEADKIQINNKLQTTNPSIYVCGQTISSYNLSNLACYEASIAVKNAILYPIFKVNYNLSPMRMLTNPMFSQVGLTETQAKRDYKKDLIIVKQNYKSLVKAKMLDETTGFCKLITRRNGMILGCGIIGNQSEEIINLIALAIQNKVKIQKISQLFPPYGTTSEILFQISQKWQTQKPPKNTFINNCLETLLFWRRKWNK

SEQ ID NO: 25166 - protein, 123 aa, Crocosphaera watsonii WH 8501
MSKQKDSHPSEFTRTPPWGKVTMLEEGHRYRINRIELNPGQHISTQMHYHRSEHWIVVSGTAKVVFNGEEHLLKQKESTYVPMNTRHRVENPGVIPLVLIEVQNGEYLGDDDIIRFAEEEGKK

SEQ ID NO: 25167 - protein, 496 aa, Crocosphaera watsonii WH 8501
MQVTSKNKSEIQEQALNNLVKSHNQKTATSKHKAQQNRAILADRSALGVKFSPEIKEICYPIIIERSQGSKIWDIDGNEYIDILMGLGVNLLGHNPPFIKEAIAQQLEKGIQVGSQTILAAEVAQLVKDLTGMERVTLSNTGTEAIMAAIRIARAATKRKKIALFTNSYHGHSDQTLVRATLAEYAKKAINRKISEKIGDKSWLSQLMRPLQNQLQNNLNPKAVPAALGIPPSQAKDVLVLEYGNDKSLDIIKANRKQLAAVLVEPVQSRCPQVQPEAFIKELRQVTQEGGIALIFDEMVTGFRIHQGGAQAWFGIDADIVTYSKIAGGGLPLSIIAGKSTYLNRIDGGIWNFGDDSSPSVETTFFAGTYCKHPLSLAAAKATLTHLKTEGATLQETLNQKTAKMVDCLNSDLASQGLMLKFTCFGSFFALDLSQSVISPLALTLLSYYLLSRGIHLRQGDRGGFLSTSHTDNDINLIIQAFKDSINDLQAGGFLE

SEQ ID NO: 25168 - protein, 311 aa, Exiguobacterium sp. 255-15
MKIYSLGEALIDLIPLDADNVTFQKNPGGAPANVAVGLARLGADSYFLGSVGDDSMGHFLKDTLHHYGVKTDHLVFDPEHKTGLVLVTNAADGERSFEFINSYRADMSFHEKDIPDSLAEADLLHIGSISLISGDAVEATRRAIEVAKSNNVPISYDPNLRESLWSDLDAARSTIRSVLPDAQIVKLAEEELTFLTGQTNLDEGAAELLAEYPIRLLAVTRGAEGSLLYTDRSMAEIQAISVDAIDTTGAGDAFMSGLLHQCAIRSFSFDWDETELQDIGRFAAISGGLAASVKGAMAALPTLDEVSRRLT

SEQ ID NO: 25169 - protein, 181 aa, Exiguobacterium sp. 255-15
MGIHPVMEIVIKEKLVSESELAAKVKELAVAIERDAAGRQIVLVVVLKGSMVFAADLMREIKGSVQIDTVACSSYGAKTVSSGRVQLKKDLDLDVEGKYVVVIEDIIDTGHTLSFLCEHMKLHKPGVLKICTLLDKPARREVPLDADYVGFEIPDYFVVGYGIDCAEEYRNLPYVGWVETD

SEQ ID NO: 25170 - protein, 400 aa, Exiguobacterium sp. 255-15
MNQTEKIITQTEKFGAHNYHPLPIVISEAEGVFVKDPEGREYMDMLSAYSAVNQGHRHPKIIEALKRQADKITLTSRAFHNDQLGFFYEKVAQLTGKDMVLPMNTGAEAVETAVKAARRWAYEVKQIPGDAEIIVCEGNFHGRTMTAVSMSTEAEYQRGFGPLLPGIKTIPYGDLEALKGAITENTAAFIVEPIQGEAGILIPYEGFLKDAQDVCKEQNVLLVSDEIQSGLGRSGKWFASDWDNVTPDMYILGKALGGGVFPISCVAANHDILSVFNPGSHGSTFGGNPLACAVSVASLEVLEEEKLPERSLELGTYFMNRLKEIDNPMIKEVRGRGLFIGVELTEAARPYCEALKEKGLLCKETHETVIRFAPPLVITKEELDWAFERIEQVLGVSVAQ

SEQ ID NO: 25171 - protein, 448 aa, Exiguobacterium sp. 255-15
MTRRNITREDIMKIAKAEDVRFIRLQFTDILGTIKNVEIPVSQLEKALDNKMMFDGSSIEGFVRIEESDMYLFPDLNTWVVFPWTEDGTGKVARLICDIYNPDGTPFAGDPRGQLKRVLKEMEELGFTSFNVGPEPEFFLFKKDANGRPTLELNDQGGYFDLAPVDLGENCRKEIVIELENMGFEIEASHHEVAPGQHEIDFKYADAITTADNIQTFKLVVKTIAAKHNLHATFMPKPLYGVNGSGMHANMSLFKGNENVFFDEENSNMQLSDDARAFTAGILKHARAFTAVCNPTVNSYKRLVPGYEAPCYVAWSARNRSPLVRVPAARGLSTRIEVRSVDPAANPYLALATLLASGLDGIKNNLQAPAPIDRNIYVMDKPERVANGIDDLPSTLSHALEVLKADDVVMHALGEHIAEHFVELKEIEWDMFRTQVTEWERDQYMVLF

SEQ ID NO: 25172 - protein, 290 aa, Exiguobacterium sp. 255-15
MRFDEAYSGKVFIASQPTHEDAKGVLYGMPMDWTVSFRPGSRFGPARIREVSLGLEEYSPYLDGDIADAKLFDAGDIPLPFGNAQKSLDMIEEYVDSLLTAGKFPLGMGGEHLVTWPVVKAFDKHYEDFVVLHFDAHTDLRDSYEGEPLSHSTPLKKIANLIGPENCYSFGIRSGMKEEFEWAKTSGYNLFKYEIVEPLKAVLPKLAGKKVYVTIDIDVLDPSAAPGTGTQEIGGVTTKELLEVVHMIARADVDVIGADLVEVCPAYDQSDMTAIAAAKVLREMMIGFIK

SEQ ID NO: 25173 - protein, 287 aa, Exiguobacterium sp. 255-15
MALGWIGLGHMGVPMALRLRRAGHPVNVYNRTVEKTESLVKEGAVALESPRAVVEQSDIIFLMLADGPAITAVFEQENGLLASKLSGKTLVNLSTISPEQSVSFAERIEQAGATYLEAPVSGSVGVAEAGQLVLLLGGDEQAIAACRPYFEILGKESIHFGAHGTGSSAKLAINLLLALVGEGVAETLLLGERAGLDKEKLIQLIGASGMNTPLFQGKQTMYRDEQFPPAFPLRLMAKDLGLITEEAKRLTLDLPLAATAQTQYQHALESGHGDEDMAAVYLSLKQR

SEQ ID NO: 25174 - protein, 291 aa, Exiguobacterium sp. 255-15
MISVAKDYYRTLGVEKTASNQEIKRAYRKLAKQYHPDVNQEASADQRFKDIQEAFDVLGDEEKRAQYDQYGSNYERMAGAGYGQSADYDDLFRQFNGRQSRTAGSAGQSFGFEDMFGSFFSQEPEETDEELELTVPLSHLSQNDKVTIRLATGAIQMSLPKDLYDGKKVRLRGKSSKRNRKGIAGDVYVTIHLKDDDQFRRQETDVISTVRVYPTVFVLGGEVVADTLEGKRVKLKIKPGTKPGARLRIPNRGLSNREGHRGALLVQLEVKLPEMEPSFYEEWENRLSVKE

SEQ ID NO: 25175 - protein, 370 aa, Exiguobacterium sp. 255-15
MHVEKRDYYEVLGVARDASAAEIKRAYRKLARTYHPDVNKEADADQKFKELSEAYEVLSDDNQRARYDQFGHQDPSQGGGGFGGAEGFGDIFDMFFGGGRRQDPNAPRKGQDLQYVEEIDFMEAFSGVEKVITIPVEEDCGTCHGSGAKPGTHPETCKRCGGSGHINVEQNTMFGRVVNQTTCSTCHGRGQIVKEPCETCRGAGRVRKNKDVRVKIPAGIDNGQQIRLAGKGEAGVNGGPFGDLYVVVRVREHELFERVDDHIVMDMPLTFAQATLGDEIEVPTVHGKVSLKIPAGTQTGSRFRLRGKGMPNVRSGHHGDQYVNVVIITPKNLTDRQKELLREFNEISDEKGVEEQHEGVFSRIKTFFTG

SEQ ID NO: 25176 - protein, 107 aa, Exiguobacterium sp. 255-15
MIELNFSKGLVAAVILDETTNDVLMVGFMDQAAYDKTLATGLVTFFSRTKNRLWTKGETSGHTLELRRMWIDCDQDSLLITVKANGPTCHTGNRTCFYTEVEVPHAT

SEQ ID NO: 25177 - protein, 159 aa, Exiguobacterium sp. 255-15
MLQEQTFQRIDGTEATLKDYPGQAWLIVNTASKCGLTPQFEGLEQLHQDYRKQGLVVLGFPCNQFAGQDPGTDEEIQSFCQMNYGVTFPVFSKIEVNGKGTHPLFAELKALAPNTTGEQDVEWNFTKFLVTRDGEVTRFAPKTNPTDLVAAIERIVVPV

SEQ ID NO: 25178 - protein, 475 aa, Exiguobacterium sp. 255-15
MKSYQLVVIGGGAAGMTIAAGAASLGAHVALIEKHTHLGGDCLHYGCVPSKALIEAAHDVHVMKQTAAKYNVTLNGEAVYSKTKASVDRARNIIQSHDGTKRFKDLGVDVYIGEASFLSANEVEVAGQLVVGEKFAISTGSQPIIPPIEGLDTIPYLTNETIFEQTERPERLLVIGGGAIGLELSQAYAHLGTEVTVIEGAKSLMPKEDRSMVEVLQRQIEQELTLHLDTTVTSVRKAAKGIEVTVKTGEESRVIETDAVLVAVGRKPRIDALRLDRAGVHVEKGYVQVDGSLRTNQRHIFAVGDTIQSLPFTHVAGLEGKTVVTNALFGLRTKPDYRAVPWVTFTTPELFHLGLTEEEARQKYSDIKVYETGLDEVDRFVINGRTEGHVKLIADKRGKLIGAHAIGEQAGEWMQEVVYAMARKDKVGQLSRVVHPYPIRGAAVQRAADLYWRERLFDGPLPKWLKRYFDWKQGE

SEQ ID NO: 25179 - protein, 371 aa, Exiguobacterium sp. 255-15
MANEKMFDTFTLPNGVTLKNRIMMAPMTNYAAEENGEVSEAELAYYAARSGGVGAVITACANVTADGQGFPNEFGAERDELVPSLKRLATTIQDQGAKAILQIFHAGRMAPPELVGGQTVSASAVAPEREGAMTPRALEAAEVEAIIEAFGQATRRAMEAGFDGVEIHGANTYLIQQFVSPHSNRREDKWGGSLEKRLAFPLAVVDAVEAVAKQDPSFIVGYRFSPEEVENPGITLDDTMQLVDALAKKDLDYLHVSVMDFFAGSIRDQNETRSPISLVQERVGQQVPVIGVGSLHTPEEVERSLEVVPLVALGRELIMEPKWVEKVEAGETESIRTELDPSAQAELVVPDALWQGITSRPGWFPIKQTTK

SEQ ID NO: 25180 - protein, 457 aa, Exiguobacterium sp. 255-15
MYPWIYTRAKEQPDDLALITDNERLTWSALYTKAHELASSWAPLLSRGDRIALYGPSSSSYIIAVHAAQLLELTIVPINIRLSQAEVHMQLQQADIRFVISDRPIDAPVKRLPFHVVKPAPDVLVRHMPKHYIQSMLFTSGTTGRPKAVEQTMLNHFSSAMNAARHTGSYPDDRFLVVTPLFHMSGLAVVYRSVIYGVPLILEPHFSPNKTITWIQTEHITHISLVSVMLDRLLEAGLRRFDLRVVLTGGGPVPLPILTRALDRGIPVMQTYGMTETASQVATLLPEEAIRKIGSAGKAIAPTEIRINRYQEIEVKGPTVMNGYFANPEATAAAFTADGYLKTGDLGRIDADGYLYVLDRRSDLIISGGENIYPAEVEAALLSISGITEAGVVGRFDPVWGQVPVAFIVSTLSETDVRQEMERLLAKYKCPVSYFYRDTLPRNANGKLIRRQLKESL

SEQ ID NO: 25181 - protein, 233 aa, Exiguobacterium sp. 255-15
MQQGKIYDSFTEATADIFDGATLVVGGFGLCGIPEKSIAALQEQGVKELTVVSNNCGVDDFGLGILLQSRQIKKMVSSYVGENKTFEQQYLSGEIEVDLVPQGTLAERIRAGGAGIPGFYTPTGVGTPIAEGKEQKQFDGKTYLLEEGIVGDFALVKAWKADKLGNLVFRKTSRNFNPLVATAGKVTIAEVEELVEVGELDPNEIHTPAVYVQRIIVGTDYEKRIERRTVREA

SEQ ID NO: 25182 - protein, 489 aa, Exiguobacterium sp. 255-15
MKRRDQFMNVPRQAGKERDSSERIGDFNEYKERFSETEASEQASRCMDCGTPFCHVGETYSQVKIGCPVYNLIPEWNVLVEQGNFQEALERLQETNNFPEFTGRVCPAPCEGSCTLSINEPAVTIKQIERTIIDIGFENGWVQPRIPSVRSQHRIAIVGSGPAGLAAADQLNQAGHHVTVFEREDQVGGLLTYGIPAMKLSKDIVARRVRLLETEGITFKTGVTIGLDVSLDQLEADYDAVILCVGATEPRKIPDAPGQGVGYAMDYLTSVTRQLLTGQSLIDLHDTRGKDVLVIGGGDTGADCVATALRQGCRSVVQFGKHQMPGSTRTADNMWPDTPNLFTLDYGYEEAHVQFGRDPREYLIAIERYTTDEAGRLTGVWTIYNDKIRHADGRVEFQKLPGTEKYYPVDTMLIAIGFSGVEQDVLRHLPVASQNGKIKTMAYATDRPGVFAAGDARRGQSLIVWAIREGREVAEKVEQHLLTVHKQTG

SEQ ID NO: 25183 - protein, 506 aa, Exiguobacterium sp. 255-15
MIYEIPNTQGSKVQYKDRYENFINGKWTAPVGGEYFDNVTPITGKVLCQVARSGKEDVELALDAAHAAKDAWGKTSVAERSNILNKIANRMEENLEMLAYAETLENGKAVRETLNADLPLAIDHFRYFAGVIRAQEGSIGELDNDTVAYHFHEPLGVVGQIIPWNFPILMAVWKLAPALAAGNCVVLKPAEQTPASILLMTELIEDLLPPGVLNIVNGFGLEAGKPLASSKRIAKIAFTGETTTGRLIMQYASQNIIPVTLELGGKSPNIFFADIMDADDAFFDKAIEGLLMFALNQGEVCTCPSRALIEESIYEPFMERVLERVKAIKLGNPLDADVMMGAQASSEQMEKILSYLEIGKSEGAECLIGGERNHLDGDLADGYYIQPTIFKGNNKMRIFQEEIFGPVLSVTTFKTEEEALQIANDTLYGLGAGVWTRDMNRAYRFGRAIEAGRVWTNCYHQYPAHAAFGGYKMSGIGRENHKMMLNHYQRTKNLLVSYSPDKLGFF

SEQ ID NO: 25184 - protein, 314 aa, Exiguobacterium sp. 255-15
MRTRTKIGLGVIGSGMLAASYYFYEMAIATNPKPFLSNNRDLSDEMVRLMQPGQTWIKEQPLELIEVKAHDGLMLRGHYLPPLVPSDRIVILVHGYGGVGTDLAGFAYLYHQAGFHVMMPDNRGHGKSDGNYIGFGWHDREDCLRWTEYLVARLGRESAIFLHGVSMGGATVLMTSGELLPPQIKGIISDCAYTSVNAVLAYQMKRMYRLPHFPFLTMTSILTKLKAGYFFSEASAIKQVQRATVPILFIHGEADTFVPTSMVYELYQACPTEKELVVIPNAAHAMAYFEDPDTYDTVVERFVRRILDEPTEKV

SEQ ID NO: 25185 - protein, 431 aa, Exiguobacterium sp. 255-15
MKLEEMLVSVDTFYVLFATLLVFTMQIGFLLLETGMLRAKNAGHVAVKQLISFSVAALAFWAIGFGLTFGDGPGLIGTEGFFLHGGFSSLDWSNVTIDVKFLFQLSFVAVSLAIAWGGFAERAKLSVYLLFGTFFVAVIYPIIARSVWAGGFLGSLGMQDFAGSTVVHLQGGIAALVAALILKKRIGAEKTPLLGHNVIYSVVGAFILWLCWFGFNAGSTLTIADGFFSYVALTTLLATAAGALGALAISFWHRRVADIPSIINGVLAALVAITAACAFVEPWGAVVIGFLAGVITYATSILLARRVDDPLCAFSVHGVAGIWGTLATGFFASPRLVEITGIGQAGLFYGGGFTQLGVQALGVVFAVVVVSVLSYVFLKLLDVTIGLRITREDELRGLDVAEHGQASYDLPAPVSKESHPTYEEESTEKVN

SEQ ID NO: 25186 - protein, 486 aa, Exiguobacterium sp. 255-15
MKTLPNDFLWGGALAAHQFEGGWNAGGKGPSVVDVMTAGEHGVARRITETIEEGTFYPNHEAIDFYHRYKEDIALFAEMGLKCLRTSIGWSRIFPNGDETEPNEAGLQFYDDVFDELLKHGIEPIITLSHFEMPLHLAREYGGFRNRKVAEFFERFAEVCFTRYKDKVTYWMTFNEINNKMDVENPLFLWTNSGVKVEPGENAMEVMYQTGHHELIASALVVAKGKAINPDFQIGAMISHVPIYPYSSHPEDVMLAEKSMRQRYFFPDVQARGYYPNYALKEFEREGYQIPILDGDDEILKNGTVDYIGFSYYMSTTVKHDATVNNTGNIVNGGLANGVENPYIQSSDWGWAIDPIGLRYVLNRLYDRYQLPLFIVENGFGAVDTIEDGKIHDAARIDYLKTHIEALTEAVTEDGVELMGYTPWGIIDIVSFTTGEMKKRYGMIYVDRDNEGNGSMERMKKDSFDWYKQVIATNGQDLAYDKAAQR

SEQ ID NO: 25187 - protein, 368 aa, Exiguobacterium sp. 255-15
MGQDYQQWVDRLAQKKTGERQDGVEVVIKPVPDRTESGVLDPRVLEVMMQQQQDSSPVGPFSLEAARAGMGWINTDLTTTDITTEDIMIPSAEQPIPARIYRPRSTEPLPAVVYFHGGGFFGGTLEPVEHPCRLLAERANVVVISIDYRLAPEHPFPAGLNDCFTAVKWVYEQGEELGINREQLAVAGDSAGGNLATVCALLDREQQTEMIQYQVLLYPVVNLAALPTDDFNWRLDAYEMNENRELLEGIVTALEDSDGLLNRLYLQGTTDVQDPHVSPLFSDKLTGLPDALIITAEYDYLRLEGEAYGRKLARSGVKTKRIQYNGMDHAFIEKLGQYPQAEDCITEIANGLQNRFAVMKSDTNTIGG

SEQ ID NO: 25188 - protein, 466 aa, Exiguobacterium sp. 255-15
MKEGTFRRKMESRHIVMLSLGGVIGTGLFLSTGYTLEQAGRVGTILSYLVGALAIYLVMLCLGELAVHMPETGAFHSYATKYIGSGTGYTVAWLYWLTWTVALGSEFTAAGLLMQRWFTDVPVWLFSALFVVMILGINVLTVRLFAEVEFWFSAVKVLTILVFIVLGTAAIVGFLPLADGSQAPLLAPLTEGGLFPNGAFAILMTMLAVNFAYSGTELIGIAAGEAVDPKRTVPLAIRTTVFRLVLFFVGTIIVLAILLPNDSKGVLESPFVAVFERIGLPFAADIMNFVILTAILSAANSGLYAASRMLWSLSDQRMITPYFSKLNASGVPTRAVLFSMLGGLLALFSSVYAPGSVYIALVSISGLAVVVVWMSISASQFMFRKRYLQEGHDLNDLVYRTPWYLFVPILSFLMCLASLIGIAFDPTQRVALYFGVPFIAVCYIVHHLTKTSWKRSVEDVKEQQSS

SEQ ID NO: 25189 - protein, 479 aa, Exiguobacterium sp. 255-15
MNGKFLINGQWLDQGRERTDVKNPATGEVVGSVPNGTKSDVNDAVEAAHNAFPDWSKRTVYERAALLEKLYAKMLEKKDELARLMTLEMGKPLAESEGEVEYAANFVKWFAEEGKRAYGRIIPSHDATKRLHVIKQPVGVVAAITPWNFPAAMITRKLAPALVAGCTFVLKPPTATPLTALRLLELCQEVGIPDGVVNAVTGSGKDLGESLATHPHVAKITFTGSTEVGRTLMAQGAETIKAMSLELGGHAPILVFDDCDLDLAVRETIKSKFRNGGQTCVCGNRIYVSDSIYDEFVEKLGQETAKLKTGNGLDQETKIGPMINKAGYDKVKKHVDDATSAGARIVTGGSGQTDDDNDVYYYEATVLADVTPQMLIMNEETFGPVAPVQRVSSDEEAVHYANQTPFGLASYVFTNNYARAFKAIEHLDYGIVGWNDGVPSAAQAPFGGMKQSGVGREGGSEGLEAYLETKYVSIGGLDQ

SEQ ID NO: 25190 - protein, 332 aa, Exiguobacterium sp. 255-15
MKAMTISKYGQVPLEQTEQPRPDVRPHDVLVEIHAASINPVDFKIRDGDVKLLIPYQFPLILGNDFAGIIVEVGHAVKQFQVGDAVYGRAEKNRIGTFAEYIAIDEQMLALKPASLSFEEAASIPLVGLTSYQALHDVLQATPGQKILIQAGAGGVGTFAIQLAKAMGLYVATTASSAGHDLVASLGADEIIDYRTEAFDEVLHDYDGVYDTIGGETLRRSFKIVRPGGHIVSISGLPNGRFGKSYRSGFLKTNLFRLLTLRETWLERKHRVTYTFLFMRPSGRQLEHITEWIETGQIKPVIDRIYPFEEAQAALEYSESGRAKGKVVLQMK

SEQ ID NO: 25191 - protein, 460 aa, Exiguobacterium sp. 255-15
MKEHPTELRRDLKTRQLTMIAMGCAIGTGLFLGSGLAISLAGPSVLVSYAIGAFIVLLLMGCLAEMTVAHPTSGSFGTIAEKYIGPYAGFLVRYSYWVANVLAIGVEVSAIAIYMKYWFPDVPGYIWIFVFAAALIYINATTVNTFATFEYWFSVIKISAILMFMILGAYLVFGSSSPEIGPQNFTNDGGFMPFGFSGLWIAVFISLFSFLGTELIAVTAGEAKDPDVAVPKALKATVFRLSTFYVITIALMLMIVPWQQAGGVDESPFVKVMEMLSIPGAAGIMNFIVLTAALSAMNSQLYASTRMMYSLSKATYAPRMFSRLNAKGVPLFALAVSTLGIFLAAVISSQSSVSYPFMMGISMFGAIFTWFMIFISHLYFRKAWERDGGRKLPVRMMGYPYLTALGALLLFALVITTWFTDFQIVLKFGIPWLIFLTIAYVFWKRNHPPQADQTNRSQSL

SEQ ID NO: 25192 - protein, 312 aa, Arabidopsis halleri subsp. halleri
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMEHLGADDYVVSSDPAEMQRLADSLDYIIDTVPVFHPLEPYLACLKLDGKLILMGVINTPLQFLTPLVILGRKVISGSFIGSIKETEEVLAFCKEKGLTSTIETVKIDELNTAFERLSK

SEQ ID NO: 25193 - protein, 312 aa, Arabidopsis halleri subsp. halleri
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMQHLGADDYVVSSDPAEMQRLADSLDYIIDTVPVFHPLEPYLACLKLDGKLILMGVINTPLQFLTPLVILGRKVISGSFIGSIKETEEVLAFCKEKGLTSTIETVKIDELNTAFERLSK

SEQ ID NO: 25194 - protein, 318 aa, Arabidopsis halleri subsp. halleri
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMEHLGADDYVVSSDPAEMQRLADSLDYIIDTVPVFHPLEPYLACLKLDGKLILMGVINTPLQFLTPLVILGRKVISGSFIGSIKETEEVLAFCKEKGLTSTIETVKIDELNTAFERLSKNDVRYR

SEQ ID NO: 25195 - protein, 318 aa, Arabidopsis lyrata subsp. petraea
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMEHLGADDYVVSSDPAEMQRLADSLDYIIDTVPVFHPLEPYLACLKLDGKLILMGVINTPLQFLTPVVILGRKVISGSFIGSIKETEEVLAFCKEKGLTSTIETVKIDELNTAFERLSKNDVRYR

SEQ ID NO: 25196 - protein, 355 aa, Arabidopsis halleri subsp. halleri
ISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLGFYSEEAKLVSEAADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 25197 - protein, 470 aa, Prochlorothrix hollandica
MAVQTKGYQAGVKDYRLTYYTPEYTPKDTDLLACFRMTPQPGVPPEEAGAAVAAESSTGTWTTVWTDLLTDLDRYKGRCYEVEPVPGEDNQYFCFVAYPLDLFEEGSVTNILTSIVGNVFGFKALRALRLEDIRFPIALVKTFQGPPHGIQVERDRLNKYGRPLLGCTIKPKLGLSAKNYGRAVYECLRGGLDFTKDDENINSQPFMRWRDRFLFVQEAIEKAQAETGEVKGHYLNVTAATCEEMLKRAEFAKEIGTPIIMHDFLTGGFTANTTLAHYCRDNGLLLHIHRAMHAVIDRQRIHGIHFRVLAKCLRLSGGDHLHSGTVVGKLEGEKDITLGFVDLMREDHIEEDRSRGVFFTQDWASMPGVMPVASGGIHVWHMPALVEIFGDDSCLQFGGGTLGHPWGNAPGATANRVALEACIQARNEGRDLMREGGDVIREACKWSPELAVACELWKEIKFEFEAIDTL

SEQ ID NO: 25198 - protein, 395 aa, Streptomyces tenebrarius
MTRTNETIATITDWSRSAEHLRRSHEVTTNPRPDEDGQYPCVLTRGSGARVHDMDGNAYLDLTCSFGTVLIGHAEREVTDAIRACLDEGNLFYTGPSPRRLALAERLLDWFPWADQALFYRTGSCAVSSVARLSQHVTGRTAVLTSGYHGWHDWHLEAVPEAKLFPSYATEFHDDLDVYRAYLDRHADEIAAVVVTPEPTRHPLEHYRTLRDLAAEAGCLFVLDEVKTGMRAGKGGLSARAGLEPDAVTVSKGLANGHSISAVVGSRRITEGLAEAHVWSTYQNEQVGYAAALSTVDFLLREDVAGVVERTGRTVERAFRSAFAERGLPVEVHGWGPMFDLDFSAAEEDLPERLQLALLRHGVFCDVGDDFNLMYRMADHLDELLERVTAAIASV

SEQ ID NO: 25199 - protein, 340 aa, Micromonospora echinospora
MGGRMRALQFHGGHKAQIIDTPRPEAPPGWAVVKVHYCCLCGSDLWLYRGKWHGNRYPIVPGHEWAGVVDSAPEGYESWVGRPVTGDLIVGCQGCGPCRDGLPVMCENLIEIGFTVDGGCAGYVAVPITNLYLLPEGMDLAAASQTEPLAVALHAVDRINLRPAERVAVLGAGGIGQLILQSARATGATVTLATDLVAERRKIAEESGAAAAVHPSELPELTSYADKVDVVFEASGDPESVVRALDLVRPGGRVCLVGYQVGAEHALETARLPLSYASLVGVMGPGGKYREAVDLLANGAIDTQPILTDIVTLDDYAPAIDRAINRTDGTVRVVFDLRNE

SEQ ID NO: 25200 - protein, 414 aa, Micromonospora echinospora
MIIANADGCTPYEVARGVTIVRGEGAYVYDAEGRGLIDLSNSFGSVMLGHQDPVVTEAVLKTVRSGVPAAASLDLQNHLAEQIAGDLPGDQRVAFFKTGTAATRAAASAARQVTGKRLIASCGYHGYDLMWEFTPPGQPNSEDVLHCYHLPELIDQVLDKHAHELAAVIIAPDYIHVSPEYIADLFERCERVGVVTIADEVKHGYRLRQGASVTEASVVADMYTYAKGISNGWPLSCVAGDERFLKPLAEFVSTLTFEAPSFAAASATLDRLAELDVQAQLAIDGARFVSEAAKMISTRDLPIEMAGTGAAFQFVCAEEVEEVLLPHALAEGLILEPSDQQYPSACFRGEVVDDALERLDRALTTMAAARPDLVGREVTQLDRVNAAFCQMDGLPGRPDGWSLDQCVEYVTAQL

SEQ ID NO: 25201 - protein, 450 aa, Micromonospora echinospora
MDSANLTNRGLVERARRVTAAENYDIGTRFSAMIQSGEGAWLTDVEGNRYVDLTASSGTIILGHRNQAVTEAITRQIRDFGTAFASTLSVPRVELAERLCERYECAEKVVFHKTGSEGTAMAARLARAATGRELILSCGYHGWHEWQLAGETFGYQQTTGVVGFGYNEKALAKMLEAFGNEVAGVLISPELLYFDVEFYQRMYALCARYDVPFMMDEVYTGFRAGPKGVHGLGVPADVVVVSKGLANGHSLAAVMGRRDIIDAYDVSGIQGTYTREVPPMAAAMAVLDVLDTPGVYEHAEAMGRRLADGMREILTGEGIPNWVGGPALMFDTVLPNDDLGWEIYKTAHDFGVYFEDSGTQLVTTAFDEAAVDHALTAFRKATRQVIADRPDIAPTSGGELTEERKLDFAEEAFGGLLRDDERTNALIDETIEKVVNRDRSIKPVLIPAQN

SEQ ID NO: 25202 - protein, 444 aa, Micromonospora echinospora
MNYRELIERARRTTAAEEYDISGRYPSVIAHAEGAWMTDLSGNRYVDLTGADAAVILGYRHPAVNEAITRQIRDYGTTFASTLSVPRVELADGCERYECAEKVVFHKTGTEGTAMAVRLARAATGRELVLSSGYHGWHEWQMAGEEFGYQQSTGVVGFGYNEKALAKMLEAFGEQVAGVIVSPEVLYFDLDHYRRMSALCARYDVPFMLDEVYTGFRAGPKGVHGLGVPADVVVLGKGLANGHSLAAVMGRRDIIDAYDVSGIQGTYTREVPPMAAALAVFEVLDTPGVYEHAEAMGRRLADGMREILTGEGIPNWVGGPALMFDVVLPNDDLGWEIYKTAHDFGVYFEDSGTQLVTAAFDEAAVDHALTAFRKATRQVVADRPDIAPTSGGELTEERKLDFAEEAFGGLLRDDERTNALIDETIEKVVNRDRSIKPVLFPAQN

SEQ ID NO: 25203 - protein, 285 aa, Rubrobacter xylanophilus DSM 9941
MELSKISAETPGVRIYGKAEWYNPGGSVKDRPALWMIRDGERSGALTPEKTILDATSGNTGIAYAWIGAALGYRVKLCMPSNASEERKKILRAYGVDIVLTDPGEGSDGAIREARRLYAEDPERYFYPDQYSNPANPRAHYESTGPEIWEQTGGEITHFVAGLGTSGTFVGTARRLKEFNPEIRAISFEPDSPFHGIEGMKHMESAIVPAIYDPGVADENRRASTEEAYAMVKRVAREEGILIGISAGAAVATALRVAREIESGTIVTILCDGADKYLSESFWEE

SEQ ID NO: 25204 - protein, 444 aa, Rubrobacter xylanophilus DSM 9941
MIEQRRPAVLPPELSDGSVTSVRVLYADLHGVARGKDVPIGEFERAVEHGLAFCSAIMGTDLRHTPVVGGEEGYPDLVAYPDLSTMTLVPWEPGVACCLADLRPVGDHAPPADPRGAVRRAVAAFEELGLSPVVGPELEFFLCERDPAGGVRRYVDNLSMVYTVGPQADPRGIVREIAEMLSGMGLGAFAANHEFMNSQYEINLHHADALAAADRAFRLKCAVKDVAAMRGLVATFMGKPFNDQGGSGFHIHFSLERGGENAFAGGEEGGVTGLLRHFVAGVLEHASGLMAFLNPTINAYRRLVPDSLAPTHANWGWDNRTAFVRIPPERGGATRVEVRVGDGSANPYLATAATLFAGLHGVRERLPLGPPVGGDAYALAGEKAGPPLPATLEEALDALEADEVLRGAMGEQIVGTFLALKRYEAERHRTWVSDWEISEYLHHL

SEQ ID NO: 25205 - protein, 488 aa, Rubrobacter xylanophilus DSM 9941
MTTAAERVRVAGVEVSPDHFIGGERVASPRRFEDISPITNEPIAEVSRAGEAEVDAAVRAARDAFPGWAALGPAGRAPYLHRLADLIDANVERLAAVECMDMAMLLRSLRARVIRRGARNYRAYADLAASYEERDWRSQGTWNRVQRMPAGPAAIITPWNAPFMLSTWKTAPALAAGCTVVLKPAEWSPLSCSLLADLVAEAGFPPGVFNVVQGIGEEAGAALVAHPLLRRVSFTGSPETGRSIGVAAAKNLVPFTAELGGKGPLIVFEDADLDAAARRAAGQYDDAGQVCLAGTRLLVQESVAEEFLELFHRYADEHVLGDPRSEHTTVSPLIHPDHLRRVEGFVERARREGHRVLRGGRRSPAGPLFYQPTLIEPLSNDAEIVQREVFGPVLTLQTFADEEEAVSLANSTEYGLSGIVYTSSMGRADRVGRAVRAGVVWVNTFLVRDLTAPFGGMGISGIGREGGDYALDFYSDLKTLQILEGSTR

SEQ ID NO: 25206 - protein, 436 aa, Rubrobacter xylanophilus DSM 9941
MAEAERQSAAERGILNLEWYRSLRGNARHAFWAAFLGWALDAFDFMVLSFSLSAITATFALSSGQAGLIGTVTLVVSALGGVLAGVLADRIGRVKTLMITVAVFSVFTFLSGLAQSYWQLLLFRSLQGLGFGGEWAAGAILLAEVSDPVQRGRVLGVIQSAWAIGWGLAAVAFTAVFSLADPELAWRILFWLGILPALLILYIRARVEEPRIWVETSRARLRRTREAIERGATANPLVQIFRRDLIGTTAAASLLSIGAQGGYYAIFFWLPSFLESERNLEVVGTGSYLAVVIAGSFIGYVTAGYVHDWLGRRPTFALFSVLSAVLIFLYTRMPEGANTLLLFLGFPLGFFASGIFSGFGSFLAELYPSRARGAGQGFCYNFGRAMGAFFPTIIGVLSASIGLAGAIGFGAAAYGLCLIALLLLPETRGKELVALD

SEQ ID NO: 25207 - protein, 392 aa, Rubrobacter xylanophilus DSM 9941
MDKRSVRDLELRGKKVLVRVDFNVPVKGGEVTDDTRIRRALPTIRYLLQRGARVALISHLGRPKGEPDPRYRMDPVARRLEELLGEPVRKLDTATGPEVGRALEELERGVILLENSRFYPGETKNDPAFAAELAGPFDLYVNDAFGAAHRAHATTVGVAERLPAAAGFLLEQELDYLDGVLRSPERPFVAILGGAKVSDKLGVIESLLGVADRLLVGGAMCFTFLKARGLGVGASLVEDDYLGEARRLMEGAADRLVLPVDVVVAERMEEGARTRTVPVEEIPEGWMGLDIGPRTVELFRRHILQARTIFWNGPMGVFEIDAFARGTEGVARAVAESGATSVVGGGDSVAAVRKLGLEDRMSHISTGGGASLEYVEGRELPGVAVLPEREEV

SEQ ID NO: 25208 - protein, 314 aa, Rubrobacter xylanophilus DSM 9941
MTRIVSLGEVVADIYRQEATSPVELPFVARPGGAPANVAVAACRLGAEAAFVGSVGDDLFGSFILRALRAEGVDTSQVVLQRPPTRTSLAFVEISADGDREFTFYRSSPAADELLGERDVRPEALSGAAFANFGSIPLIREPVRSATLRFARLAREAGVPVAFDVNFREHLWESVEAAREVVAPLLGLAAVVKLSDDELRPLLGVEEPEEAARLLLGRGGLPGLRQPGAPRGLLRRGGLLRTGARLPGGGGGRHGRGGRLSRRGAGAPGGARVGGGGGARGRPAGGRRRRPRLHRLRGDERAAHPGGAGAPCIR

SEQ ID NO: 25209 - protein, 477 aa, Rubrobacter xylanophilus DSM 9941
MSKAGPAGRQGPVPCPLGEAARERPEGAALEAPGLRLTYRELDRRVSLAAGRLREAGLGGRRVGLYLEGDAGYVILLLALLRAGAVACPVSTRLPPQGAAPLLRRAGCAAVVCAGPLPGLRCLRPEEILSGRPAEAPTPGPIPLDRPATVVFTSGSTGIPKAALHTFGNHYYSALGSASNIPLAPGDRWLLSLPLYHVGGLSIVFRCVLAGAAMVLPEPGAPLGSELRRRGITHASLVSTQLLRLLREGGEGPPEGLKAILLGASAMPAGLLEEAVSRGLPVHTSYGLTEMASQVAATRPGAPLEELLTSGRVLPHRELRLAEDGEILVRGRTLFAGYVEGDAVERPLDREGWFHTRDLGELDGEGRLLVRGRRDNLFVSGGENVQPEEIEEALRREAGAEEAVVVPVPDEEWGARPVAFLKGGAPDPARSLERVLPRFKIPVAFYPWPQDAPGGMKVDRAFFRERALGLRRRPRLC

SEQ ID NO: 25210 - protein, 306 aa, Rubrobacter xylanophilus DSM 9941
MPERPPVAILGVPMDLGQDRRGVDMGPSAIRYARLQPALEELGYRVSDLGNVEVPIPEAASGGDGKAWRLRAVREVCSAVSRRAREAVARGALPVFLGGDHSISIGTVSGVCAAGRTGVLWVDAHADFNTPESSPSGNIHGMPLAALTGRGHPDLVGVGGEGASVRPEDAVLVGLRSVDREERDLLREAGVRVYTMKDIDAYGVAAVVRRALEHLSGLPRLHLSLDLDVVDPEVAPGVGTPVRGGLTYREAHLLMELVNEAGGVSSLDVVEVNPILDSRNRTAELAVELVASLMGRQILELPRRPL

SEQ ID NO: 25211 - protein, 382 aa, Rubrobacter xylanophilus DSM 9941
MGKGKTARRAYGLDEIAIVPSRRTRDPEDVDISWNLGDLHLDLPCLASALDAAVDPTTAGIIGELGGLAVLNLEGIQTRYEDPEPVFEEIASLPQEKATRVMQEIYSEPVKEELIFRRVQEIKDKGVIAAASLTPQRVERYHRAAIEAGLDVLVIQGTVVSAEHVSRQAKPLNLMEFIPSLNVPVVVGGCASYSTALHLMRTGAVGVLVGVGPGRICTTRGVLGVGVPQATAIADAAAARTRHYMETGQYVNVIADGGMRTGGDIAKAIACGADAVMLGSAFARAEEAPGKGYSWGMATFHPTLPRGTRIKTGTVGTIEEILLGPAHENDGTLNLMGALRTSMATTGYQNIKEFQKAEVMVAPALATEGKLEQFSQGVGMGR

SEQ ID NO: 25212 - protein, 249 aa, Rubrobacter xylanophilus DSM 9941
MRDGDGPAVKTLSLEKVYGSGPTAVRALRGVSLSFPDGEFAAIMGPSGSGKSTLLHLLGGLDRPTSGRVVVGGNDLSGLSDRRLTLLRRERIGFVFQFFNLIPTLTAEENILLPALIAGERPSRYAGRLEELLGLVGLEGRRRHRPDELSGGEQQRVAIARALLRSPDIVLADEPTGNLDSGTGTGVLELLRESAGRYGQTIIMVTHDPRAASFADRVVFLSDGRVVDEAGGLGAEAILERIKRLEAAG

SEQ ID NO: 25213 - protein, 481 aa, Rubrobacter xylanophilus DSM 9941
MAQLLVGGERVSARGGGEMPVVNPATEEVVDTVPKGTAEDVEAAVAAAKGALAEWSGKDPDERAAIMRAGIGAVKERGREIAELLVREQGKPLSEAMGELHHFIHGMDFYADLASKVRGAYAPLPSSLGKSYGMVIKRPVGVCAAIVPFNFPLTLMGTKVGPALAGGNTVVVKPAETTPLATLRVAELFAEAGLPAGVFNVVTGEGPEVGEALVAHPDVRRVAFTGSTEVGRRIMELAGPQFKRVSVELGGSDPVIVCPDADVDAAVKGVNIGRFFNAGQACLAAKRVYVFDEVYDEFMEGLIKRVSRYELGDGLTKAEKPKIRMGPMNSARYRDQVASQLEEALGRGARVVYQGEWGGEKGYFFPPAVIEGAPHDSRVVREETFGPLLPVFRVGDLDEALRLANDSRYGLGSSIWTRNIRWIHRAAQEIEAGMTWVNQLHYGYDELPFGGVKDSGVGREHGPEALEYYLESKSVVIGGLD

SEQ ID NO: 25214 - protein, 401 aa, Rubrobacter xylanophilus DSM 9941
MSARAGGATAERAIDPRDFLELDALLSEEERAVRDRVRSFVEERVRPNIKGWYEEARFPRELVPEMGALGLLGMHLEGYGCAGRSAVEYGLACMELEAGDSGIRTFVSVQGSLAMSAIHRFGSEEQKQEWLPRMARGEAVGCFGLTEPTAGSDPASMKTFARRDGDGWVIEGAKRWIGMASIAEVAVIWARTDEEGNPVRGFLVPTAAQGFSATNIEPKLSMRASIQCDIELRGVRVPAGAMLPGAAGLRAPFSCLNEARYGIIWGSMGAARDCYECALEYSLRREQFGRPVASFQLTQKKLADMVVEIQKGMLLALHLGRMKDAGALKHQQISLGKLNNVREAIKIAREARAILGGNGVTLDYPPLRHANNLESVRTYEGTDEVHTLILGQAITGIEAFR

SEQ ID NO: 25215 - protein, 189 aa, Rubrobacter xylanophilus DSM 9941
MGIGESIGAWPLLRQLRDGDRLGLGKASRSGRSEALRPRTERARKVARSVCPYCAVGCGQRVYVEGGEVTQIEGDPDSPISRGRLCPKGAASRQLVQSPTREYRVKYRRPYSDRWEELDLDTAMDMIADRVIKTRNETWEEEDGEGRKLRRTLGFAHLGGATLDNEENYLIKKLFTALGAIQIENQARI

SEQ ID NO: 25216 - protein, 342 aa, Rubrobacter xylanophilus DSM 9941
MSAAMVRLENVSRRYGPVRAVEGLSLEVRRGEILALLGPSGCGKTTTLRLLAGFEPPDGGRIEISGRPVAAPGVFVPPERRRTGVVFQDYALFPHLTVRQNVAYGLGREKREARLEAVLRLARLEGLEERMPHELSGGQQQRVALARALAPEPAVVLLDEPFSNLDAALRARVRAEMRRILLAAGTTALFVTHDQEEALSLADRVAVMFEGRVVQSATPEELYERPADRRVAGFVGEANLLPGTAEGERALCALGEVPLREPARGGVELMLRPEQLALEPSPEGEAEVAEREFYGHDQLVRLRLPGGEGLQARLPGSIRLRPGERVRVRALSPAVAFPRPAH

SEQ ID NO: 25217 - protein, 398 aa, Rubrobacter xylanophilus DSM 9941
MIADVSKGLGTDYYMVEEWMSEEDREIRDRVRDFCDREVIPVMGGYWNREEFPFELVPKLARLNIAGHVIPREYGCPEMSNLASGLVMMELSRGDGSLSTFFGVHSGLAMTSIALLGSEEQRQRWLPPMARMEKIGAFALTEPGHGSDVVMLETSAERDGDGWVLNGRKRWIGNGTFADVVVVWARDEEDGEVKGFLVEKGTEGFTAERIEGKIGNRSSWQADITLENVRVPAENKLENANSFADTSTVLTNTRYGVAWQALGHALACYEAAVQYAKEREIFGIPQASFQLIQYRLAGMLADLTQMQLVCFRLSQLLDKGEMTHGRASLAKLVTARQGKRICAEARDILGGNGVLLEYLVGKHLADMEIIYTYEGTDTVQSLIVGRSITGEQAFFPTA

SEQ ID NO: 25218 - protein, 486 aa, Rubrobacter xylanophilus DSM 9941
MQSRVIESQIESRNYIGGEWVPADSGEVEEVRNPARPSEVLGTAPRSDRGEMERAVAAAQEALPGWRSALPAARGQILLRAADIIDSRSEELARLMALEAGKPLGESRAEVSRAAAIFRYYGSEGWRLYGVEAPSTRPGVRITSTREPLGVVGLITPWNFPLAIPSWKMAPALICGNTVVIKPAANAVLNAAELVRILEEAGLPGGVVNLVMGPGGSSGDALVRDERVRAISFTGSTAVGLSIQERAAGKKVQLEMGGKNPYVVMEDADLEDAAAKVAYGAFGYAGQKCTASSRAVVVEEVYEAFLEQVVEATRALKLGEPLDEEAVIGPVINESQYESILGAIEQAREDGRVVLDGGATGPREEGYYISPVIVADVDNGSKTAREEIFGPVLAVIKARDFDHAVEIANDTRYGLTAGIATRSLRYAEEFIERSQTGLVNVNLPTAGVEFQVPFGGSKQSGVGGREQGMAAIEFYTGWKTASVLAL

SEQ ID NO: 25219 - protein, 461 aa, Rubrobacter xylanophilus DSM 9941
MVDPATGEEVDSVPVCGEAEVDAAVRGAAGAFPGWSGTPASRRGELLARAAEAVLGARDELAGLLTAEQGKPLREARLEIRRFVHTLEHYAGLAKNIRGGYVPDLDEGAYGLILRRPVGVVGAIVPWNFPTTLLANKLGPALVAGNVVVAKPAETTPLTTLRIAEIMHGAGLPAGVFNVVTGDGPTTGQALAGHPSVRKVAFTGSTPVGKKLAALAAGDLKRVTLELGGSDPMIVCDDADLDRAASAASVGRFFNCGQACLAVKRLYVFESVAEEFVEKLVGKAKRLRVGPGRAEGTIIGPLHTPEGRELLEGQVRDAVESGARVLAGGRRPEGEVFERGNFYEPTLLLEPSHESRVATEEVFGPALPIWRVGDLEEAIERANGSIYGLGSSVWTADLDRATEAAERIEAGYTWINSPQVIYDELPFGGWKQSGYGKEHGMEAIEYYTETKSVVVRRAYQG

SEQ ID NO: 25220 - protein, 377 aa, Rubrobacter xylanophilus DSM 9941
MSRRFNSATDEEIRNAEVADSYFHRTMRILRAKGLENTPVHAEVAYKTSNPDEWFVVAGLDEVANLLSGLEVEARAVPEGTICGPHEPVLTISGPYGAFAEHETAILGFLCQASGVATGAARCRLAAGDKPVISFGARRMHPAITPMIERSAYLGGCDRVAVDLAVQRMGIPATGTLPHALVLILGSTAEAAKAFDEVIEPEVPRTILIDTFDDEKFGALLAARAIPDSIYAVRLDTPGNRRGDFRDLMKEVRWELDRHGYEHVKIFASGGIDVDYILHLNDVCDAYGVGGAIADAPMIDYSLDIVEVNGEDRSKRGKRGGRKRLLLMPDGSHRVVPADAPTPEGARDLLQPLDPDAPVSAARERVLRQLASGRYTL

SEQ ID NO: 25221 - protein, 318 aa, Rubrobacter xylanophilus DSM 9941
MEKRAFGRTGMEITPVGFGSWAIGGGGWAAAWGPQDDEEAVGAIRRALELGMNWIDTAAVYGLGHSEELVARALRGVPEADRPYVFTKCSLVWDEDREVHNVLKKDSVKRECEDSLRRLQVDAIDLYQIHWPNPDEDIEEGWEALVELRDEGKVRHIGVSNFDVGQMERVGRIAPVETLQPPYNLIDRGVEEEVLPYCRRNGIGVIVYSPMKSGLLTGKMTPERVRSLPDDDWRRDHPDFNEPRLSKNLRLVEKLREVGERHGRSPGEVAIAWTLRHPAVTAAIVGGRRPEQVDGIIGAAGFRLPEEEIREIEAAVPA

SEQ ID NO: 25222 - protein, 386 aa, Rubrobacter xylanophilus DSM 9941
MRKADATPLRLNPVLERQGEYPLLRLDERRERLKEQGVRLFDFGAGDPREPTDPRIRRALLEAVPEVSQYPSASGTRALREAFCGWMERRHGVELDPDAEVLPASGSKEAIFHAHLPFLHHTHERRGVAYGTPGYPVYERGALFAGGEALPVRLVREDGFLLPLEAVDPQRTRILWLNYPHNPTGARAPRSYLEEAAAFCREHDILLFSDECYNEIYSGDPPPSVLEVSRERTLAFCSLSKRSGMTGYRSAMMAGDAELISALGKLRPSVGVASPSFVQAAAAAAWSDDEHVEERRRTFARKRGLFVEFFRRAGLDFLPTDATFYLWVAVPGGDDEAYALRLLEEGIVVAPGRSFGPGGEGYVRVALVPSLEECEEAVRRWEALAA

SEQ ID NO: 25223 - protein, 473 aa, Rubrobacter xylanophilus DSM 9941
MSELLRKKDIPTLQREAAGDTGLKRTLGVWSLTFIGLGGIIGVGVFVLTGVVAANQAGPAVALSFVVAGIASAAAALCYAEFAGMIPVSGSAYTYGYAVLGEFFAWVIGWDLLIEYTLVVAVVAIGISGYINELLSGLGVGVPEWAASAPGGGDGGVVNLFAVLLCLFIAGLQIRGIRESANFNNAMVVLKLAIIAVIIALGAFFVDPANLTPFFPYGIGGVFTGAAVVFFAVFGYDTLTTAAEEATDPQRDLPRAVILSLAIALVLYVLMSLVVTGMVPYRQLDTPAPVAVAFQEAGLPWVARVISVAAIAGIISVLFAFMLGAARVWFAMSRDGLLPRWFCRLHPAYRTPYRPTAILGVATALVAGFFPITAVAELVNIGVLSAFIIVCASVWVLRHTRPDLPRAFRTPLVPLVPILGMAFSAVLIASLPPATWLRFVAWMAVGLVIYFLYSRRRSLLARGELGIERDLVE

SEQ ID NO: 25224 - protein, 305 aa, Rubrobacter xylanophilus DSM 9941
MEIGIYGLGRMGANMVRRLLRSGEHRVVAGNRSPGPVDEAAKEGAEGAYSMQELVDKLEPPRVIWSMVPAGEPTEKTLMGFAELAQEGDILIDGGNSYFRDSVRRASALRERGLRFLDAGTSGGIWGLEVGYCLMVGGDRSAFEHVEPALKTLAPPDGYAYLGEAGAGHFAKMVHNGVEYAMLQAYAEGFEILKKSPYGYDLRALSSLWNHGSVVRSWLLELAERAFEKDAELQSIRGYVEDSGEGRWTVLEAIEEDVPANAIAGALFARFASRQEDSFAMKVIAALRREFGGHAVKEAGPGGGG

SEQ ID NO: 25225 - protein, 327 aa, Rubrobacter xylanophilus DSM 9941
MRRRRLGGGLEVSEIGLGCMGMSEFYGPADEREAVATIHRALELGIDFLDTADMYGPFTNERLVGRAIAGRRDEVVLATKFGNVRGEDGSFLGVRGDPEYVRRACDASLRRLGVDHIDLYYQHRVDPEVPIEETVGAMKELVEAGKVRHIGLSEAAPRTIRRAHAVHPVAALQTEYSLFSRDVEAEILPTVRELGIGFVAYSPLGRGFLTRRFLSPEDLPEGDFRRGHPRFTGENFYRNLELVDRLEEIAAEKGATTAQLAIAWVLHQGEDIVPIPGTKSRGRLEENAAAADLELTPQDLRRIEEAMPRGAVAGARYDERRMRTIDR

SEQ ID NO: 25226 - protein, 1121 aa, Rubrobacter xylanophilus DSM 9941
MTQTARRGAARREEAYREDPLWYKDAIIYQLHVKAFFDSDNDGIGDFRGLTQRLEYIKDLGVNAIWLMPFYPSPMRDDGYDISEYKNVHPEYGTRRDFRNFVRRAHALGLKVITELVINHTSDAHPWFQRARKAPRNSVWRNFYVWSDTDKKYADARIIFTDTETSNWTWDPVAQQYYWHRFFSHQPDLNHDNPRVFDAIMRVMRFWLDAGVDGLRLDAIPYLIEREGTDCENLPETHEILRRMRAELDARYQNRIFLAEANQWPEDVLPYFGKGDECHMAFHFPLMPRIYMAVAQEDRHPIVEIMQQTPEIPEVCQWAIFLRNHDELTLEMVTDRERDYMYQTYAADPRARINLGIRRRLAPLMENDRARIELLNSLLMSMPGTPIIYYGDEIGMGDNVFLGDRNAVRTPMQWTSDRNAGFSRADPHSLYLPPIMDPVYGYEALNVEAQSRSPGSLLNWMKRIIAVRKAHKAFGRGTLEFLHPGNRKVLAYLREYGDETILCVANLSRSAQPVELDLSRFSGRVPVEMIGGSSFPPIGSLPYFLTLPGHSFYWFNLTTEAEAPSWHQESPRFFEPPVVVLPAGRQTARDIRRLPLRLQHRQVAQLEQEALPAFLSVRRWFAAKGSEIERVSLLARAEFGPDRLLALLRVGAGGAEHTYFLPLAAAWEDEDGERVSGLMPHALAKIRRRYRVGVLFDALADEGFCREVVAAMAGGRELEMGEGRVRFYATGALEELLAGEPVGELAVRRASVEQSNTSVILGERLVLKAYRRLQPGVNPELEIGRYLTEVRRFPNTPPLAGAVEYEDPRSGTVSLALLQGFVPSQGDGWSYVLGYLDRYLERRLLSASWSPEEEGPAEPPGQEGQEADEGFFMELMRTLGVRTGELHAALAAPTDDPSFSPEPAPPAEVSRWVEAVLDDLRLTLSLLERRRSGLPEEVRPEVDRLLRMEARAFDRLEAISARGIRAVKTRHHGDYHLGQVLVAGNDFQIIDFEGEPARTLEERRRKHSPLRDVAGMLRSFDYAAQTALMNLGADRAVGEDPEPVVRRWERSVREAFLGGYAEGVRGAGVLPGEGEEAAALVELFALEKALYEIRYELDNRPDWIGIPVRGVLDLLTREESP

SEQ ID NO: 25227 - protein, 448 aa, Rubrobacter xylanophilus DSM 9941
MAMQAPRERLGYVALLDPGRERPDALGVLDLDPDSGTYAQIVGRVEMPNAADELHHFGWNACSAALCPYAPHPHVERRYLIVPGIRSSRIHIVDTKPDPREPRIVKVIEPEELHRRTGYSRPHTIHCGPDGVYVSALGSPEGDGPGGVFVMDHESFDPLGRWEVERGPQQLAYDFWWHLGYDTMVTSEWGTPNMIEGGLDPQILLNKGYGRRLHIWDLRRRRHLQALDVGEEHQMVLELRPAHDPARTYGFVGVVVSLEDLSASVWLWHRQNGSWGIRKVIEIPAEPAEPDQLPPLLKDFGAVPPLVTDINLSLDDRFLYVSCWGTGELRQYDVSDPFNPRHTGSVRLGGIVRKAAHPASGPLNGGPQMVEVSRDGRRVYFSNSLYASWDEQFYPVGIRGWIAKAEADPGGGLSLDPGFFTEVGDGLRPHQIRLEGGDSSSDSYCYPS

SEQ ID NO: 25228 - protein, 475 aa, Rubrobacter xylanophilus DSM 9941
MGDPKGFLKIGRKPVPKRPVEERVRDYRWVYEPMPEGELRRQASRCMDCGVPFCNTGCPLANLIPDWNDLVYRDHWREAIDRLHATNNFPEFTGILCPAPCEAACVLSINDRPVTIKEIERSIIERAFEEGWVVPKPPPPERRTGKRVAVVGSGPAGLAAAQQLNRAGHSVVVFEKDDRPGGLLRYGIPDFKMEKWVIDRRLRQLEEEGIEFRTGAYVGYDPTAEELRRGFDAVVLAVGALQGRDLPVPGRELRGIHLAMEYLVQQNRRVAGLPVEGEEITARGKHVIILGGGDTSADCLGNVHREGCASVRVLTHGPKPPESPDPLEWPDWPFVLHTYPAHEEGGERGWNVAVTGFSGEGGRVRRMHCVRTRRDPDGRTHHLPGTEFELEADLVLLAIGFTGPVRDRLLEELGVEFGPRGAIATREGFDTGIPGVFVAGDARRGADLIVTAIAEGRKAARQVDAYLMGRSLLPG

SEQ ID NO: 25229 - protein, 385 aa, Rubrobacter xylanophilus DSM 9941
MVPDYYLLDELLTGEERAVRERVRAFVDREVLPVIGDYWERGEPPFELLPKLAELKLAGGTIEGYGCPGLSAVAAGLVTMELSRGDGGLNIFFGGTSSLVMPAIYMLGSEEQRERWLPPMARLEKLGAFALTEPEHGSDAVALETRARRRGEGYVIDGRKRWVGNASFADVILVWARDDEGEVGAFVVERGAPGLSARVMAGKTAVRSSWQAEVELSGVEVPAENRLERARSFRDASRVLAAMRYGAAWAALGHAAACYEAALAHARERRQFGRPLVSFQLVQKKLAGMLAEITSMQLLCLRLSRLADQGKMTGAMASLAKMNNARKARGVCLEARDILGGNGLLLEHHVARHAADIEAVYTYEGTDDINALIVGRDITGVSAFA

SEQ ID NO: 25230 - protein, 297 aa, Rubrobacter xylanophilus DSM 9941
MAEKVGFIGLGIMGRPMAENLIRAGYSLTVHNRTHQKAEEFAQQTGARTAKSPKEVAGQSDIIITMLPDSPDVESVVAGEGGVLEGMREGSLLIDMSTISPAVARQLAAKARERGASMLDAPVSGGDVGAREGTLSIMVGGSEEDFGRARPLFEVMGKTVTHVGPSGAGQIVKAANQIVVGLTIEAVCEALVLGLRGGVEPQKIFEVLCGGLAANRVMEVKREKFLSRDFRPGGKARFHRKDLGIALNTGREYGVALPAAALVEQLFGALEAKGRGDLDHSALLLLVEELSGHQGRQ

SEQ ID NO: 25231 - protein, 244 aa, Rubrobacter xylanophilus DSM 9941
MSIIEFRNVSKSFGDFEVLKGIDFSVEEGEVVVIIGPSGSGKSTLLRCINALEGISSGELIVDGIRVHDRKADLNRLRTEIGFVFQQFNLYPHMTVAENVMLAPMKVRKLSRKEAEERCMRLLERVGIPEQAGKYPENLSGGQQQRVAIARALAMEPKIMLFDEPTSALDPEMINEVLEVMVDLARGGMTMVVVTHEMGFARRVADRVVFMDEGRILEEGPPEHFFENPENERTKRFLDRILHM

SEQ ID NO: 25232 - protein, 350 aa, Citrus unshiu
MADNHNPTSGAGSKDLSASMDGGSGAYDRLVVCFGEMLIDFVPTVGGVSLAEAPAFKKLLCAPANVAVGISRLGGSSAFVGKLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAAREGIMSIWDQADIIKVSDDEITFLTGGDDHNDDHVVLEKLFHPNLKLLIVTEGSKGCRYYTKEFKGRVPGVKTKAVDTTGAGDSFVSGILNCLAADQNLIKDENRLREALLFANACGALTVTERGAIPALPTKEAALKLLHTVAAL

SEQ ID NO: 25233 - protein, 221 aa, Pseudomonas aeruginosa
MKKIKLVMVGNGMAGVRTLEELLKLNSDFYDITVFGAEPHPNYNRILLSPVLAGEQTFEEIVLNDLNWYAENGIKLLLDRKVVQIDRLRRRVVAADGSEAEYDRLLLATGSLPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRV

SEQ ID NO: 25234 - protein, 134 aa, Circaea cordata
ERVRNGSWVGATGKVLKDVIAVGIGGSFLGPLFVHTALQTDPEAGKNARGRELRFLANVDPIDVARSISGLNPETTLVVVVSKTFTTAETMLNARTLREWISSALGSSAVAKHMVAVSTNLPLVEKFGIDPKNA

SEQ ID NO: 25235 - protein, 136 aa, Circaea cordata
VSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPSLDAYRIGQLLAIYEHRVAVQGFI

SEQ ID NO: 25236 - protein, 144 aa, Fuchsia cylindracea
NVLDKIKEFSERVRNGSWVGATGKVLKDVIAVGIGGSFLGPLFVHTALQTDPEASKNASGRALRFLANVDPIDVARSISGLNAETTLVVVVSKTFTTAETMLNARTLREWISSALGSSAVAKHMVAVSTNLPLVEKFGIDPKNA

SEQ ID NO: 25237 - protein, 136 aa, Fuchsia cylindracea
VSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPSLDAYRIGQLLAIYEHRVAVQGFI

SEQ ID NO: 25238 - protein, 134 aa, Hauya heydeana
ERVRNGSWVGATGKELKDVIAVGIGGSFLGPLFVHTALQTDPEASKNARGRELRFLANVDPIDIARNISGLNPETTLVVVVSKTFTTAETMLNARTLREWISSALGPSAVAKHMVAVSTNLPLVEKFGIDPNNA

SEQ ID NO: 25239 - protein, 136 aa, Hauya heydeana
VSIDGLPLPFETGEIDFGEPGTNGQHSFYQLIHQGRVIPCDFIGVVKSQQPVYLKGEVVNNHDELMSNFFAQPDALAYGKTPEQLQKENAPQHLIPHKTFTGNRPSLSILLPSLDAYRIGQLLAIYEHRVAVQGFI

SEQ ID NO: 25240 - protein, 381 aa, Ludwigia peploides
NVLDKIKEFSERIRNGSWVGATGKQLTNVIAIGIGGSFLGPLFVHTALQTDREACECARGRQLRFLANVDPIDVARNIMGLNPETTLVVVVSKTFTTAETMLNARTLREWISSALGPSAVAKHMVAVSTNLPLVEKFGIDPKNAFAFWDWVGGRYSVCSAVGVLPLSLQYGFAIVEQFLLGARSIDQHFNSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVMKSQQPVYLKGEVVNNHDELMSNFFAQPDALAYGKTPEQLRKENVPEHLVPHKTFTGNRPSLSILLPSLNAYNVGQLLAIYEHRVAVQGFI

SEQ ID NO: 25241 - protein, 501 aa, Calylophus toumeyi
MASPALISETEAWKDLKAHVEGIKRTHLRELMGDAERCQSMMVEFDNIFLDYSRQQASPDTINKLYKLADAAHLKQKIDRMYNGDHINSTENRSVLHVALRAPRNSTICSDGKNVVPDVWNVLDKIKDFSERVRSGSWVGATGKVLKDVIAVGIGGSFLGPLFVHTALQTDPEASKNARVRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLLYGFAVVEKFLQGAHNIDQHFSSAPFEKNIPVLLGLLSVWNVSFLGYPARAILPYSQALEKLAPHIQQVSMESNGKGVTIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFIGNRPSLSILLPTLDAYRIGQLLAIYEHRVAVQGFV

SEQ ID NO: 25242 - protein, 491 aa, Gaura lindheimeri
WKDLKAHVEGVKRTHLRELMGDSERCQSMMVEFDNIFLDYSRQQASPDTINKLYKLADAAHLKQKIDRMYNGDHINSTENRSVLHVALRAPRNSAICSDGKNVVQDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFQSGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWG

SEQ ID NO: 25243 - protein, 371 aa, Epilobium canum
ERVRNGSWVGATGKELKDVIAVGIGGSFLGPLFVHTALQTDPEASKNARGRELRFLANVDPIDAARNLSGLNPETTLVVVVSKTFTTAETMLNARTVREWISSALGPSAVAKHMVAVSTNLQLVETFGIDPNNAFAFWDWVGGRYSVCSAVGVLPLSLQYGFAVVEKFLQGAHSIDQHFLSAPFEKNIPVLLGLLSVWNVSFLGYPARAILPYSQALEKLAPHIQQVSMESNGKSVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 25244 - protein, 371 aa, Epilobium canum
ERVRNGSWVGATGKQLKDVIAVGIGGSFLGPLFVHTALQTDPEASKNARGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLTFESGEIDFGEPGTNGQHSFYQLIHQGRVIPCDFIGVVKSQQPVYLKGEVVNNHDELMSNFFAQPDALAYGKTPEQLKKENVAEHLIPHKTFTGNRPSLSILLPTLDAYRIGQLLAIYEHRVAVQGFI

SEQ ID NO: 25245 - protein, 371 aa, Epilobium brachycarpum
ERVRNGSWVGATGKELKDVIAVGIGGSFLGPLFVHTALQTDPEASKNAKGRELRFLANVDPIDAARNLSSLNPETTLVVVVSKTFTTAETMLNARTVREWISSALGPSAVAKHMVAVSTNLPLVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQGRVIPCDFIGVVKSQQPIYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 25246 - protein, 373 aa, Epilobium brachycarpum
ERVRNGSWVGATGKQLKDVIAVGIGGSFLGPLFVHTALQTDPEASKNASGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLPFESGEIDFGEPGTNGQHSFYQLIHQGRVIPCDFIGVVKSQQPIYLKGEVVNNHDELMSNFFAQPDALAYGKTPEQLKKENVAEHLIPHKTFTGNRPSLSILLPTLDAYRIGQLLAIYEHRVAVQGFIWG

SEQ ID NO: 25247 - protein, 166 aa, Megacorax gracielanus
SAILPYSQALEKLAPHIQQVSMESNGKGVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFIWG

SEQ ID NO: 25248 - protein, 281 aa, Megacorax gracielanus
ERVRNGSWVGATGKELKDVIAVGIGGSFLGPLFVHTALQTDQEASKNARDRELRFLANVDPIDVARNISGLNPETTLVVVVSKTFTTAETMLNARTLREWISSVLGTSAVAKHMVAVSTNLPLVEKFGIDPNNAFAFWDWVGGRYSVCSAVGVLPLSLQYGFAVVEKFLQGAHSIDQHFSSAPFEKNIPALLGLLSVWNVSFLGYPARAILPYSQALEKLAPHIQQVSMESNGKGVSIDGLPLPFETGEIDFGEPGTNGQHSFYQLIHQGRVIPCDFIGVV

SEQ ID NO: 25249 - protein, 371 aa, Hauya elegans
ERVRNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLHYGFAVVEKFLQGAHNIDQHFSSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVVRSQQPVYLKGEVVNNHDELMSNFFAQPDALAYGKTPEQLQKENVPQHLIPHKTFTGNRPSLSILLPSLDAYRIGQLLAIYEHRVAVQGFI

SEQ ID NO: 25250 - protein, 269 aa, Lopezia grandiflora
ERVRNCSWVGATGKELKDVIAVGIGGSFLGPLFVHTALQTDQEASKNARGRELRFLANVDPIDVARNISGLNPETTLVVVVSKTFTTAETMLNARTLREWISSALGTSAVAKHMVAVSTNLPLVEKFGIDPNNAFAFWDWVGGRYSVCSAVGVVPLSLQYGFGVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQ

SEQ ID NO: 25251 - protein, 230 aa, Lopezia grandiflora
AILPYSQALEKLAPHIQQVSMESNGKGVSIDGLPLPFETGEIDFGEPGTNGQHSFYQLIHQGRVIPCDFIGVMKSQQPVYLRGEVVNNHDELMSNFFAQPDALAYGKTPEQLKKENVSEHLIPHKIFTGNRPSLSILLPTLDAYRIGQLLAIYEHRVAVQGFIWGINSFDQWGVELGKSLATQVRKQLHASRVNGEAVEGFNFSTKTLLTRYLKETSDVPADPSTLLPKI

SEQ ID NO: 25252 - protein, 509 aa, Arabidopsis thaliana
MDIDVGPVDPSVLYEQDLHVSSAVWEGQERGLLRCQEHTSLLHQWKLTDEQINLVDKAGFGYFRKIGPMSLNNSLISALVERWRRETNTFHLPLGEMTITLDEVALVLGLEIDGDPIVGSKVGDEVAMDMCGRLLGKLPSAANKEVNCSRVKLNWLKRTFSECPEDASFDVVKCHTRAYLLYLIGSTIFATTDGDKVSVKYLPLFEDFDQAGRYAWGAAALACLYRALGNASLKSQSNICGCLTLLQCWSYFHLDIGRPEKSEACFPLALLWKGKGSRSKTDLSEYRRELDDLDPSKITWCPYERFENLIPPHIKAKLILGRSKTTLVCFEKIELHFPDRCLRQFGKRQPIPLKVKRRDRKNRRLDDLDTSMSLACEEWAERGDHIVDSPGGGNVVDDGAYMEWYARISITKLYREAFLESQVMNMIACMREFEEAASGIALERLSPAEREVMESVKDTFANSLTFGGWQEVAVNSGYGKRRRRNEHTPTPNNGGGNDISSLLLQKEDS

SEQ ID NO: 25253 - protein, 473 aa, Eriocnema fulva
PQTETKASVGFKAGVKDYRLTYYTPDYQVKPTDTLAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRFDYIEKDRSRGIYFDQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 25254 - protein, 472 aa, Cambessedesia corymbosa
QTETKASVGFKAGVKDYRLTYYTPDYQVKPTDTLAAFRVTPQPGVPAEEAGAAVAAESSTGTWTTVWTDGLTSLDRYKGRCYNIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRFDYIEKDRSRGIYFDQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 25255 - protein, 403 aa, Saccharomyces cerevisiae
MAAIRDYKTALDLTKSLPRPDGLSVQELMDSKIRGGLAYNDFLILPGLVDFASSEVSLQTKLTRNITLNIPLVSSPMDTVTESEMATFMALLDGIGFIHHNCTPEDQADMVRRVKNYENGFINNPIVISPTTTVGEAKSMKEKYGFAGFPVTADGKRNAKLVGAITSRDIQFVEDNSLLVQDVMTKNPVTGAQGITLSEGNEILKKIKKGRLLVVDEKGNLVSMLSRTDLMKNQKYPLASKSANTKQLLWGASIGTMDADKERLRLLVKAGLDVVILDSSQGNSIFQLNMIKWIKETFPDLEIIAGNVVTKEQAANLIAAGADGLRIGMGTGSICITQKVMACGRPQGTAVYNVCEFANQFGVPCMADGGVQKHWSYYYQSFGSWFFYCYDGWYVGRYYRITR

SEQ ID NO: 25256 - protein, 279 aa, Physcomitrella patens
MAKDAGTESGVPSKDYSDPPPAPLIDAAEFGRWSFYRAIIAEFVATLLFLYITISTVIGASRNAGCAGVGLLGIAWAFGGMIFVLVYCTAGVSGGHINPAVTFGLLMARKISLPRALTYMIAQCLGAICGAGLAKGFQTAFYMRYGGGANSVALGYSTGTGLAAEIIGTFVLVYTVFSATDPKRNARDSHVPVLAPLPIGFAVFMVHLATIPITGTGINPARSFGAAVIYNRSKPWDDHWIFWVGPFLGAALAASYHQYILRAAPFKSLGSFRSAPSHV

SEQ ID NO: 25257 - protein, 279 aa, Physcomitrella patens
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWNDHWIYWVGPFLGAALAAAYHQYVLRAGPFKSLGSFRSAPSHI

SEQ ID NO: 25258 - protein, 336 aa, uncultured marine gamma proteobacterium EBAC20E09
MIRNLLINLFFLIPVWLIRLVALPFRDVKRNTIFDPQAKFFLALIPKFEIHLIGDQDISKIRNQIHEKRNNLRLSRKIKKNIKTIDHLINQNNSLSLREYVPYKIDNSNVILFFHGGGYVLNSVDTHHDMVCYFSEKLRTRIYSLEYSLAPENKFPKARDESLLALRWLIEQGHNPANISLCGDSAGAHLAVSLSQHLKNNENIKLHSQCLIYPMCDPKCDSESHKIFKHGYLLTHEAMKWFWQKFSSSKLDIEDSTFNLMIEDTTIQQPKTILVTAGFDPLVDEAEEFAFLLHENDNTVIQLHYPSLFHGFASMTRLKSAKLAVDDFLREYKEIL

SEQ ID NO: 25259 - protein, 359 aa, uncultured marine gamma proteobacterium EBAC20E09
MIFEPYKLKNITLRNRVVMAPMTRNQSPGGIPTQDVVSYYSRRSKAEVGLIITEGIEVSHKASSAYPNVPRLDSENAREGWKKVVNGIKKHDGSVIAQLWHCGGFRKLGMQPDPEVPGYTASGLVKPGKKVAHEMTLDDIKETIEAYASDAKICEELGFDGIEIHGAHGYLIDNFFWSGTNIRDDQYGGTIEKRSQFVVDIIKAIRDQVSNEFIVGLRFSQWKQHDFEAKLALNPEELKKVLIEPVNSGLDYVHSSMRRFWEKEFENSEENLAYWTKKITKIPTIGVGSVGLDSDFIDMTAPASPTSIERAIEDISKNKYDMIAVGRALLSDPEWVLKMKEGRLNDVIPYTKEALLNLY

SEQ ID NO: 25260 - protein, 367 aa, uncultured marine gamma proteobacterium EBAC20E09
MSKRDYYETLEVSRDASASELKKAFKKKAMKFHPDRNPDNPEAAEKFKEAAEAYDVLSDPQKKSAYDQFGHSGVEGMGGGGPNFNDININDIFGDIFGDVFGTRSQSRRQRRGSDLQYNLELSLKDAVLGVQKKIKIPSHRECPDCLGSGAAKGTKPVTCMNCNGTGQVRMQQGFFSIQQTCSVCSGTGQVIKEKCGTCGGVGAIKENKTLSVNIPAGVDNGDKVRLSGEGEWMKGGRSGDLYVAIRVKDNPLFERDGRHLYIEAPIPFDVSILGGSIKIPTLEKTISLKIPSNTQTGKVFRIKGEGASIVRNKRRGDILCRVIVETPSNLDKAQLKALSELTKKLEPSKNYPGTDIFLKAISKNKE

SEQ ID NO: 25261 - protein, 443 aa, Leptospira interrogans serovar Copenhageni str. Fiocruz L1-130
MNQNKPTSKLISDFWKGKTSEELFERAKKVSPGGVHSPVRSFRSVGGTPVFFASAKGATLTDISGKEYIDYCLSFGPLILGHRDPEIEEVVRETTEIAWSFGAAEPYSLELAELISSRVPWAEKVRFVNSGTEAVMSALRVARAATGREKILKFDGCYHGHLDSLLVKAGSGLAGESSSDSAGISATSIANTLVLPLDDEASVERVFETEGKNIAALIIEPLPANYGLLIQRKEFLLKIVETARKYGTLVVFDEVISGFRVGFQGMSGLLGIWPDLVTYGKIIGGGFPVGCYAGKKDLLDLVAPSGPVYQAGTLSANPFGMRAGLATLKKAQRDSIYSVLDDRTKIFTDTMTKLLNKKSNQEWEAVIHSSLFWFRKKTQQPIRRIDLIPEGHKESFAKVFHTFLKNGIYLAPSGYEVGFLSWAHDDEIIAKTLEIADKALKTF

SEQ ID NO: 25262 - protein, 316 aa, Leptospira interrogans serovar Copenhageni str. Fiocruz L1-130
METKLQKIGEVGTLLFPAWVLIGSILSFFFPQWFTWFTGPAITYGLGFTMLGMGITLLPRDFRNIFKTPIPVFIGVALQYTVMPVSGWGIGVLLDLPIPLATGLVVVSCCPGGVASNVITYLAKGDLALSVSMTASSTILSVFMTPLLTLFLIGKGIDVSTSGLFLDTFQVVIFPIVLGVLLNVYFPEVSKKIQAVSPLVAVFLITMIVSSILGAGKEKILQSAGILIFAVLSLHISGFFFGYVISWLFIRKQKISRTISIEVGMQNSGLGVVLSRNNFPDPLVAIPAAISSLVHSLIGSLLAVFWRKLEKETTIK

SEQ ID NO: 25263 - protein, 486 aa, Leptospira interrogans serovar Copenhageni str. Fiocruz L1-130
MKSESSVFRKTKIICTIGPATSDKKMIQALAEAGMNVARLNMSHGNHDFHRSIIRNIKSLNKDVLKNPIAILLDTQGPEIRTGDLQVDHLDLKVGETFTFHIIPGEESEEQSVFVNYKDIVKDLKVGDPVTVDNGLINLVVEEINDSALKCKVLDGGRLGSRKHINLPGIRVNLPSITPKDHKDILFGLEEDVDFIALSFVRSVEDINQLKQIIEENDGHAQIIAKIEDQEAVRNMKEIVEAADGVMVARGDLGVEVPIEELPILQRAIIKECALKGKRVIVATHLLESMIHNPSPTRAEVTDVANAIYEEADAIMLSGETAAGKFPIRCVEMMDKIAQRVEKTGGVDYVKDKIPQDKKEQMARAAAKLADSLKCPAIIVITRRGTTALNVAGFHPHYPLIYAFTNMTTVRRKLWLTRGVIPHRIDFSKDPEKTIRLAIETLKKTGRIEDGDQVVILSDIIAGEDRVETIQIREVKTYFNVEVEKL

SEQ ID NO: 25264 - protein, 394 aa, Leptospira interrogans serovar Copenhageni str. Fiocruz L1-130
MRALLEKSNDLFNPTENHLALRENVAKFAKENMDTQAKEHDDYETFNLSLFRRIGSELGLFGVTVPEEDGGMGMDAVAAVIIHEELSAYDPGFTLSYLAHEVLFVNNFYHSSNAAQRAKYLLKVISGEWIGGMGMTEPGAGTDVLGMRTIAVKKGDKYVLNGSKQYITNGNVGSVFLVYAKMDKDSKRTTSFIVESSFPGFSVGKKEEKMGMRSSPTTQLIFEDCEVPAENLVGQEDGALVHMMRNLEIERITLAAQSLGIAKRCVDVMADYTIRHREAFGKKLSEFGQIQRLLAESYADYQAARALVYQVASGIHPESRNSLGAASAKLVATQMAERVSRNAIQALGGYGYCREYPVERLHRDSILLSIGGGTNEAMQKNIVADLKKIYEGTP

SEQ ID NO: 25265 - protein, 498 aa, Leptospira interrogans serovar Copenhageni str. Fiocruz L1-130
MQTALYISVLIISSCGLVYELLAGTIASYLLGETVTQFSLIIGTYLFSMGVGSWLSKYLEKDLIPKFLEIELAIGLVGGFSSAILYLSFGQIRYFQIPLFLLVILIGILVGLEIPVLLRILKKELQFKELVSRVLSLDYVGALLASILFPIFFAPKLGLMRTGFIFGILNVGVALWGTWVLPLRQSKIIILRAQSVVVLTLLILGFSYSDLITYYSEESLYTDEIILSKQTQYQRIIVTRWKNEIRLFLNGHLQFSSRDEYRYHETLVHPALLAHPTPKKVLVLGGGDGLAVREILKHKNVESVTLVDLDSAITNLFSEHGILKKLNEESLKNSKVTVINTDAFLWLEESDQIFDVVLIDFPDPSNFSLGKLYTTAFFHTLKRRMNETSVLEIQSTSPLFARSSYWCIERTIASLGFYTLPLHVYVPSFGEWGFVLAGQRPIQFKKDFPKDLKFLNIQELESIQTFPQDMSRVPVEINRLDNQALVRYYDREWNRILD

SEQ ID NO: 25266 - protein, 263 aa, Leptospira interrogans serovar Copenhageni str. Fiocruz L1-130
MFRLLQVKNLNKSYLVSGKKLEVLKDVSFQIEEGEFIAIIGPSGSGKSTLLAISAGLDRPDNGEIMLDGVPLLQKDEDELAKLRGEKIGFIFQNFQLIKSLNALENVSLPLVLNSKLSSTEIKDKALTWLEKVSMKERASNFPGQLSGGEEQRIAIARSFIHNPKILFADEPTANLDKKNGETVMNLLAELNQKTSSTLIVVTHDRSVAELADRILEMSDGRIIKEMYGKKKKSLNKPKILSSEKKSVSKHTSTKRKVSAKKR

SEQ ID NO: 25267 - protein, 437 aa, Leptospira interrogans serovar Copenhageni str. Fiocruz L1-130
MTVEDSLRILHTELCPKTDFEAEPENQIQSIGNPGGMSGTVQFRPRCTIKMEFALSSEQKELRDLARKFAKEEIRPKAEHHDHTGEYPLAVLKKAWEIGLMNIHIEPRFNGAGMQELDDVIIGEELFWGCSAMATAILANNLALAPVLLGANDRIKKEFVQPMTEEFKLAAYAVTEPGAGSDVAAIRTSAKKVGDEYILNGSKMWITNAGYADWFFVLTKTDPSAGHKGITGFIVDSKTPGIIMGKKEINMGQKCSDTRGITFEDVKVPAWQMIGREGEGFKIAMGAFDHTRPGVAIGAVGVARAAMEHSIQYANTRNTFGRPIMENQGISFMIAEMARDIEAGRLLCYQAAWMIDNGFRNTYQASIAKMFCADMCMRVCTDAVQVLGGYGFNTEYPVEKLMRDAKIFQIYEGTSQIQRMIVSRFLADGKGIEGPNF

SEQ ID NO: 25268 - protein, 264 aa, Leptospira interrogans serovar Copenhageni str. Fiocruz L1-130
MNSISSVFSSEQSVFIPYISLGDPDYDSCVIWADALIRGGAGILELGIPFTDPVADGPVIQKAFKRSLAHPFSMDKILEVTSEIHKLHPQIPLVYLTYFNPLFSMGLESFTERAKNSGIQGLIIPDLPFDTPEAEEFFSQLERKRIDFIHLVTPATTEDRIRSMKSLASGFIYYVTSYGVTGERGSIASGLEDRIRMVRKIVGLPVCAGFGISTSDQSKVISTYADGVIIGSAVQRIIEENGSDRNNCADKLLAYASEIRASMR

SEQ ID NO: 25269 - protein, 337 aa, Leptospira interrogans serovar Copenhageni str. Fiocruz L1-130
MKVYEIQNQFGLENLKISERPDPVPVQGEVLVRFRAASLNYRDYLMAIGRYNPKQKLPLIPLSDGAGEVVQVGPGVTRWKIGDKVCANFAQTWFDGAPEKDMLKNTLGGPLDGTLCEYRIFREEGLVLMPENLSFAEASTLPCAALTAYTAIVTHGNIQPGATVVVQGTGGVSIFALQFAKMMGCRVIATSSSEEKLAKVKELGADEVINYNEKTNWDREVRKITEMKGADLVIEVGGAGTLQKSISSTKPWGTIALIGVLAGGESNNLSLFPILMQGIRIQGIIVGSKRNFEDMNLAINTNKIKPVVDQVYSFEEVPKAFESLKAGKHFGKICIEI

SEQ ID NO: 25270 - protein, 418 aa, Leptospira interrogans serovar Copenhageni str. Fiocruz L1-130
MVFSFIFWFDLITVKKKVGLEYSLKIRRAKPMYQEFTEQQLEIRDQIRNFVKKEITHEVAIHWDEENKHPEELINRMRKELGVNGLTIPEEYGGWGLGSVEQCLVTEELSRGCLGISLCFGYTGLGILPILKGASHEQKKKWLQPVVDGEYGVSFCLSEPGAGSDVPGMSTTAVKKGDKWVINGTKQWITGGGSAGAYTVFAYTDKGRGTRGVSCFYVKRDTPGLTVGKKEDKLGIRASDTRQIIFEDCAVEEANMIGKENLGFIYALQTLNASRPYVAAMGVGVAQAALDYASKYARQREQFGSKISSFQAVQHMLADMSIGLETSRQVTYLAARMSDADDPRLPKYSAIAKAHASETAMKCALDAVQIFGGYGYTKEYPVEKLMRDAKILCIFEGTTQIQKNEIAAYVIREAASAK

SEQ ID NO: 25271 - protein, 438 aa, Leptospira interrogans serovar Copenhageni str. Fiocruz L1-130
MNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 25272 - protein, 459 aa, Leptospira interrogans serovar Copenhageni str. Fiocruz L1-130
MKKKLSRTFICQSCGQDYTRWAGKCESCGSWNSIVEEIGGERFSSSNGSSQKNKSYKEPIPLDRVEEESLKRMGTGLKELDLVLGGGLVPGSLTLIGGEPGVGKSTLILEVSRYLTQANKNVLYISGEESPSQIRMRAERMGLRASNLFVTSETIAENISSMIEGEKPAVVFVDSIQTIAREALPNQAGTVTQLRECTQVLLETAKRSGIPILMTGHITKEGTIAGPKVLEHLVDTVLYFEGDRLNYYRLLRAVKNRFGAVGDLAIFEMFSGGLREVGDRNRVFVSAGAEERSGSVISAVLEGSRALTVEVQALVSKTGFAQARRMAEGPDTRRVILLAAVIEKYIKIKLGECDLFSNLAGGLSADEPALDLAICASIISSYLDQPLPKGTCVLGEVGLSGEVRSIGQANLRVKELAGVGMKKVILPEGNLSELDQNLDIQVKGIRSLNDLRSLFPGAS

SEQ ID NO: 25273 - protein, 490 aa, Leptospira interrogans serovar Copenhageni str. Fiocruz L1-130
MRKFDKTLFHEFRRIYKFMPESYDLTVIGAGPGGYVAAIRAAQLGMNVCIIEKDKPGGICLNWGCIPTKALLESAHLLEKLHSAKEYGINLSDPKPDFAAIIRRSRNVAEGMASGVEFLLNKNKITRKKGTAVFKDPNTIWLPDSSKEEITSKYFILATGARARELPDLPFDSHTVLSSKTAMIQDKIPESLLIVGAGAIGVEFADFYSTMGTKVTLVEMMDQILPVEDKEISTFLEKSFVKRGIRVLTGVGVSDPKIVNGKVKVLLKGKNLPEAVESFEAEKILVSIGLVPNTDSMHLEEIGIFLQKGFVKTDTKYKTSVPHIYAIGDCNGAPLLAHVASMEGIKAVEAISIHAGNPHHLSYIPIDYNAIPGCTYCHPEVASIGFTEKKATDMGYTISVGKFPFVASGRAKAMGDTGGFTKVIVDKTSGEILGAHLIGPGVTELLPAVSLGITQELTAKEIASTIFAHPTLSETVMESFGAALGEAINL

SEQ ID NO: 25274 - protein, 498 aa, Leptospira interrogans serovar Copenhageni str. Fiocruz L1-130
MHSFYIPFGSSLVVLNLEPILPLCFWPHSLRQPGPKTKVLSPREGEILTVYQLETTVQANSDGEFEIFHEGNKLFSFQSTPSSPQTSPTFKPKNGHNTIQIRFKKSNGFVLSQEIHFYFGTKLSAGGAHSGFLINGELYTVGRNNFGQLGTGISTGDGINDRIVKVDPIRDIFSIHFNQNNSMAISQNGRVYTWGANSKGQLGIGNNNTDPARASDPGNRQPPTEIPGINDAVMGAYGFNHALVLKSDGTVVAFGQNNVGQLGNGENNLNRNSFSSNPVNVVQLRNVIQVIAGSEHSAALTENGEVYIWGRNQYGNLGNGIISPANTVQSVPVKVEGLSKIKQIANGRDHILALTSDGKIYSWGLNASGQLGIGGNGNPPPTPIPTQILNIQDVASIWAGGTQSFAILKNGEVKGWGANGNMASLALGESNTQKVYEPNKAVVGIDNVVHFGCGATHNFALLGNGEIYGWGWNFKGSLGRTDLQNNWGAPNPVYIKFP

SEQ ID NO: 25275 - protein, 215 aa, Leptospira interrogans serovar Copenhageni str. Fiocruz L1-130
MKISASILATKLTELVKTVPNYDPTAIDLIHMDVMDGNFVPQISFGEALTKEVKSLTSIPLDVHLMVAKPENHVFKYYEFNPYCITFHIETTDFPIRLAQEIKSHGTKVGVSLNPGTPVSSLENVLPYVDLILLMTVEPGFYGQKFIINGMDKIRKVKELIGSRPIELEVDGGVNDTNIQELRKNGVDIVVVGAGLYKTGNPVENAKNLKYLARV

SEQ ID NO: 25276 - protein, 511 aa, Leptospira interrogans serovar Copenhageni str. Fiocruz L1-130
MIQIKRALISVSDKSGLVEFAKFLNQNGVEIISTGGTLKLLKDNGIAAIAIDDYTGFPEILDGRVKTLHPKVHGGLLGVISNPAHKQKMEELKIPKIDLVVVNLYPFLKTVSKPEVQLEEAIENIDIGGPSMIRSAAKNYKHTLVLTDPNDYKEIQNLISSSGISEEISASYMRKAFSHTAMYDAAISSWFYKQSGEVFPDVLNLSFIKKQKLRYGENPHQAASFYEPLFTKSDFSPLQGKELSFNNMLDFDAAFHISSLLPENTVCIIKHLNPCGIAYADNPLEAFQLARRTDPISAFGGVIGIKGQVNGELATSITENFVEGVIAQKFTQEALEVFSKKPNIRLIEIQDFKEALDELDLRPIHHGLLIQDRDYTTITEKDLKVVTKKQPSPDDIRGLMFAWSCVRFIKSNAIVYTEENATLGIGAGQMSRVDSVQLGANKALNVGLSVVGSYVASDAFFPFRDGIDTLAKAGAKAIIQPGGSVRDEEVIQAADEHGLIMVFTGMRHFRH

SEQ ID NO: 25277 - protein, 406 aa, Leptospira interrogans serovar Copenhageni str. Fiocruz L1-130
MNDADIHKELFQHTKELADHYLLNTYARYDVAFRYGVNELLFDFDNKQYIDFHCGVAVTNLGHADPDIIEVVRSQADKLFHTSNLFYSEEASKLAELLILNSFPGKVFLTNSGTEAIEGAFKLARKYAYSKSIVDPIILSLEKSFHGRSVSGMSLTGQDKIRKGYGELLKGIEFIEPNNDEALVAAFERYQGRIVALIEEPILGESGIIPLSRNFLTLSRELTEENEALLIFDEIQTGMGRTGTLFAFETMGFSPDAMTLAKGLGSGFPIGALIVGEKYQDLFTQGSHGSTFGGNHLAAAVAYETIRIIQTREILNNVNICSDIAFTRLREMQEKYPVISEVRGKGLHIGLELKVPSKPIAEACLSAGLVVNATADNVVRIMPPLTISTDFLNQGLDILESVLKQN

SEQ ID NO: 25278 - protein, 433 aa, Leptospira interrogans serovar Copenhageni str. Fiocruz L1-130
MIWYPFTLQFEPDSPLKIERAKGEFLYDELGNSYIDGISSWWVSIHGHNHPKIVQAVKNQLEKLDHVLLAGFTHDPAEKLAAELLKITDGLFQKVLYSDNGSTAVEIMIKLAYQYFQNIGEVDRKIFIKWNSSYHGDTIGTMSVGGNSVFNRVFQGLMFPTKEFQTPNCNFCPMGKKPESCKVECIDPIEEFFQKSPKAVAGIVIEPLILGSGGMIFYKEEVLQRLETISKKYGSLLLLDEVFTGFGRTGSVFAYQRAKIRPDFIALAKGLSAGVSAVAVTLTTDRIHSAFVTADPEKGFYHGHTMTGNPIACSAALASLKIFFEENRLEQILRLESKLNVGLKKIAKEFPKAVKNCRVLGAVGVLELEVGKASGYHYPGNKILKKKFLEKGVLLRPLGNVIYLTPPYNIENSSLEKIFSAIRETLSEISFGN

SEQ ID NO: 25279 - protein, 460 aa, Leptospira interrogans serovar Copenhageni str. Fiocruz L1-130
MKEYDIIVIGTGGGTKLVTPPSKIGYKIAVIEKENPGGTCLNRGCIPSKMLIYPAEILSLTKHSEKFQISFPKKPEVDFKTLIERISKTVDDESASILPAYDKNSNITYISGTASFISDKVITVNGEQLTAERIFIASGARPAIPDIPGLAGTPFMTSRETLRRTDLPKSMIVIGGGFIALELGFAYSSFGSEVTFLVRNRMLKNEDKDIVDEFERIFTKEHNVLLHTNIHKIEYNKNLFYVEAISQGKTILLQSEALLVATGIKPNTDLLNLQNTNIQTDKNGYIVVNEYLETTSPGVYALGDITGKYFYRHSVNFEGEFLFRTLYQEKKRTPIEYPPVPHAVFTHPQIAKVGKTEEELIQEGIDYVAAKNSYSASATGMARLSDSGFVKILIDKKSKMVLGAHVIGDEASNLIHLFILLMTMKGTLDDLLKMIYVHPALPEIARNAARKAKELLQSKK

SEQ ID NO: 25280 - protein, 333 aa, Leptospira interrogans serovar Copenhageni str. Fiocruz L1-130
MFDEISRSIDEFGNSFLSALNNIQKSFGRELSVAKPVKETILQMIGNTPLIRLNQIGSHIPNVEFYLKAEFCNPTGSVKDRTALSMLLSSERRGELKPAGQVIQPGYNTTAMSLAWICTIRQYKFRCLVAGDTDPLKIKDLQTFGAHVEIVPGAKGNWDDSLLKRAKEIKEKEKNTIILNEYKDMANTNAHYLFTGPEIWRDLGGNVDAFVAGGGSGGTLSGVGRFLKSKKSSVRVIMGVSQKSRFIRKMVQNESSIYLPESFDPKIVDEYVGVDREQALLYQSDLYQKEGIFAGQTTGTTLASAIRFAEGLSIKEDSKSQVYRIVVLSPDRF

SEQ ID NO: 25281 - protein, 434 aa, Leptospira interrogans serovar Copenhageni str. Fiocruz L1-130
MPRNYKPETIALHGGQSPDPSTLSRAVPIYQTTSYVFKNTEHAAKLFGLQEFGNIYTRIMNPTTDVLEQRIAALEGGVAALATASGQAAETLALLNIVEAGQEIVASSSLYGGTYNLLHYTFPKLGIKVHFVDPSDPENFRKAVNDKTRAFYAETLGNPKLDTLNLEAIAKVAHDSEVPLIIDNTLPSPYLVNPIEHGADIVVHSLTKFLGGHGTSIGGIIVDSGKFNWGNGKFKNFTEPDPSYHGLKFWEVFGKFEPFGGVNIAYIIKAKVQGLRDMGASISPFNAWQILQGVETLPLRMRKHSENALAVAEYLTKHTKVSWVNYPGLKMDKNYSLAKKYHKKDLYGAILGFGIKGGAVEAKKFIDGLELFSLLANVGDAKSLVIHPASTTHQQLTPEEQLSAGVTPDFVRLSVGLENIEDILFDLEEALKKV

SEQ ID NO: 25282 - protein, 255 aa, Leptospira interrogans serovar Copenhageni str. Fiocruz L1-130
MEPFAIELKNVHKTFGKRKILAGMDLHVKKGETLVILGPSGTGKSVTLKHITGLLEPDAGDCFIFGESISRVDSKVKKKLRARMGVLFQSGALINWLTVFDNVALPLREHKLASEEKIQKIVMEKLKLVDMVIAKDNFPNDISGGMKKRAGIARAITTNPEIILYDEPTSGLDPVMSNVINELVLKIQKETGAAQVVVTHDMSSAYMIADRISFVYKGQIVFTGTPEEIQNSNNELIQQFIHGKTTGPMILETKS

SEQ ID NO: 25283 - protein, 508 aa, Leptospira interrogans serovar Copenhageni str. Fiocruz L1-130
MSNQTYRDSEYLDGLSGEELFNLQIGLTYRDFLVLPGFIDFHPSEVELETRLTRNIKLKRPFISSPMDTVTESQMAIAQALMGGIGIIHYNNTIEEQVALVEKVKRFENGFITDPVILGPKNVIRDLDAIKERKGFTGIPVTEDGTRNSKLIGIVTNRDIDFEKNREITLDKVMTTNLITGKEGITLQDANEIIKKSKIGKLPIVDSQGKLVSLVSRSDLKKNKEFPDASKDERKRLRCGAAVSTLLESRDRVAALYEAGVDVIIIDSAQGNSNYQIEMIQFIKKEFKNLDIVAGNVVTRAQAENLIRAGADGLRIGMGPGSICITQDTMAVGRAQATAIYQTAKHSAKYDVPVIADGGISNIGDIANSLAIGASTCMMGFMFAGTTEAPGEYFYENGIRLKKYRGMASIEAMKAGGDKRYFNEGQKVKVAQGVSGSVVDRGSILNFIPYLSQGLRLSFQDMGYKSIPEIHKALRDGKLRFERRSESAQAQGSVHGLYSFSAPTMRAE

SEQ ID NO: 25284 - protein, 432 aa, Leptospira interrogans serovar Copenhageni str. Fiocruz L1-130 [sequence omitted]

SEQ ID NO: 25285 - protein, 376 aa, Leptospira interrogans serovar Copenhageni str. Fiocruz L1-130
MDRILQFTEEHESFRTMARKFFETEVAPNHESWEKVGVVPKEIWKKAGANGLLCPDVPAEYGGAGADFLYNVIVIEESSRVGNSGFFISLHNDVIAPYITAYANEEQKKRWLPGCTTGDSILAVAMTEPGAGSDLKNIRTSAIEKSDHYVVNGQKTFISNGQLANLIITAVKHDNGTMSLLMVEEGMKGFERGRRLEKIGLKAQDTSELYYNDVIVPKENLIGKQGQGFRYLMQKLATERLVLSIAAVEATALVQRITLQYIKERQAFGKKIGTFQNIKFKMAEMATELEMCRTFVDKITLETIAGRSNTAEASMAKWYSTEMQKRHTDECLQFFGGYGYMMEYPIARAYLDARIQTIYAGTTEIMKEIIGRSLGL

SEQ ID NO: 25286 - protein, 384 aa, Leptospira interrogans serovar Copenhageni str. Fiocruz L1-130
MFQKDGFNVRLLPAAFSEKELLDEIENIHVLGIRSKTNVTSAVLEKAKRLLTIGCFCIGTNQVDLVGAEKKGIPVFNAPYSNTRSVAELVISEIIMLARRVPDHIRNTHSGIWNKISKNCFEVRGKTIGIVGYGHIGSQVSVLAEAMGMKVIYYDIQTVLPLGNATPVSSYEELLKNSDFISFHVPETPQTMNLYGKKEIEVTKKGAYMINLSRGKVVDLEALAKAIQSGHIAGAGIDVFPEEPESNNDPFLTPMQNLPNVILTPHIGGSTEEAQRNIGSEVASKLLKFINNGSTTFSVNFPNLEITPLPAGQYRILNVHKNQPGFLKDINSMVSAIGANISSQHLGTSAEIGYLSMVIDKSVGDELKEKIEKHPFSIKTRILY

SEQ ID NO: 25287 - protein, 309 aa, Leptospira interrogans serovar Copenhageni str. Fiocruz L1-130
MKAKNILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 25288 - protein, 396 aa, Leptospira interrogans serovar Copenhageni str. Fiocruz L1-130
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLAALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKARVADKITHISTGGGASLEFMEGRKLPGVEALKKKTSE

SEQ ID NO: 25289 - protein, 250 aa, Leptospira interrogans serovar Copenhageni str. Fiocruz L1-130
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAGLF

SEQ ID NO: 25290 - protein, 353 aa, Leptospira interrogans serovar Copenhageni str. Fiocruz L1-130
MNQDKPVVLIMAGGKGERFWPRSRISTPKQLQKVYSNKTLLRETLERALTITTIDRIYIGTNASLKKSILIQEKNFPEKNFIIEPEGKNTAPIIALASLYFQERYGDPLQVVLSADAWIHPVKEFTKTISKALEYTKEHLVLLGIKPNRPEIGYGYIEAGKSTDACFAVKSFYEKPDVKTALKYIKKKNFYWNPGIFLWRTSIILEEFKTYSPKILDPLKERFPFKKAGELAAAFKIIPSEPVDITIMEKSSRIKMVEASFGWDDVGSWTSLERVMPGDELGNRHMGKTILFHKSSGNITQTRKEFTAVLGVNDLIVVEEEDVLFISTKSGIGDIKNLVSELRKNKTLQKYTE

SEQ ID NO: 25291 - protein, 473 aa, Leptospira interrogans serovar Copenhageni str. Fiocruz L1-130
MSRTPSEVIAYAKANNVLFYDFRFTDIKGAWHHVSYHAGSINEDSFKGLPFDGSSIPAWQPIDRSDMQLIPDTSAIFLDPFTADSTLVVFCDVFDIYKGTLYEKCPRSIAKKALKYLESSGLADTAYFGPENEFFIFDNIKVRDAINVQYYEIDSSEGIWNSHTDFPGSTNTGHRPGTKGGYFPVAPVDSQVDLRADIVKTLHQIGMETFVVHHEVAQGQGEIGVKFGTLIEAADNVQKLKYVVKMVAHKYGKTATFMPKPLYGDNGNGMHCHQSIWKNGVNLFAGKGYQNLSDTAMHYIGGVLSHAKSCAAFTNASTNSYKRLLPGFEAPSILAYSAQNRSASCRIPFVNGDKARRVEFRFPDSSANPYLAFAAMLMAGIDGVQKKIDPGPPREEDLFELSLDEIREKGIQQMPHTLRESVEHMLLDKEFLKKGDVFTEEFIQTYKAYKFETEIWPWEGRPHPFEFLTTYSC

SEQ ID NO: 25292 - protein, 368 aa, Leptospira interrogans serovar Copenhageni str. Fiocruz L1-130
MIYSKMSDLDQQLKIFRDQIDSLDREIVKSIQTRAEFASKIGEIKRERNEPVFRPDREKEVYEKIKSFSPGPLPDKVLLAIYREIMSGSISVEKGLEIGYLGPAGSFSNQAVRSRFGASINALEFNSIPDVFRAVETDKIDYGVVPVENSSEGLVNSTLDQFLVSDLLIYSEHYLRINISLLGLEHDLSKIKTLYGIKIANSQCKNWIAANLPHVEIVETSSTAKAAQIVAEKKDACAAVASSIAAEIYGLSLIRESIEDLPDNTTRFLIIGKNQCPPTGNDKTSIVFSCPDKPGALYRVLKPFFDYQLNLSKIESRPTRRNSWEYNFFIDFHGHQKDPSIQNVLAGLKENTIFLRVLGSYPMSPQNL

SEQ ID NO: 25293 - protein, 467 aa, Leptospira interrogans serovar Copenhageni str. Fiocruz L1-130
MSAEFDVVVIGAGPGGYVCAIRCAQLGFKTAIIEKRKTLGGTCLNVGCIPSKALLDSSEEYHKTLHKLEVHGISVGKVDLDLNKLMNRKDQIVKEVTDGVDFLMNKNKIKRYEGFGKVLSAGKVEVAFNDGKKETLSAKHIVVATGSVPIDIPGLTVDGKNIITSDHAIDVRKLPKKMIIIGAGVIGLELGSVWGRLGTSVTVVEFLPGLISNVDRQMGSLLERSLTSQGMEFLFEHKVKGATTTKNGVKVQIEDSKGESKDLEADVVLVAVGRRPFLEGVGLEEVGVAFTQRKRIQVDAHFKTSVPGIYAIGDAIDGPMLAHKAEEEGVALAELLAGQSGHVNYNAVPYVIYTWPEMAWVGKGEEELKAAGIEYKVGKSLFRPNARSKAMNEAEGQVKILADKKTDKLLGAFVFGPRASDMVAELAVAMEFGASAEDIARSFHAHPTLSEVIKEAAMAVDKWAIHA

SEQ ID NO: 25294 - protein, 356 aa, Leptospira interrogans serovar Copenhageni str. Fiocruz L1-130
MGIEVKNLVKRFGNFTAIDDLSLDVPSGELVALLGPSGSGKTTLLRIIAGLEDADKGQVIFEGREVGKKNAKDRGVGFVFQHYALFRHMTIFENIAFGLEVRKRSERPSKDTIRDKVMSLLKLVQLENFYNRYPSELSGGQRQRIALARALAIEPRFLLLDEPFGALDAKVRKELRNWLRRLHDEIHITSVFVTHDQEEALEVSDKVVILRSGKIEQVGTPDEVYNHPKNSFVFHFLGDVNLFHGRVQGGQTQLGEIKVDTPEHSEIENASAVGYVRPYDVEILREPIEAQTIPAEIQYIHSTGRNVKIDLKRLDTGTILESQLNSSEFQSLNLLPGETVHIRFKKIKVYVEDYTI

SEQ ID NO: 25295 - protein, 189 aa, Leptospira interrogans serovar Copenhageni str. Fiocruz L1-130
MKEGASFMYSKYFIWFMTLGIFLPLAGIFAKGSFYDFKVKDIKGNEVSLSKYKGKVVMVVNVASKCGYTYQYEHLEKVYKKYKDQGFAVVGFPANNFGGQEPGTDQEIETFCRIQKGASFDMMSKISVKGKDIHPLYFYLIQNSPNPGEVEWNFEKILISKSGTIEARYRSSVEPDSSAVTQKIETLLK

SEQ ID NO: 25296 - protein, 465 aa, Leptospira interrogans serovar Copenhageni str. Fiocruz L1-130
MNGVNMEKSPSDKSLLRFFGLGELVNHGWNAILAFWMIMGMAFFLFADQNLIAPNLKNIGASFGLNNQEDVDWYIGGVIPILFFILGGAVSVSMGYLSQKYSRKTLIIFSVFLGEVPCFLSGFATSYPEFVFYRTLTGFGLGGIFPLLFTVLGDYFSDKSRSTAAAYVSLSMGIGLGVGQLLGGILGSADPANGWRTSFIYLSIPSFFFAIIYWIFCKEPIRGGGESEWSGIAEKFSEESFHLRWSDVRLLFKNKTNIGIFLQGIPGCVPWGVFFVFLVDYYETSYHLDKATATMLLTYAAIGVFAGTFFGGIIGQKIYNYKKRLLPIFCMSSILIGILPCIYLLKAENIADSGLFILINVVAGFIISVTGPNVRATLINVNIPKNRSSMFALYNLTDDLGKGLGPAMSALILGLTPGDRSLGLSISVLFWIPCALSWLIVLKNFEKDEKDVHEYLVLEAEKIKG

SEQ ID NO: 25297 - protein, 496 aa, Leptospira interrogans serovar Copenhageni str. Fiocruz L1-130
MNYTRGALSMPTLQESPVKLPNSNQPPSVNKTEIERVFNLQKKHFHKVMKLTTAGQRIQRLKKLKEAIFKYSPEIEKAVHSDFRKSEREVDITEIMPSISEINDAIKHVRRWMKPVDVKTPMTLFGSKSQIIYEPRGVVLIIGPWNYPFYLTFAPLAAAIAAGNTVLIKPSEFTPVTSNLIQKIISEVFPKEEVAVFEGDYQVSGALMELPLDHIFFTGSTHVGKIVMTAAAKHLTTVTLELGGKSPAIIDKSADIKKAAKKLIWGKVLNAGQTCVAPDYLLIPNELIKPFVEEAKTVIKEFYGNSLKENSDFCRIVNDRNFNRVSGYIHEAVEKGAKIEMGGDTDASQNYIEPTLLSNVPENSNIMEDEIFGPVLPMIPYTNLDEAIEKINSKPKPLALYIFGKKDRSIKKILKETSSGGVAVNDVILHLANPNLPFGGINHSGHGSYHGYFGFKAFSHERSVLRQAALSSIDLMYPPYTNFVKRLVSFTKKFLV

SEQ ID NO: 25298 - protein, 187 aa, Leptospira interrogans serovar Copenhageni str. Fiocruz L1-130 [sequence omitted]

SEQ ID NO: 25299 - protein, 187 aa, Leptospira interrogans serovar Copenhageni str. Fiocruz L1-130
MSSREITILKIQEPTRSIASLTRIMEEELSQYRKTLPKGFREEVDCDEDTVLFLHVDFLPLDFQKTTELLLTGKKDLVPVVAIDLQGQILMQAFGNEESQTLSLKTGYAHYFSRSRNQLWKKGDTSGHTQKILQILSPTDRSFLVYQVEQEVAACHEGYYSCFFRERMEGVTWKLLPVPRNFLPEKS

SEQ ID NO: 25300 - protein, 445 aa, Leptospira interrogans serovar Copenhageni str. Fiocruz L1-130
MIRLETRFASSFIQSSKLEPFLEKSESARLTLHSSQGQGKEYLGWLYLPKELKNSEIERMTQVAERLRNSSEVIVVIGIGGSYLGSRAVLEATLPFFKKPSIGNPEIIFAGHHLESRYFSELIEYLEDKNFSINVISKSGTTTEPAIAFRLLWELLRKKYGSSASSRVVATTDSSKGVLKKFADSEKLDTFTIPDNVGGRYSVLTPVGLFPLAVAGISISKFILGFQNILNDIHSITDPTRNPATYYSALRNYFLSEGRYIEVLANFNPSLRYVSEWWKQLFGESEGKENKGIFPASMDFTTDLHSLGQYIQEGKRILFETVLSPSEVCSNLTLKPTQDNLDSLNFLSGNTLGYVNEQARLGTLLAHADGGVPCLELVFPDISPQSLGELMYFFEYSCAISGYSLGVNPFDQPGVEAYKKNMFALLNKPGFEQEGETLRKRISRN

SEQ ID NO: 25301 - protein, 288 aa, Leptospira interrogans serovar Copenhageni str. Fiocruz L1-130
MANQLKKRPENQEGNFYVDSTCIDCETCRIVAPKTFAEKNGGSYVWKQPEIESEKIAALRALIACPTTSIGTINRIDLKEAKETFPSKIEENVYYCGYHSKDSFGAFSYLILRENGNILVDSPRFVSSLADKIESLGGIRYHFLTHQDDVADHQKFKEKFGCDRIIHENDLKSLPSAEIVLKGEKVFELDNEVKMIPVPGHTQGHSVLLYKNRFLFTGDHLAYDPLKDRLIAFKNVCWYSWQEQINSMKKLKNYSFEWILPGHGYPVNKEQKIMLDLLKSCIVWMETR

SEQ ID NO: 25302 - protein, 473 aa, Leptospira interrogans serovar Copenhageni str. Fiocruz L1-130
MKMNSFSASYKNLGRTVRTLHHLAHTFYRNIRPSLLNSMILKLAVPVVFGMLSQTVVWVTDTMMVGRLGKHSIASIGIGGIAHFTVLAFLMGFSMGIQVIVARRFGEKNDSEIGKIGVTALYLVIVFGSILSIGGATISEWLMNLLNKDEIVRRLSSEYLYFRFLGTIFFFLLFTTRAFTDGLGITTAGLASMIITCFTNIFLNWMLIYGNLGFEPMGVKGAAIASSLAGGAGLFAFPFYFYSKDLGKYFSHISWVFSWDHFREILKASTAPALAELLNNISFMIFTEFATIVGTTALAVTNMLFSTLSLSFLPGYAFGIAATTILGQALGAGKPKLAYHGAFRSAFFAACVMGSMGLVFIFWGKDMLSFYTKDQELIEEAYSPLLILGMIQVVDAYHMVIACALRGAGLQDFVFRAYTAASYLVFLPSAYFMGIYLGMGSAGLWSGIVAWVLVLASVFVVRFRRKDWVQNPV

SEQ ID NO: 25303 - protein, 162 aa, Leptospira interrogans serovar Copenhageni str. Fiocruz L1-130
MDKPYRKNVGMVVFNSRGEVLVGERLNFLGSWQFPQGGIDDDEDPIKAAMRELYEEVGIDSGKIVAEYPDWISYDFPENLPLNRHLQKYRGQLQKWFLIYWDGEVDQCDLDIHEREFGTVRFIPIKNTLNTVVPFKKDVYYKIVNDFEPKIQNFLQDIGNRS

SEQ ID NO: 25304 - protein, 443 aa, Leptospira interrogans serovar Copenhageni str. Fiocruz L1-130
MISPLRWLLPAKAKPLLSKELIDRSYPRFRWRILEATFIGYATFYLVRNNFPVISKEMGEALHYSQEQITNILAVTAITYGIGKFLMGILSDRSNPKYFMPLGLILTAICNLFFGASNQYEIHFYLWALNGLMQGMGWPPCGRSLGHWFGVSERGSKFAIWNIAHNVGGGLVGIIAAYSASWWGWRNAFYIPALIAIVTAIYLLFRLVDTPQSVGLPPIEEYQKDPEKEVRLSIQEQEKELSFREIILGSVLKNHYVWTFAFANFFVYVVRYGLTDIGPTYLKLSKGASLEKGGISTLIYEFAGIASTLLVGWGSDKLGGKRGMVSLLCMLPILFALISLLFTPLGFLWLDLVLFGIIGFFIYPPVMLLGVAGLDFTSKKAVGAAAGFIGLFGYLGRTILSKSVGWLSKQTGFHWEQPMYLMIGATLISIALLAITWNWKPKA

SEQ ID NO: 25305 - protein, 273 aa, Leptospira interrogans serovar Copenhageni str. Fiocruz L1-130
MKRSMSFIITFLLSFIFLILFLIWWNQERLIFFPEKLSENFIFHFPNEFKEIKLTTPDGEKSYGLFFPSKNNLSKKTILFFHGNAGSLRTWGRIYEDFLPIGWNLLITDYRGYGKNSGSISEESMNSDAELWLSYLLNEIKIPRNEIVIYGRSIGTGVAIDLVSKNPDLNLFLETPFIDLFTLARNYYPFIQAWMLKFQFQNLAKLKNIRSKIRIFHGTQDPIIPYSNSEIIFKKLKEQNQDVILFTISNGSHNDLTIYPEYHRALKNSLDEL

SEQ ID NO: 25306 - protein, 183 aa, Leptospira interrogans serovar Copenhageni str. Fiocruz L1-130
MKKINSDILHPRFSREDISQKVKSLALQISEDYKKLNPIFICVLKGGVYFFTDLTREIPFSVEINFVQARSYSGTVSTGKIELLKDIDIDLSDRHVIIVEDILDTGFTLQYLVRHIFTRNPASLEIVTLLLKERKDTLEFPVKYIGWRIPDEFLVGYGLDFDGRYRNLPDIHVLEPGEPQFPV

SEQ ID NO: 25307 - protein, 165 aa, Leptospira interrogans serovar Copenhageni str. Fiocruz L1-130
MRFDMNDTLYDLTATLNNGKEQKLENYKGKVLLIVNTASECAFTPQYAGLQNLYSKYKTEGLEILGFPCDQFKHQEPGSDETIKNFCQKNYGVEFPIFKKIEVNGDNAHPVFRFLRNKASGFFGNSIKWNFTKFLVDKQGNVIKRYSPITTPENIEKEIQNLLKR

SEQ ID NO: 25308 - protein, 467 aa, Streptomyces aureofaciens
MPTPEAGSASGREAVRFPVVDPATGETFDEAPDQQPGELDDVVARAQRAWHGWRADPAARTAALRGAADAVETAGDDLARLLTREQGKPLAESYAEIARTAARLRYFADLAPRTRRIDDGRPVHSEVRWRPLGPVAAIVPWNFPLQLAAAKFAPALAAGNTVVLKPSPFTPLATRMLGSVLATALPEDVLTVVTGREPLGARLASHPGIRHVTFTGSVPTGRAVAGAAAASLARVTLELGGNDAALLLDDVDVDRIADRLFWAAFRNCGQVCMAVKRVYVPARLHAEVVEALAQRAKTVAVGPGLDPGTRLGPVNNARQLARVEQVTEQALADGARAAWGGHRLDGPGYFFAPTILTDVLPGSPVVTEEQFGPVLPVLPYRSLDEAVDAANSTGFGLGGSVWGTDLDQAETVADRLECGTAWINHHAELSLAQPFAGVKDSGVGVAGGPWGLYGNLRPFVVHRPQEV

SEQ ID NO: 25309 - protein, 421 aa, Arabidopsis thaliana
MGSRDLISSLPDEILGKVLSLLPTKRAASTAVLSKRWNNLPALVDKLDINDAIGGPGGFPEFIDKTLALLTNSTTIKRTSLNNEFQYGESQVNTWIRSFLERGCLQLYLNAQSLYTIDTEFFTSNTLVELTITGGFSPDGLLPPGGVFFPKLKTLSLVLMTFVDSDMYELFISGCPLLEEFLLRNDEIEIPPVWNALVSSPSIKRLTIVHHFPNYREAHDGCWFRTPNLVYLDYSSYVPDWYEVDLGSLVEARLDLRSWERLRDEKAGGYGDCDSVYDDEEYPDDPILGDVTNLVTGLSNIKTLHLSPDSLEGLVHQVTRRCGDACPCIPKRMKKKKKELGICCLSTCQVKVLHISGYQGTCRELKQMRHFLGNLKCLETVNVGVEMNHREDNDVDNKYLRITDALMKLPRVSSNCRIHFF

SEQ ID NO: 25310 - protein, 500 aa, Mesorhizobium sp. BNC1
MELQDYAQHIGGEAVAAADGETYITHNPANGRPWGRFPAGKSADVARAVAAAMEALRGSWGSMAPTRRGRLLIEWARAISVNAEKIARLETAQNGKIFRDCLNQARDLENWLYYYGGQADKIEGTVVPLLRQSILNYTLREPLGVIGIITPWNSPASLTMSSAAPALAAGNAIVIKPSEVTPASILEIARLAEEAGIPKGVINVVTGGRNAGEALVDHPDIAKIAFTGSVEAGRAIAERAGKRLIGCTLELGGKSPNIVFPDADLARAEAGVLGGIFASTGQTCVAGSRAYVHESLFDSFVERLATRARQIVLGDPMDPRTQMGPVSTELQLQKDERLVAEALSEGAVKIAGGERVSPPGCEDGYFYAPTVLTKLNPAASILKTEVFGPVLSVLPFKSEDDVVAMANDSPFGLAAGFWTRDFARAHRLARRLEAGTVWINMYRAFAFNSPMNGHKQSGIGWQNGSEAIFQYLKTKSVWCETDEDYGDMFARAQPASTGRE

SEQ ID NO: 25311 - protein, 499 aa, Mesorhizobium sp. BNC1
MNRFELPSSKLYIGGRWEEGSGAEIVSIFSGDGSVNRVIKGASRADGERAIERALKAQSDPAWRNLKPHERARFLHRIADGIETNAARIAFIQTRDTGKTLRETTALVASAAGTFRYFAGALESLDDTLTAPRGDYLSMSVHEPLGLVSAITPWNSPIASDAQKVAPALAAGNAVLLKPASWSPLVSLELARIVEAAGLPQGLFSVLPGAGREIGNLLVEHPAISRVSFTGGTATGRMLARQAAEKLMPISLELGGKSPTIVFADADIDLAIAGILFGVFSSSGQSCIAGSRLFVERSIYESFVDRLVAATKKLVVGDPFDERTQVAPLVHFDHRDAVAAQVAAAVEAGAEVLCGAAIPTGADYDRGAYYLPTILAGLENDDPICREEVFGPVLCVLPFDDEADVIAQSNANDYGLACGIWTRDFPKAWRTARAITTGTVWINTYKQFSISTPFGGEKDSGMDREKGREGIRAYMAQKSVYVDLTGKPHPWARWPEAGA

SEQ ID NO: 25312 - protein, 356 aa, Mesorhizobium sp. BNC1
MGSVELRGVKKRFGGHTVIHGVDLAIDDGEFVALVGPSGCGKSTLLRIVAGLEDASEGEVSIAGYVVNDLTPRERNIAMVFQSYALYPHMNVAENMAFNLKLSGKSKAEIEQRIAEAARMLDLSTLLKRRPSQLSGGQRQRVAMGRAIVRNPSVYLFDEPLSNLDAKLRVQMRSEIKALHQKVHTTAIYVTHDQIEAMTLADRVVVLNGGRIEQAGRPMELYRRPENLFVAGFIGSPAMNFIDATGTLTPDGPVARLGDGTEIRLERALPVKEGQPLVIGLRPENLALNGEGTALSGPIQLIEPTGAQTHIVFKLAGQGIASVVDGSLEFGFGENFKAAIAPALVHVFDKATGRRV

SEQ ID NO: 25313 - protein, 510 aa, Mesorhizobium sp. BNC1
MKDVLEELERRRAAAREGGGKARIAHQHAKGKLTARERLEVFLDEGSFEEFDMFVEHRSTDFGMEKTKIAGDGVVTGWGTVNGRAVFVFAKDFTVFGGSLSEAHAEKVMKVQDMALKNRAPVIGFYDAGGARIQEGVAALGGYAEIFQRNVLASGVIPQISVIMGPCAGGDVYSPAMTDFIFMVRDTSYMFVTGPDVVKTVTNESVTAEELGGAHVHTVKSSIADGAYDNDIEALLQMRRLVDFLPSSNTADIPDIEFSPGDGEPDHSLDRLIPTNANKPYDIKELILKTADEGDFFEIQEHFARNIVTGFGRIEGRTVGFVANQPMVLAGVLDSDASRKAARFVRFCDCFNIPIVTFVDVPGFLPGTSQEYGGLIKHGAKLLFAYAEATVPKITVITRKAFGGAYDVMASKHLRGDINYAWPTAQIAVMGAKGAVEIIFRKDIADVEKIAEHTRKYEERFLSPFVAAERGYVDEVIMPHSTRRRIARALRMLRGKDLQNPWKKHDNIPL

SEQ ID NO: 25314 - protein, 256 aa, Mesorhizobium sp. BNC1
MSSDEPIVSAVDVHKSFGNNKVLKGINMEVSTGEVVTVLGPSGSGKSTFLRCINQLEEIDSGAIFVDGEQMGFELRGDRLYHLPDSAVRRQRRKIGMVFQNFNLFPHMTALQNVVEAPIGIHGRDKTEAREEAMELLQRIGLAEKANSYPRQLSGGQQQRVAIARALAIKPRLLLFDEPTSALDPELVGEVLTTMRNLAEGGLTMLVVTHEISFAREAAHRVVFMDGGVVVEDGKPDEVLNNPQQARTRQFLNRFI

SEQ ID NO: 25315 - protein, 223 aa, Mesorhizobium sp. BNC1
MEASRPVKIAPSILASDFSRLGEEVTAVAAAGADWIHLDIMDGHFVPNITFGPPVVKAIRDRTNKVFDCHLMIAPADPYLAAFAEAGCDVLTVHAEAGPHLHRSLQTIRKLGKKAGVSLNPATPESAIEYVLDDVDLILIMTVNPGFGGQAFIPSAVKKIRRVRQMVGNRPIDIEVDGGITAENAGAVVAAGANVLVAGSSIFKGNGEDAYRQNIAAIRTAVE

SEQ ID NO: 25316 - protein, 289 aa, Mesorhizobium sp. BNC1
MGPSALRVAGLVEALSELGHTVEDLGNVSPKLQSPLAHPNSVLRSLSEIAGWTAALAEAAYRASADALPIFLGGDHSISAGTVSGIAQRAAELRRPLFVLWLDAHTDFHTLDSTVSGNLHGVPLAYATGQPGFDGYFPPLMAAVDPFRTCVMGIRSIDPAERIAINEAGVTMYDMRAIDEHGVAPLLRAFLERVASQDGLLHVSLDVDFLDPSIAPAVGTTVPGGATFREAHLVMEMLHDSGLVSSLDLVELNPFLDERGRTATLMVDLASSLMGRRIMDRPTRSYSHG

SEQ ID NO: 25317 - protein, 396 aa, Mesorhizobium sp. BNC1
MQVIIIEGPMDMKKEDISTIGRRSFLGVAATMAVAPVLIGATSKAWAQAGGPDGSIAASSSNSRNLGALEVSSVGLGVQNMARTYQTTIPSRPEMINIIRTAHERGVTFFDTAEAYGPHECERILGEAIAPFRDEVVITSKFGWNIDLDTGERRPGLISRPDHIKLAVEGMLERLRTDRVDLLYQHRVDPEVPIEDVAGAIKDLMDEGKVLHWGLSEMGLNTLRRAHAALPVSAVQSEYSMLWRGPEDEVLSVCEELGIGFVPWSPLGVGFLTGAIDERTRFAEGDIRGIESRFSPDNLPANLALVRLLGEWADRKQATRAQIALAWLMAQKPWIVPIPGTTQMAHLLENIGAASVSFTPEEIGELNSAVAAIEVRGQRLPDAVLAFSNVEAPERN

SEQ ID NO: 25318 - protein, 327 aa, Mesorhizobium sp. BNC1
MERRYLGDLEVSALGLGCMGLSHGYGPAVEKKDGIALIRAAVERGVTFFDTAEVYGPFTNEELVGEALEPVRDRVVIATKFGFDIGGDNKERPLNSRPERIKKVADASLKRLRTDRIDLFYQHRVDPDVPIEDVAGAVRDLIAEGKVKHFGLSEAGVGTIRRAHAVQPVAALQSEYSLWWREPEKDVLPTLEELGIGFVPFSPLGKGFLTGAINADTQFASDDFRANVPRFSEENRKSNQALVDLLGQIAAEMGVTSAQIALAWLLSQKPWIVPIPGTTRLHRLEENISAANVALTADDLSRIEAALSNITVQGARYNAAYQALVGR

SEQ ID NO: 25319 - protein, 294 aa, Mesorhizobium sp. BNC1
MTKIAFIGLGNMGNPMAANLVKAGHEVNGFDLLPENLAKAEKSGVFRAENAQKAIEGADAIITMLPAGKHVLTVYEDILAKAAAGTLFIDSSTIDVASARVAHLMARKHGHLSVDAPVSGGVVGAEAGSLTFMAGGSAEAFAKAEPILKPMAGRIVHCGDGGAGQAAKICNNMILGISMIGVAEAFVLAEKLGLSHQALFEVASASSGQCWSLTTYCPVPGPVPTSPANRDYQPGFATSLMLKDLRLAQEAAQTAGAVTPLGAEAAQIYALFDAMGQGGRDFSGIISLLRGTTK

SEQ ID NO: 25320 - protein, 315 aa, Mesorhizobium sp. BNC1
MPSKTIDHAFTARQITGAAGDPTYAGALSFMRRKFTKDVKGADAVVWGIPFDAAVSNRPGARFGPQAIRRASVIFDNDPQYPFHLDLFDTLAVVDYGDCLLDYGRHDLTPAAIETEASKILESGAFLVTLGGDHFVTWPLLRAHAARHGPLALVQFDAHQDTWWDDGNRIDHGSFVGRAVRDGVIDPARSIQVGIRTHAPEDCGLKIVHGYDLEEIRAAEIARMIAERVGDAPAYITFDIDCLDPAFAPGTGTPVAGGPSTAKMLSILRQLGGLNIVGADVVEVSPPYDHADVTAIAGASIAMHYLGLLAEKRRP

SEQ ID NO: 25321 - protein, 388 aa, Mesorhizobium sp. BNC1
MASDKSGGINTRLAHMGNDPLSFHGFVNPPVVHGSTVLFPDSATMASRSQKYTYGTRGTPTTDALATAINELEGSAGTIIVPSGLAAVTVPLLAFLSAGDHVLIVDSVYHPTRRFADTMLKGFGVEVEYYDPLVGGEIEALMKPNTRVVFTESPGSNTMEIQDIPAIAAAARARGAIVMMDNTWATPLLFRPLDHGVDVSIHAATKYPGGHSDVLLGTVSANESSWERLHDAFITLGTCAGPDDVYQVLRGLRTMGIRLERHQESALEIARWLEGMPGVARVLHPALPSHPGHAIWKRDFSGASGLFSFVLSGGGEKEAHAFLDTLKIFGLGYSWGGFESLAVHVSLADRRVAKGNFPGPVIRLQIGLEDAADLKADIENGLRATGLR

SEQ ID NO: 25322 - protein, 499 aa, Mesorhizobium sp. BNC1
MKSLEGSRQELFIGGRFRAPSSGRFIPSFDPTTGEVWYEFAEADAADVDAAVTSATKAFHNPAWRRMTQTDRGKLIRRLAELVLEHADELALMETRDNGKLIKEMMAQMRAMPDSYIYFAGMADKLQGDTIPVNKLDSLNYSQREPLGVVGMITPWNSPLMLLTGTLAPCLAIGNTVVVKPSEHATASTLALAELVVEAGIPEGVVNVVTGTGAVTGEALTRHPGLAKIVFTGSTATGRRIAANAAENLIPCQMELGGKSPHVVFSDVDIERAVNGVVSGIFAAAGQTCVAGSRCFVEANIYDRFLEALVERTRHIRVGHPMEESTDVGPLAMKSQLEKIEGYVASGARDGAKIAVGGRRPKDGDLARGWYFEPTVMADARNDMKFMRDELFAPVVGVMPFRDEAEMITLANDTEYGLASGIWTRDIDRAMRFASQIDAGTVWINTYRSAAYMSANGGFKNSGYGRRGGFDVMREFSRSKNVLIDYSGAMQDPFVIRLK

SEQ ID NO: 25323 - protein, 2679 aa, Mesorhizobium sp. BNC1
MTQSVLPDIAAIDENVGRIAIVGMSGRFPGAPSVDALWDLVSKGKHAFAHFRPEELEDAFEDAVRASKDYVPARPYLDDVDLFDAEFFGMYPRETALIDPQFRVFLEICWEAIEGAGYDPYSLPGQVGVFAGSALSTYLINNVLSDREKAEAFASNYQVGMFSELIGAINDTLATRVAYKLDLRGPAFTIQSACSTSLLAVAQACQNLLTYACDMALAGGVSITFPQKRGYIHQEGGMVSQDGFCRPFDADAGGTVFGSGAGVVLLKRMEDALKDGDHIHAVILGYGVNNDGSSKVGYTAPSVDGQAEAISAAHASAGIDPGTIGYIECHGTATPLGDPIEFAGLRKAFGDASMGQSVCALGSVKGNLGHLDAAAGVTGLIKAVHALKHAKIPPMANFQNPNPRIKLEDSPFYIPRELHDWPAQDHPRRAGISSFGVGGTNAHLVAEEAPPSPDLQEEEKEENSSFIIPLSARNESSLRAARRNLAAMLKSGPHMPIAAVAHTLQHGRHHFSHRAAVIAGNIEEAIAGLEGERPITGKATETSPPVVFMFPGQGAQYVGMGLGLYEREPEYARWIDHGARLLEEQAGIDIRKFLCRNNVQGEELSAALKDTRITQPALYLVEYAAARLWMSRGLKPDAMIGHSVGEFVAATLANVMTFDDALLLVAARGQLMQEQPKGAMISVRADAETVRDFLDDGVEIAAINAPKLCVVSGTFEAADVICKKLEAADIAFSRLHTSHAFHSAMMNEAAAALREQTDKIAYGRATIPYISCLTGEWQTDELGTSPEYWARHCRDAVRFAEGLVTVCRDRKPALLEVGPGRTLSTFAAQTIGRSDLAAVIQSLPEHDRASQAASAFAEAHARLWVAGCTLEWPALPAEARRRVPLPTYPFERRRHWIDPPPPIRRAIPNVEASPTGQAASQDGPPYPTPSFGNTPMNAVTPAPSPSRIEKLENALLARLAEMSGEEMTPDALCATFLELGFDSLFIGQFAQKIEKEYKVKLSFRELLGNIPSVSALARHLDKEMPPEAVQQPLPAQTAQGPGQAVSSPARQQQAITAPPPTAGAVDAIFQSQMLMMQQLFAQQIQALQAMGGAQAAQPPEELPAPTAQAPAALPPSSVPAKMADREIGGERLRLHKPGARASDGELSPEKRKFIADLAESYAARNARSKAFTAAHRSRLADPRTAAGFRPEWKELVFPIVSDRSKGSRIWDIDGNEYIDLVNGMGQTAFGHAPDFVVDAIRAQTEKGFAIGPQTPLAGEVADLISKMTGHERVTFCNTGSEAVMAAMRVARAVTGREKIVVFGNDYHGQFDEVLVKGRTRNGSPVALPIAPGIPPSSLSNMTVLSYGSSESLDWIRANAEDVAAVIIEPVQSRHPELRPVEFVRELRQIANEREFALVFDEVVTGFRVHPGGIQAVWGIRGDMATYGKVLGGGMPIGVLAGDSRFMDALDGGRWNYGDDSAPMVAPTFFAGTFVRHPLVLAAAKAVLRHLEGDGQALYTRIADRTKLLVDELSADLAARGIEGCINHYSSWFVTDFSSRDPLGMLFYPKARMLGLHIQDGYPCFLTTAHAEEDFRRIAEVFRETLDALQRVGILAPAGERASPQPAPVARPAAENVITSAGLTESQKEIWLAAQAGDEASCSFNESFSLNLQGTLDKEIFVQAIEMVVARHDALHIRFSRAGDRFEMIPDFRIPLETIDLTHNNTPEAALEEIVAEEASTPFDLANGPLARARLLSLAQDRHVLIFTAHHIVCDGWSANVILEELASAYTALCDGRTPDLPPALSFAAYADDVAAREAQPATEEFWLKQFETIPELPEMPTDRPRPEQRTFAGGTCTAFVEKDVYKRLKMAGAKSGATLFSTLLGALQVMISRLSGSTDIIIAIPSAGQSLVPDQTLVGHCVNLLPIRQQIDAEARFEEHLRQTQQLVLQAFEHQDYTYGTLVRKLGLKRDPSRLPLTEIQFNLERVARNAVFKGLSAKVTPNPKAFSNFDMFLNMVEGNDGIRIDIDYNGDVFDRATIERWLGHFTILVSVLADGMGAKIADLPILSENEMRWLIEELNETDADYERDRFMFELFAAKAAEQPKAIAAVHEGKSITYGALEARSNQLARHLQTKLSMPGLRVALALDRSIDMLVALLAIMKAGHTYVPLDPGHPPARLAQTMKTARVSGVICASGEIGKLGEPDTSVIRMDTESEEIARQDSRPLDLQLLDTEAPAYVIFTSGSTGTPKGVEISHRALVNFLSSMAMEPGFSSEDTLLAVTTISFDIAGLELYLPLIMGGRVVIANRTEVQDGFALVKLLRASGANVLQATPTLWQMLVEAGLSNQPKLKMLCGGEPLPKDLARKLLTIGGELWNMYGPTETTIWSSVARIVNADDPIHIGRPIANTQLYILDGHDRIAPVGVTGELYIGGEGLANGYFDRLDLTQAAFRSVRIGDGLPRRLYKTGDVGRRLPDGTLQLHGRRDNQIKLRGFRIELGEIEAVIGKKAGIRQCAVVAARNKNGDRQLVCHFVPDGQELSPDELSTHAKEHLPAHMVPSFWVATADLPKTANGKLDRKTLEERGVPQRHSAAPVRIKPRTPMEQKLSVIWQEVLQVGEIGIHDNLYALGADSLSIFRIAARMMDDGLPLEAKHLMRHPTVAGLAGFAEEQGNAAANGAVAPIPSLRDFRHGARRRLERLT

SEQ ID NO: 25324 - protein, 388 aa, Mesorhizobium sp. BNC1
MAENNEDMRTTLVHAGRGPQYRGNTVSPPVHRASTFLFDTLAEMDQASKTPFRGVFYGRNGTPTSVAFEDAMAKISNAHGAIATASGVSAIMGVMLGLLNSGDHVLIPDSVYDIVRRSADGMLARMGIEYEYYDPVVGAGIESLLRPNTRLIYLESPGSGTFEVQDVPAIVAVAKARNIRTAIDNTWATPVFFRPLELGVDAVIEAGTKYIVGHSDAMLGVVAANELTYGPIRQAIRDFGAVVGTEEANLGLRGLRTMEVRLQRHFAAALEIATWLEGQPGVARVMHPALPSFPGHTLWKRDFSGASGLFSIELANRDPAAMTRFVDSLKLFKIGFSWGGFESLVLPAHPERRKVAVWTGGPVVRFHIGLEAIDDLKADLAAALPLIA

SEQ ID NO: 25325 - protein, 206 aa, Mesorhizobium sp. BNC1
MSGTLILVRHGQSEWNLKNLFTGWRDPGLSELGHEEATSAGRKIKDRGLRPDIAFTSVLSRAKVTNTHILEVLGLPALETIEDVALNERDYGDLSGLNKDDARKKWGEEQVHIWRRSYDIPPPGGESLRDTGARVWPYYLREILPQVLRGKTVLVSAHGNSLRSLAMVLDGLSGEEIVKMEIATGVPIVYRLNPDSTVASKEILEG

SEQ ID NO: 25326 - protein, 398 aa, Mesorhizobium sp. BNC1
MAGFKTLDDLKDVAGKRVLLRVDLNVPVKDGEVTDTTRIERVAPTITELSDKGAKVILLAHFGRPKGKPDAEASLQPIAHAVEAVLDRRVHFASSCIGEPAKKAVDEMTGGDILLLENTRFHAGEEKNDPEFTKALAANGDIYVNDAFSAAHRAHASTEGLAHLLPAYAGRTIQAELEALQRGLGDPKRPVVAIVGGAKVSTKIDLLTNLVKKVDCLVIGGGMANTFLAARGTSVGKSLCEHDLRETAKQIMIDAAEAGCAIILPVDAVVARKFEAGAETETVDIDAVPEDAMILDVGPKSVEKVKEWLDRADTLVWNGPLGAFELSPFDKATMEVAKYAARRTRESLLVSVAGGGDTVAALNQADVSDDFSYVSTAGGAFLEWMEGKDLPGVAALQK

SEQ ID NO: 25327 - protein, 335 aa, Mesorhizobium sp. BNC1
MTSDEIPDKMTAVAITEHGGPMVLKPEERPVPKPGSGEILIKVRAAGVNRPDVAQRKGVYPPPPGASDLPGLEVSGIVAATGEGVERWHVGDEVTALTPGGGYAEFCVVHETNALPIPHGFTFTEAAALPETFFTVWHNVFERGGLKAGETLLVHGGTSGIGTTAIQVASNFGARVIATAGSAEKCEACLKLGAARAVNYRAEDFVLAVKEATEGRGADVILDMVGGDYIDRNYAAAAMDGRIVQISLQGGSKAEADFSKLMVKRLTHTGSTLRPRTIKFKAHIAAELEAHVWPLLAARKVAPVMDTIFPLREAWRAHERMEEGAHIGKIVLDVV

SEQ ID NO: 25328 - protein, 254 aa, Mesorhizobium sp. BNC1
MHGSDVVLQARDVTVRFGRTTVLDQLSLDVYRGEILGFVGASGAGKSVLLRTILGLIPKQGGTIRMYGQDLAELTDAERLLIDMRQGVLFQHGALFSALTVLENIQVPMREYLDLPRRLMDELALLKLELVGLQRDAANKFPSELSGGMIKRAALARALALDPDIVFLDEPTSGLDPIGAAEFDELVAKMRDTMGLTVYMVTHDLDSLLTVCDRIAVLGNKRVLVEGTVEDMMRSEEPWVKSYFRGKRARQVVR

SEQ ID NO: 25329 - protein, 487 aa, Mesorhizobium sp. BNC1
MGRADRFAAEAGPLESYDLMRNAGAAVTAEILARFADRTGFDVLCGPGNNGGDGYIVARLLHERGLDVRIWRETEPRPGTDAARAAAEWPMRVGTLGNFAPEAGRLVVDALFGAGLAKPVEGVYAEALEKTVAAKSPVMAIDLASGVSGESGKILGTAAPAQVTVTFFRKKPGHLLYPGRTLCGEVVVADIGIPEDVLKTIRPRCRENAPEFWKALLPRPHIETHKYERGHAAVFSGGPSATGAARLAARGAARIGAGAVTLLSPATALAVHAMHLTSIMLKRVEAVDELDVFRRSRKASAYLLGPGFGVSEKARVFAAAVLRSSEEAPAHLVLDADGISAFSEEPELLFAEAAGTPGNLVLTPHLGEFSRLFPDLAADEQLSKLGKARAAAARSGALILLKGPDTVIAAPDGNAVINTNATPYLATAGSGDVLAGMITGLLAQGMPAFEAAAAAAYLHAEAARAFGPGLIAEDLPEMLPEVLKRFL

SEQ ID NO: 25330 - protein, 289 aa, Mesorhizobium sp. BNC1
MAKIAFIGLGVMGYPMAAHLKNRGGHDVTVYNRTTAKAEKWVGEHGGALAETPAEAAKDKDFVFACVGNDEDLRGVTTGPEGAFRTMKQGSIFIDNTTASAEVARELAADAEKRGCSFIDAPVSGGQAGAENGALTVMCGGDKAAFEKAKPVIEAYARMVGLMGPSGAGQLTKMVNQICIAGLVQGLAEGIHFGKKAGLDIEQVVGVISKGAAGSWQMENRHKTMNEGRYDFGFAVDWMRKDLEICLAEADRNGAKLPITALIDQFYKEVQEMGGRRWDTSSLLARLER

SEQ ID NO: 25331 - protein, 506 aa, Mesorhizobium sp. BNC1
MTNHMFDAIATAANRREAPFIFTPSGRVWTYGDLLDFSARMANRLVTLGVKPGDRVAVQVEKSPEALILYVACLRAGAVYLPLNIDYTQAELEYFIGDAEPALVVATPSAGAGIASLARQHGGRVETLDEFGGGSLVADLAAPADFADIPRGPDDLAAILYTSGTTGRSKGAMLSHDNLLSNAKTLISHWRFTAGDRLIHALPIFHTHGLFVASNVIMLSGASMDFLPKFDPKAVLGLMETATCLMGVPTFYTRLLESEALSAEKTANMRLFISGSAPLLAETHHAFAERTGHAILERYGMTETNMNTSNPYDGERIAGTVGFPLSGVSIRITDPESGAVLGTGEIGMIEIKGPNVFKGYWRMPEKTAAEFRADGYFISGDLGKIDERGYIHIVGRGKDLIITGGYNVYPKEVETEIDQIDGVKESAVIGLPHPDFGEGVTAVVVRSPGSTISASDVLIALQGRLAKYKQPKTVHFLPDLPRNTMGKVQKNVLRETFNDIYKAPRA

SEQ ID NO: 25332 - protein, 479 aa, Mesorhizobium sp. BNC1
MTTLHQNLIDGAWVGGEGKENINPSNIKDVVGIYAQASAEETKQAIAAAKAAFPAWSRSGILERHAILRKTADEILARKDELGELLSREEGKTLPEGIGEVTRAGQIFDFFAGAVLRLAGEVLPSVRPGIGVEITREPIGVIGIITPWNFPIAIPSWKIAPALAYGNTVVVKPADLVPGSTWAIVDILVRAGLPKGVLNLVMGKGSVVGQTMLESRDVTAITFTGSVGTGKRVAAASVELGRKFQLEMGGKNPTVVLDDADLKVAVESVTQSAFFSTGQRCTASSRVIVTEGIHDRFVEALAERIRGLKVGNALEPGIDIGPVVDANQLKQDTDYIEIGKQEGAKLVAGGERVQKETEGYFLQPALFTEATNSMRISREEIFGPVASVIRVKDYEEALATSNDTEFGLSAGIVTTSLKYATHFKRNAEAGMVMVNVPTAGVDFHVPFGGRKGSSYGPREQGTYAAEFFTVVKTAYTAAG

SEQ ID NO: 25333 - protein, 426 aa, Mesorhizobium sp. BNC1
MPFTANRQFKQAPRMLVSAKDMHYTTDDGRKLLDGTAGLWCVNAGHCRPKITEAIRHQAGELDYAPAFQMGHPIVFEFASRLVDIAPEGMDHVFFTNSGSESVETALKIALAYHRAKGDGSRTRLIGRERGYHGVNFGGISVGGIVNNRKMFGTLLAGVDHLPHTYLPGKNAFSRGVPEHGVELADELERIVALHDASTIAAVIVEPVAGSAGVILPPKGYLKRLREICDKHGILLIFDEVITGFGRLGTPFAADYFGVVPDIMTTAKGITNGVIPMGAVFVKKEIHDAFMNGPEHMIEFFHGYTYSGNPIACAAGLATLETYREEGLLTRGEELGQHWEDALHSLKGEPHVIDIRNIGLVGAIEMEPIQGQPTKRAFSAFLKGFEKGLLIRTTGDIIALSPPLIITKGQIDEIVDHVREILRSID

SEQ ID NO: 25334 - protein, 115 aa, Tagetes minuta
PNTVNETEEKEPEDKEMTLEEYQKVLEEKRKALETLKTEERKVEVDKELASMQQLSNKKSNDEIFAKLGTDKDKRKELAEKEERAKKSLSINEFLKPAAGERNYTSGGGGRGRVR

SEQ ID NO: 25335 - protein, 367 aa, Cicer arietinum
MAAIEAFSKSLIEEVHKWGCLKQTGVSLRYMMEFGSKPTDKNLLISAQFLQKELAIRIARRAIELETLPYGLSQKPAVLKVRDWYVDSFRDIRSFPEIKNINDEKEFTEVIKAIKVRHNNVVPTMALGVQQLKKGLKPNMVNEDFVEIHQFLDRFYLSRIGIRMLIGQHVELHNPNPPPYVVGYIHTKMSPVEVARNASEDARSICLREYGSAPDINIYGDPDFTFPYVPAHLHLMVFELVKNSLRAVQERYMDSDKVSPPIRIIVADGLEDVTIKISDEGGGIARSGLPKIFTYLYSTARNPLDEHEDLGVADSVTTMAGYGYGLPISRLYARYFGGDLQIISMEGYGTDAYLHLSRLGDSQEPLP

SEQ ID NO: 25336 - protein, 174 aa, Cicer arietinum
NISGGHLNPAVTFGLAIGGNITIITGLFYWIAQLLGSIVASLLLNYVTSKSVPTHGVAAGLSPIAGLVFEIIVTFGLVYTVYATAADPKKGSLGTIAPIAIGFIVGANILVAGPFSGGSMNPARSFGPAVVSGNFADNWIYWVGPLIGGGLAGLIYGDIFIGSYAPAPASETYP

SEQ ID NO: 25337 - protein, 194 aa, Cicer arietinum
DSNMLTVESQRYYHLTFLNQSCLDYIGIGLFSYYQRQQQQQHDSASKTQLASSSTPPQSPQQFSDIPFFSISFKTGNLKTLLLHGGNEPGFESAMRIRVMNFLNISENDYFMVFTANRTSAFKLVADSYPFESCKKLLTVYDYESEAVEAMISCSEKRGAKAMSAEFSWPRLRIQSTKLRKMIVSENKKKNKKK

SEQ ID NO: 25338 - protein, 369 aa, Schedonorus arundinaceus
MVMMVDPPNGMGNHGKHYYTMWQTMFEIDTKYVPIKPIGRGAYGIVCSSINQETNEKVAIKKMNNVFDNRVDALRTLRELKLLRHLRHENVICLKDIMMPVHRRSFKDVYLVSELMDTDLHQIVKSLQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSDSDLEFIDNRKARNYIKSLPYTPGIPLSNMYPQVHPLAIDLLQKMLVFDPSKRISVIEALAHPYMSELYDPAANPPAQVPIDLDIDENIGVETIREMLWQEMLQYHPEAATMVNM

SEQ ID NO: 25339 - protein, 497 aa, Staphylococcus xylosus
MELVKNLSRRQFIDGEWVESSNKETRKIINPFNQEVIFEVAEGTADDSERAILAARRAFEDGEWANETSENRGKKVRAISDLIVKHREELAKLETLDTGKTLEESYADMDDIANVFNFFAGLADKDGGEIIDSPIPNTESKVIKEPIGVVTQITPWNYPLLQASWKIAPALASGCSLVMKPSEITPLTTIRVFELMEEVGFPQGVINLVLGKGSEVGEPLSAHKEVDLVSFTGGIQTGKHIMKNAADHVTNIALELGGKNPNIIFDDADFDLAVDQALNGGFFHAGQVCSAGARIIVHNDIKEKFEAALIERIKNIKLGNGFDEDTEMGPVISAEHREKIENYMEVAKSENATIAIGGKRPEREDLQDGFFFEPTVITDCDTSMRIVQEEVFGPVVTIESFTTEAEAIKLANDSIYGLAGGVFTNDVGKAQRIANKLKMGTVWINDFHPYFAQAPWGGYKQSGIGRELGKAGLAEYQEEKHILRNTNPEPVNWFGKA

SEQ ID NO: 25340 - protein, 296 aa, uncultured bacterium
MSQQQLQSIIQMLKSQPIAGKPSIAETRAGFEQMAAMFPVEADVKSEPVSAGGVKSEWVTAPGADAGRAVLYLHGGGYVIGSINTHRSLAGRISRAAKARVLVIDYRLAPEHPFPAAVEDSVAAYRWMLSTGLKPSRIAVAGDSAGGGLTVATLVAIRDAKLPVPAAGVPLSPWVDMEGVGDSMKSKAAADPMVQKDGLIEMAKAYLGGKDPRTPLAAPLYADLAGLPPLLIQVGTAETLLDDSTRLAERARKAGVKVTLEPWENMVHVFQIFAPILDEGQQAIDKIGAFIRANAE

SEQ ID NO: 25341 - protein, 296 aa, uncultured bacterium
MSQQQLQSIIQMLKSQPIAGKPSIAETRAGFEQMAAMFPVEADVKSEPVNAGGVKSEWVTAPGADAGRAVLYLHGGGYVIGSINTHRSLAGRISRAAKARVLVIDYRLAPEHPFPAAVEDSVAAYRWMLSTGLKPSRIAVAGDSAGGGLTVATLVAIRDAKLPLPAAGVPLSPWVDMEGVGDSMKSKAAADPMVQKDGLIEMAKAYLGGKDPRTPLAAPLYADLAGLPPLLIQVGTAETLLDDSTRLAERARKAGVKVTLEPWENMVHVFQIFAPILDEGQQAIDKIGAFIRANAE

SEQ ID NO: 25342 - protein, 296 aa, uncultured bacterium
MSQQQLQQIIQLLKSQPIAGKPSVAETRAGFEQMAAMFPVEADVKSEPVNAGGVKSEWVTAPGADAGRAVLYLHGGGYVIGSINTHRSVAGRISRAAKARVLVIDYRLAPEHPFPAAVEDSVAAYRWMLSTGLKPSRIAVAGDSAGGGLTVATLVAIRDAKLPLPAAGVPLSPWVDMEGVGDSMKSKAAVDPMVQKDGLIEMAKAYLGGKDPRTPLAAPLYADLAGLPPLLIQVGTAETLLDDSTRLAERARKAGVKVTLEPWENMIHVFQIFAPILDEGQQAIDKIGAFIRANAE

SEQ ID NO: 25343 - protein, 296 aa, uncultured bacterium
MLNDNERSFLDALAKAPMPTDVKGLRAAMDTFTPMMNQNPPEIGALHEAVQIRPGLTADIAVPKGNGPYPVVVYLHGGGWVAGSPRTHRKLGMHFADAGFLTINVDYRLAPEHPFPAGLDDCVHAVKWAGENAKRWNGDSSRLAVGGDSAGGNLTAATVTSLSAENYGGAKPKAALLIYGVFDFPATLKRAGNDVGLDGMAKAYAGSGYPSILEDPRVSPIKSVKPGAMPPSLVICGTADPLLPESHAIADALKRADIRHEVHILEDMPHGFLQMDVLSGCGEGLGKIFDFLRRTL

SEQ ID NO: 25344 - protein, 296 aa, uncultured bacterium
MLNDNERSFLDALAKAPMPTDVKGLRAAMDTFTPMMNQNPPEIGALHEAVQIRPGLTADIAVPKGTGPYPVVVYLHGGGWVAGSPKTHRKLGMHFADAGFLTINVDYRLAPEHPFPAGLDDCVHAVKWAGENAKRWNGDSSRMAVGGDSAGGNLTAATVTSLSAENYRGAKPKAALLIYGVFDFPATLKRAGNDVGLDGMAKAYAGSGYPSILEDPRVSPIKSVKPGAMPPSLVICGTADPLLPESHAIADALKRADIRHEVHIFDDMPHGFLQMDVLSGCGEGLGKIFDFLRRTL

SEQ ID NO: 25345 - protein, 311 aa, uncultured bacterium
MQLDPQMKAILDQAAAAGAQPFHTMTPAQARAAIDTMFQAFRGQPKEVAQSEDRKVPGPAGDIPIRIYTPAGSGPFGALVYFHGGGWVIGNIETHDVTCRDLAHGTPCVTVSVDYRLAPEHKFPAGPEDCYAATKWVSDNARSLNVDPNRIAVGGDSAGGNLAAAIALMARDRGGPKLAYQLLIYPAIDSADETPSHREFTKDGYILSRADMEWFWGHYLADKDRANPYACPSRAKSLAGLPPAFVLTAEFDPLRDEGEAYGQELRKAGVAVTAKRYDGVCHGFVSMASLLDAGKRAVAECCKELRGAIGR

SEQ ID NO: 25346 - protein, 418 aa, Emericella nidulans
MSDLQVQGRKVFKVFNQDFIVDDRYTVTKELGQGAYGIVCAATNVQTGEGVAIKKVTNVFSKKILAKRALREIKLLQHFRGHRNITCLYDMDIPRPDNFNETYLYEELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 25347 - protein, 504 aa, Cynara cardunculus
MGTSIKANVLALFLFYLLSPTVFSVSDDGLIRIGLKKRKVDRIDQLRGRRALMEGNARKDFGFRGTVRDSGSAVVALTNDRDTSYFGEIGIGTPPQKFTVIFDTGSSVLWVPSSKCINSKACRAHSMYESSDSSTYKENGTFGAIIYGTGSITGFFSQDSVTIGDLVVKEQDFIEATDEADNVFLHRLFDGILGLSFQTISVPVWYNMLNQGLVKERRFSFWLNRNVDEEEGGELVFGGLDPNHFRGDHTYVPVTYQYYWQFGIGDVLIGDKSTGFCAPGCQAFADSGTSLLSGPTAIVTQINHAIGANGVMNQQCKTVVSRYGRDIIEMLRSKIQPDKICSHMKLCTFDGARDVSSIIESVVDKNNDKSSGGIHDEMCTFCEMAVVWMQNEIKQSETEDNIINYANELCEHLSTSSEELQVDCNTLSSMPNVSFTIGGKKFGLTPEQYILKVGKGEATQCISGFTAMDATLLGPLWILGDVFMRPYHTVFDYGNLLVGFAEAA

SEQ ID NO: 25348 - protein, 506 aa, Cynara cardunculus
MGTPIKASLLALFLFFLLSPTAFSVSNGGLLRVGLKKRKVDRLDQLRAHGVHMLGNARKDFGFRRTLSDSGSGIVALTNDRDTAYYGEIGIGTPPQNFAVIFDTGSSDLWVPSTKCDTSLACVIHPRYDSGDSSTYKGNGTTASIQYGTGAIVGFYSQDSVEVGDLVVEHQDFIETTEEDDTVFLKSEFDGILGLGFQEISAGKAVPVWYNMVNQGLVEEAVFSFWLNRNVDEEEGGELVFGGVDPNHFRGNHTYVPVTRKGYWQFEMGDVLIGDKSSGFCAGGCAAIADSGTSFFAGPTAIITQINQAIGAKGVLNQQCKTLVGQYGKNMIQMLTSEVQPDKICSHMKLCTFDGAHDVRSMIESVVDKNNDKSSGGEICTFCEMALVRMQNEIKRNETEDNIINHVNEVCDQLPTSSAESIVDCNGISSMPNIAFTIGSKLFEVTPEQYIYKVGEGEAATCISGFTALDIMSPQGPIWILGDMFMGPYHTVFDYGKLRVGFAEAV

SEQ ID NO: 25349 - protein, 110 aa, Lilium longiflorum
MISSANNKGAGTSRRKLRSEKAALQFSVSRVEYSLKKGRYCRRLGATAPVYLAAVLENLVAEVLDMAANVTEETSPIVIKPRHIMLAPRNDVEVEQAVSRCHHLGIRCRP

SEQ ID NO: 25350 - protein, 358 aa, Cordyceps bassiana
MAEFVRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLDGKPLFPGKDHVNQFSIITELLGTPPDDVINTIASENTLRFVKSLPKRERQPLRNKFRNADDSAIDLMERMLVFDPKKRITAAEALSHDYLAPYHDPTDEPVAEEKFDWSFNDADLPVDTWKIMMYSEILDYHNVEAGASGLEDGSVPAQ

SEQ ID NO: 25351 - protein, 380 aa, Pseudomonas fluorescens
MDFNYDDTQKKHAAMIAQVCAEQLAACGNEHSRYFTARQWAICGEAGLLGLSIPREYGGQGLGALSTAIAMHAFGLGCTDMGLVFAAAAHQFACAMPIVEFATAETKRDVLPKLASGEFIGSNAITEPEAGSDSSNLKSRAWPQADGSYRLDGHKSFAGNAPIADIFVTYATTQPEYGALGVSGFIVHRSSAGLRVSEPLDKVCLRSCPAGEVFFDDCRVPEVNRLGEEGQGRQVFQSSMGWERACLFAAFLGMMERQLEQTIEHARTRRQFGKPIGDNQAVSHRIAQMKLRLESARLLLFRACWGMDQGDPGQLNIALSKLAISEGALASSIDAVRIFGGRGCLESFGIEAMLRDSIGTTIFSGTSDMQHEIIARELKL

SEQ ID NO: 25352 - protein, 243 aa, Amoeba proteus symbiotic bacterium
MKMRLVAATVIGLAMSTTMAASAAPDAATTASSATSLTTDMDKLSYSIGADLGKNLKKQGIDISPAAMAKGLQDGISGGQLLLTEQQMKDVLNKFQKDLMARRTADFNKKAEENKTKGDSFLNQNKGKDGVVSLPSGLQYKVIQKGDGAKPSKEDTVTVDYTGTLLDGQVFDTTEKTGKPATFKVSQVIPGWTEALQLMPAGSTWEVFVPAGLAYGPRSVGGPIGPNETLIFKIHLISVKKSS

SEQ ID NO: 25353 - protein, 317 aa, Vigna radiata
MANFPVVDMGKLNTEERGTAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDKVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 25354 - protein, 308 aa, Vigna radiata
PVVDMKNLNNEERGATMEKIKDACENWGFFEVVNHGISIELMDSVDRLTKEHYKRCMEERFKEMVASKGLECAESEINDLDWESTFFLRHLPVSNISEIPDLADDYRKVMKDFAVELEKLAELVLELVCENLGLEKGYLKKAFYGSKGPNFGTKVSNYPPCPKPELIKGLRAHTDAGGIILLFQDHKVSGLQLFKDGHWIDVPPMRHSIVVNLGDQLEVITNGKYKSVMHRVITQTDGNRMSIASFYNPGNDAVIAPAEALVKEDESSKVYPKFVFDDYMKLYAGLKFQAKEPRFEAMKAIDGPIATV

SEQ ID NO: 25355 - protein, 378 aa, Medicago sativa
MAIHHHHQQHTCSLFDALYCDEEKWEDDEGEVVDEGEQSDVTTTNYDILDSTSLLPLLLLEQNLFNEDEELNTLFSKEKIQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDHGVDYKNQLLNVLKTSKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 25356 - protein, 222 aa, Medicago sativa
MAIHHHHHNHQQLQQHTSSLFDALYCDEEEKWEDDEGEVVDEGEQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDPGNS

SEQ ID NO: 25357 - protein, 475 aa, Myxococcus xanthus
MGTSEPVEPDHALSKPPPVAPVGAQALPRGPAMPGIAQLMMLFLRPTEFLDRCAARYGDTFTLKIPGTPPFIQTSDPALIEVIFKGDPDLFLGGKANNGLKPVVGENSLLVLDGKRHRRDRKLIMPTFLGERMHAYGSVIRDIVNAALDRWPVGKPFAVHEETQQIMLEVILRVIFGLEDARTIAQFRHHVHQVLKLALFLFPNGEGKPAAEGFARAVGKAFPSLDVFASLKAIDDIIYQEIQDRRSQDISGRQDVLSLMMQSHYDDGSVMTPQELRDELMTLLMAGHETSATIAAWCVYHLCRHPDAMGKLREEIAAHTVDGVLPLAKINELKFLDAVVKETMRITPVFSLVARVLKEPQTIGGTTYPANVVLSPNIYGTHHRADLWGDPKVFRPERFLEERVNPFHYFPFGGGIRKCIGTSFAYYEMKIFVSETVRRMRFDTRPGYHAKVVRRSNTLAPSQGVPIIVESRLPS

SEQ ID NO: 25358 - protein, 489 aa, Streptomyces coelicolor A3(2)
MSKDAVDTAQVAAHPQATGTIPADAGDAGYSKDLKARHVNMIAIGGAIGTGLFLGAGGRLRDAGPALAIAYLVAGVFAFFVVKALGELVLYRPSSGSFVSYAREFLGEKGAYVAGWMYFLNWSTTGIADITAIALYTHYWSMFTSIPQWVLALVALAVVLAVNLISVKIFGEMEFWFAIVKVATLVGFMLIGIFLLATQHEVSGQTPGMGMITDHGGILPHGVMPVVLVMQGVIFSYAALELVGVAAGETAEPHKIVPRAVNSIMWRVALFYVGSVVLLALLLPSSLYSGDESPFVTVLSGIGVPAAGDVMNLVVLTAAMSSLNSGLYSTGRILRSMAMAGSAPRFTGVMSRSQVPYGGILLTCAVCVLGVGLNYLVPSKAFEIVLNVASLGIISTWVIIMICHLVFVRRARAGLVERPGFRLPGSPVTEIVTIAFLLAVVGLMWNDEEVGRKTVLLVPVIAVMLVAGWFGVRRRVAHQAGQERPAPRE

SEQ ID NO: 25359 - protein, 444 aa, Arthrobacter sp. SU
MDLLNEVRKAPMSRLQIRAVAVAIALMLIDGMDVAVAAYAAPALSKSWSLDPVTLGFLLSSGLFGMAAGSLFLTPFSDKIGRRRMMLVALVLVSAGMTLSVFAGDVVQLMAYRVLAGLGIGGMIANLNVFVSEYSSDKRRGSILGLYTSGFAIGATLGGFIAGPLIPQFGWRSVFVVGAAASILMLAVTWRFLPESLDYLISKRPRNALTQVNAILVQMHRPALSALPELPQDQQIGRGIKDLLTGRMAAQTVLLWVGYGLMISAYYFATTWTPKLIATSSGDDSLGVTMGLLVNFGGIIGCFIFSILAVFLRSRHLLLGSLLISALIYVSFGMTFTQTSLAIFIGAVLGLVTAANVAGFYATTPDLFPPAIRGTGIGWMIGIGRLVSFVSPIVVGYLLAGGWKAENIFMLFGLPLVVSALSMAVVWSLSTKTKPSTPVPTIIS

SEQ ID NO: 25360 - protein, 289 aa, Saccharomyces cerevisiae
MSNESNDLEKNISHLDPTGVDNAYIPPEQPETKHSRFNIDRDTLRNHFIAAVGEFCGTFMFLWCAYVICNVANHDVALTTEPEGSHPGQLIMIALGFGFSVMFSIWCFAGVSGGALNPAVSLSLCLARAISPARCVVMWFPQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWIGPLLGAFLAWSVWQLLQILDYTTYVNAEKAAGQKKED

SEQ ID NO: 25361 - protein, 180 aa, Potamogeton crispus
YMFVQCPAVSSFEWHPFSITSAPGDDYLSIHIRQLGDWTRELKRVFTEACEPPVTGRSGLLRADETTKKSMPKLMIDGPYGAPAQDYRKYDVLLLVGLGIGATPLISILKDLLNNIIKSEEQADSNSDLSRSTDASPWSFDSTSGNRVSPKRKKTLKTTNAYFYWVTREQGSFDWFKGVM

SEQ ID NO: 25362 - protein, 469 aa, Streptomyces coelicolor A3(2)
MAARTKSAKERPSYRCTECGWQTAKWLGRCPECQAWGTVEEYGAPAVRTTTPGRVTTSAVPIGQVDGRQATARSTGVPELDRVLGGGLVPGAVVLVAGEPGVGKSTLLLDVAAKSASDEHRTLYVTGEESASQVRLRADRIHAIDDHLYLAAETDLAAVLGHLDAVKPSLLILDSVQTVASPEIDGAPGGMAQVREVAGALIRASKERGMSTLLVGHVTKDGAIAGPRLLEHLVDVVLHFEGDRHARLRLVRGVKNRYGTTDEVGCFELHDEGITGLADPSGLFLTRRAEPVPGTCLTVTLEGRRPLVAEVQALTVDSQIPSPRRTTSGLETSRVSMMLAVLEQRGRISALGKRDIYSATVGGVKLSEPAADLAVALALASAASDTPLPKNLVAIGEVGLAGEVRRVTGVQRRLSEAHRLGFTHALVPADPGRVPDGMKVLEVADMGDALRVLPRSRRREATREEEDRR

SEQ ID NO: 25363 - protein, 315 aa, Arabidopsis thaliana
MRIDLSVPKVGAELELNKVLGKGSSGSVSLIKYKSRLDGQTLYAAVKTSNIIHADSLLKEFQILSEFKGCSRIVQCYGTKVQETINEEGDVEFTIPMEYASGGSLRHFMSRFKDMKLPDALIRRFTRMILEGLAVIHGHGYVHCDLKPENILVFPSFELKISDFGLSKREGDSKWWLPSHPFAGTPVYMSPESISNGETRRGLDLWSLGCVVLEMYTGKRPWWDKNYDLGDLKKGSMPLISKDIPCDAKLFVMTCFASETNKRKNAFTLLRHCFLRGDVNKIIEPLVKSKNSNDIALELENIEHRLSQLRCISGG

SEQ ID NO: 25364 - protein, 146 aa, Arabidopsis thaliana
MASNIILFEDIFVVDQLDPDGKKFDKVTRVQATSHNLEMFMHLDVNTEVYPLAVGDKFTLALAPTLNLDGTPDTGYFTPGAKKTLADKYEYIMHGKLYKISERDGKTPKAELYVSFGGLLMLLKGDPAHISHFELDQRLFLLMRKL

SEQ ID NO: 25365 - protein, 232 aa, Arabidopsis thaliana
MFVFCLSLEALINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENCQGGEWFHYTCVGLTPETRFKGKWYCPTCRLLPQSH

SEQ ID NO: 25366 - protein, 475 aa, Choristylis rhamnoides
  misc_feature (1)..(9): Xaa can be any naturally occurring amino acid
XXXXXXXXXSVGFKAGVKDYKLTYYTPDYQTKETDILAAFRVTPQPGVPPEEAGAAVAAESSTGTWTTVWTDGLTSLDRYKGRCYHIEPVAGEEKQFIAYVAYPLDLFEEGSVTNMFTSIVGNVFGFKALRALRLEDLRIPVAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 25367 - protein, 468 aa, Pinus peuce
KASVGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 25368 - protein, 468 aa, Pinus chiapensis
KASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAIFARELGAPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAAANRVALEACVQARNEGRDLAREGNEVIREACKWSPELAAASEIWKEIKFEFDAIDRL

SEQ ID NO: 25369 - protein, 468 aa, Pinus flexilis
KASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 25370 - protein, 468 aa, Pinus monticola
KASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 25371 - protein, 468 aa, Pinus albicaulis
KASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHVHAGTVVGKLEGERDVTLGFVDLLRDDFIEKDRSRGVYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 25372 - protein, 468 aa, Pinus sibirica
KASVGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHVHAGTVVGKLEGERDVTLGFVDLLRDDFIEKDRSRGVYFTQDWVSMPGVLPVASGGIHVWHMPALTEIFGDDSVLQFGGGTLGHPWGNAPGAAANRVALEACVQARNEGRDLAREGNEVIREACKWSPELAAACEIWKEIKFEFDVIDRL

SEQ ID NO: 25373 - protein, 468 aa, Pinus contorta
KASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKIHGMHFRVLAKALRMSGGDHIHAGTVVGKLEGERDITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFEAVDCL

SEQ ID NO: 25374 - protein, 468 aa, Pinus montezumae
KASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIIMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDAIDVL

SEQ ID NO: 25375 - protein, 468 aa, Pinus patula
KASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAIFARELGVPIVMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDAIDVL

SEQ ID NO: 25376 - protein, 468 aa, Pinus teocote
KASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRVIFARELGVPIVMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDAIDVL

SEQ ID NO: 25377 - protein, 468 aa, Pinus resinosa
KASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAIFARELGAPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 25378 - protein, 468 aa, Pinus kesiya
KASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEALNKAQAETGEIKGHYLNATAGTCEEMMKRAIFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAAANRVALEACVQARNEGRDLAREGNEVIREACKWSPELAAACEIWKEIKFEFDVIDRL

SEQ ID NO: 25379 - protein, 303 aa, Arabidopsis thaliana
MSSKDKKPSKPSSSRGGIRTLSDLNRRSGPDSDSDSDGPQEYYTGGEKSGMLVQDPSKKDDVDEIFNQARQLGAVEGPLEPPPSSRSFTGTGRLLSGENVPTGNQQPEPVVHNIVFWSNGFTIDDGPLRKLDDPENASFLESIRKSECPKELEPADRRAPVHVNLMRKEEKCPERQKRRVSFQGVGRTLGGSNEGSGSSSPVAPDSAPIPIQTEPAPSQSLVIDETVPTTSIQLRLADGTRLVAKFNHHHTVNDIRGFIDSSRPGASLNYQLQTMGFPPKPLTDLTQTIEEAGLANSVVLQKF

SEQ ID NO: 25380 - protein, 511 aa, Alcaligenes faecalis
MGEEMKTESKKPDSARSELAMKYFQAEYGHFINGEWVGGSSSEKIAMINPANLEVLSYIQSGNAEDVNRAVEAATQAFPKWSRSTPSERQAALYEMARRLRARANDYAAMLSLDNGKPIMEALHIDIPATIGQFELFAGAAFGLHGQTIDATQGVAIIHREPLGVVAQIIPWNVPLVMMATKIAPALAAGNTIVLKPAESVCLAVMEFIREMADLLPPGVLNVITGYGPNVGEALVTHPNVRKVAFTGSRPTAQKLMQYASVNVIPQTLELGGKSANIICADADMDAAAESAAMSIVVNKGEICFAATRHFVHESVMDAFVEKVQNILRKIRVGDPMIPSTQMGPQASRMQFDKVLGYLDIGRNEGATTAMGGKRATVSGFEQGYFIEPTLFTDVRNKMRIAQEEIFGPVGVVIPWKDEAQVIREANDTEFGLAAGLWTKNITQAHRMAREIEAGTVWVNRYFNMIPNVPFGGYKQSGFGREFSLDVLSHYTQLKSVIVSLQEGPIGLFDH

SEQ ID NO: 25381 - protein, 314 aa, Pyrus pyrifolia
MATFPVVDLSLVNGEERVATLEKINDACENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPRFEAMKAKESTPVATT

SEQ ID NO: 25382 - protein, 446 aa, Pyrus pyrifolia
MAIDIEQQQQPSPGLSKIAVSDTHGEDSPYFAGWKAYDENPYHESSNPSGVIQMGLAENQVSFDLLEKHLEENSEASNWGSKGSKGVSGFRENALFQDYHGLLSFRKAMASFMEQIRGGRAKFDPARVVLTAGATAANELLTFIIADPGDALLVPTPYYPGFDRDLRWRTGVNIVPIHCESSNNFQITPQALEAAYKEAEAKNMRVRGVLITNPSNPLGATIQRAVLEEILDFVTQKNIHLVSDEIYSGSAFSSSEFISVAEILEDRQYKDAERVHIVYSLSKDLGLPGFRVGTVYSFNDKVVTTARRMSSFTLISSETQHLLASMLSDKEFTGNYIKTNRERLRRRYDMIVEGLKKSGIECLKGNAGLFCWMNLSPFLDEPTRECELTLWDSMLHEVKLNISPGSSCHCSEPGWFRVCFANMSEQTLGIALTRIHNFMEKRERAC

SEQ ID NO: 25383 - protein, 416 aa, Brevibacterium fuscum var. dextranlyticum
GSAWEWDEQTGQYFLHLFSKKQPDLNWENPEVRAAIYRMMNWWLDRGIDGFRMDVISFISKHPDLPDGAVGKGGIWGDGIPFFGSGPRVHEYLQEMHREVFAHRDADLLTVGEMVDVTPELARLYTDQRRKELDMVFHFEHVGLDHGADGKFSRKALDLVAVKRSFARWQDALSDVGWNSLYWNNHDQPRVVSRFGDDSDHWYESATAFATILHLMRGTPYIYQGEELGMTNMPFTSIDEFRDLESLNYYRQALERDGADAATVLAGITVGGRDNARTPVQWDASVHAGFTTGEPWIPVNPNHGWLNAATQRQDPESVYGWYKRLIQLRHEEPVIVDGRFNLILADDPQIFAYTRTDSDTELFIAANCSADPAALPGDVTEEWDDADVLLANHPGVRELGRTLLPWEVIVLRRGLA

SEQ ID NO: 25384 - protein, 418 aa, Lactobacillus casei
AADKELREGTGAGKDFRGFIDLPVNYDKDEFARIKAAAKKVQGNSQVFVAIGIGGSYLGARMAVDFLSQTFRNLDPDLKFPEVYFAGNSISGTYLADLLDIIGDRDFSINVISKSGTTTEPSIAFRVLKAKLIEKYGKDGAKERIYATTDRAKGALKQEADAEGYEEFVVPDDVGGRFSVMSAVGLLPIAVAGGDIDEMMRGLGDGRKAYASADLKENEAYQYAALRNILYRKGYTTELLENYEPTLQYLGEWWKQLMGESEGKDQKGIYPSSANFSTDLHSLGQYIQEGLRNLMETVVWVEEPNRDLTIPEDANNLDGLGYLAGKKMSFVNRKAYEGVVLAHTDGGVPVMTVSIPKQDAYTLGYLIYFFEAVVSISGYLNGINPFNQPGVEAYKKNMFALLGRPGYEDMTKELNARP

SEQ ID NO: 25385 - protein, 202 aa, Cicer arietinum
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLAANKVVSSETAKAFADEIGIPFMETSAKNATNVEQAFMAMAAEIKNRMASQPANNARPPTVQIRGQPMNQKSGCCST

SEQ ID NO: 25386 - protein, 197 aa, Cicer arietinum
MSGSRFIKCVTVGDGAVGKTCLLISYTSNTFPTDYVPTVFDNFSANVVVDGSTINLGLWDTAGQEDYNRLRPLSYRGADVFLLAFSLISRASYENIAKKWIPELRHYAPGVPIILVGTKLDLRDDKQFFQDHPGAVPITTAQGEELRKLIGAPVYIECSSKTQKNVKAVFDAAIKVVLQPPKQKKTKRKGQKACSIL

SEQ ID NO: 25387 - protein, 204 aa, Cicer arietinum
EINHAIGAEGVLSVECKEVVSQYGELIWDLLVSGVNPGDICSQVGLCSVRSDQSKSAGIEMVTENKQSEMSATDTPLCSSCQMLVIWVQNQLKQKATKERVFNYVNQLCESLPSPSGESVISCNDLSRMPNISFTIGDKPFVLTPEQYVLRTGEGITEVCLSAFIAFDIPPPKGPLWILGDVFMRAYHTVFDYGNLQVGFAEAA

SEQ ID NO: 25388 - protein, 142 aa, Cicer arietinum
FDEILQEADGIILSRGNLGIDLPPEKVFLFQKSALYKCNMAGKPAVLTRVVDSMTDNLRPTRAEATDVANAVLDGSDAILLGAETLRGLYPVETISTVGRICSEAEKVFNQDLYFKKTVKYVGEPMTHLESIASSAVRAAIK

SEQ ID NO: 25389 - protein, 466 aa, Toisusu urbaniana
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25390 - protein, 465 aa, Populus maximowiczii
VGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 25391 - protein, 466 aa, Salix babylonica f. rokkaku
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25392 - protein, 466 aa, Salix chaenomeloides
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25393 - protein, 466 aa, Salix interior
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25394 - protein, 466 aa, Salix nigra
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25395 - protein, 466 aa, Salix pentandra
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEEMMKRAIFARELGVPIVMHDYLTGGFTANTTLSHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25396 - protein, 466 aa, Salix subfragilis
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25397 - protein, 466 aa, Salix subreniformis
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAIFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25398 - protein, 466 aa, Salix tetrasperma
VGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQSETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 25399 - protein, 368 aa, Nicotiana tabacum
MGIQHNEHNQDQTQSFLLDALYCEEERWEETIEDEILEKEATLPLPLPLLEQDLFWEDEELLSLFTKEKETISNFETIKTDPLLCLSRKEAVKWILKVNAHYGFSTFTAILAINYFDRFLSSLHFQKDKPWMIQLVAVTCLSLAAKVEETQVPLLLDFQVEDAKYVFEAKTIQRMELLVLSSLKWRMNPVTPLSFVDHIIRRLGLKSHIHWEFLKQCERILLLVIADCRFLSYMPSVLATATMLHVIHQVEPCNAADYQNQLLEVLNISKEKVNDCYELITEVSYNSISHKRKYESPINSPSAVIDTFYSSENSNESWDLQTSSSIPSTYSPRDQFLPLFKKSRVQEQQMRLTSLSRVFVDYAVGSPR

SEQ ID NO: 25400 - protein, 475 aa, Polygonum cuspidatum
MSPQTETKASVGFKAGVKEYKLTYYTPEYEPHDHDILAAFRVTPQPGVPPEEAGAAVAAESSTGTWTTVWTDGLTSLDRYKGRCYDIEPVPGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIFKSQCETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFVEKDRSRGIYFTQPWVSMPGVIPVASGGIHVWHMPALTEIFGDDSVLQFGGGTLGHPWGNAPGAVANRVALEACVQARNEGRDLAREGNDIIRKAAKWSPELAAACEVWKEIKFEFQAMDTL

SEQ ID NO: 25401 - protein, 450 aa, Streptococcus mutans
MTKQYDYIVIGGGSGGIASANRAAMHGAKVILFEGKQVGGTCVNVGCVPKKVMWYGAQVAETINNYAADYGFDVTTQTFHFDALKQNRQAYIDRIQDSYERGFDSNGVERVYSYATFVDAHTVEVAGEHYTAPHILIATGGHALLPDIPGSEYGITSDGFFELDAIPKRTAVVGAGYIAVEISGVLHALGGETHLFVRRDRPLRKFDKEIVGTLVDEMKKDGPHLHTFSVPKEVIKNTDNSLTLILENGEEYTVDTLIWAIGRAANTKGFNLEVTGVTLDSRGFIATDAFENTNVEGLYALGDVNGKLELTPVAVKAGRQLSERLFNHKPQAKMDYKDVATVIFSHPVIGSIGLSEEVALDQYGEENVTVYRSTFTSMYTAVTSHRQACKMKLVTVGEDEKIVGLHGIGYGVDEMIQGFAVAIKMGATKADFDNTVAIHPTGSEEFVTMR

SEQ ID NO: 25402 - protein, 336 aa, Euglena gracilis
MAQTIPDQTALPDTTNWQLSDLTLKETLGTGTFGRVRLCLHKSSGNYYAIKCLKKSEVLRMKQVEHILAEASILGSIRHPFIVNMLKTFQDDKRLYIVLEYVVGGELFSHLRKAGKFPNDVAKFYAAEVILAFEYIHSMDILYRDLKPENLLLDVGGHIKITDFGFAKKVPERTFTLCGTPEYLAPEIIQSKGHGKAVDWWALGILTYEMLVGYPPFFDESPFRIYEKILEGKVQFPKWVDGRAKDLIKGLLTTDHTKRLGTLKRGVTDIKKHKWFYGVDWDMLLARKIPAPIPVKVTTPGDSRYFDRYPESKEDKSQPLTPAQQELFKGFGPYST

SEQ ID NO: 25403 - protein, 511 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYDNGIYDEFVLPSVITKEDGSPVATIQDEDAVIFYNFRPDRAIQISNTFANEDFRSFDRGEKHPKHLHFVCLTHFSETVDGYVAFKPINLDNTLGEVLSQNNLKQLRIAETEKYPHVTFFMSGGREAEFPGETRILIDSPKVATYDLKPEMSAYEVTDALLAEIEGDKQDAILLNFANPDMVGHSGMLEPTVKAIETVDECLGKIVDAILAKGGTAIITADHGNADEVITLEGNPMTAHTTNPVPVIVTKQGLELREDGILGDLAPTMLTLFLDVAQPKEMTGKTLIK

SEQ ID NO: 25404 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTIGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 25405 - protein, 475 aa, Populus deltoides
MSPQTETKTGVGFKAGVKDYKLTYYTPEYETKDTDILAAFRVTPQPGVPPEEAGAAVAAESSTGTWTTVWTDGLTSLDRYKGRCYDIEPVAGEENQFIAYVAYPLDLFEEGSVTNMFTSIVGNVFGFKALRALRLEDLRIPPAYVKTFQGPPHGMQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQNWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 25406 - protein, 302 aa, Bacillus sp.
ANFNQQGFSTLNGGTTGGEGGKTVTVKTGNELLAALKSKGTNEKLKIVVDGTITPSNTSANKIDVKDTNNVSIVGKGTNGEFNGIGIKVWRANNVIIRNLKIHHSKIGDKDAIGIEGASKNVWVDHNELYNTLNSDKDDYDGLFDVKNDSDYITFSWNYVHDSWKTMLMGSSDNDNYNRKITFHNNRFENLNSRVPSMRFGEGHVYNNYYKNILTTAINSRMGAKMRIEHNVFENTKNAIGSWDSRQVGTWHVINNSYINSTGSLPTSSTGTYNPPYNYSLLNVNNVKSEVVSNAGVGKVNP

SEQ ID NO: 25407 - protein, 345 aa, Bacillus sp.
MLTLKRKVPMLAGVLAVGLVTSLFAPNGEAKAAAKFPESPSIMANFNQQGFSTLNGGTTGGEGGKTVTVKTGNELLAALKNKGTNEKLKIVVDGTITPSNTSANKIDVKDTNNVSIVGKGTNGEFNGIGIKVWRANNIIIRNLKIHHSKIGDKDAIGIEGGSKNIWVDHNELYNTLNSGKDDYDGLFDVKNDSDYITFSWNYVHDSWKTMLMGSSDNDNYNRKITFHNNRFENLNSRVPSMRFGEGHVYNNYYKGILTTAINSRMGAKMRIEHNVFENTNNAIGSWDSSQVGTWHVINNSYINSTGSLPTSSTGTYNPPYNYSLLNVNNVKSEVISNAGVGKVNP

SEQ ID NO: 25408 - protein, 141 aa, Synechococcus sp. PCC 7002
MTFENSPQRSGFEPELGGFLRNDTERSGFEPELGGLLRQKGVYVDETTCIGCKHCAHTAPNTFYIEEEHGRARAYRQDGDAEEIVQEAIDTCPVDSIHWLDYTELKAKEAARKNQVIRPLGFSPGWRVRRSARKPKPSRKP

SEQ ID NO: 25409 - protein, 465 aa, Astilboides tabularis
  misc_feature (103)..(103): Xaa can be any naturally occurring amino acid
  misc_feature (106)..(106): Xaa can be any naturally occurring amino acid
  misc_feature (406)..(407): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSXTNXFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPXXVANRVALEACVQARNEGRDLAREGNEIIREACKWSPELAAACEVWKEIKFEFEAMDTL

SEQ ID NO: 25410 - protein, 465 aa, Bergenia cordifolia
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25411 - protein, 465 aa, Elmera racemosa
VGFKAGVKDYKLTYYTPDYETKDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSYYCRDNGLLLHIHRAMHAVIDRQKNHGIHFRVLAKALRMSGGDHIHSGTVVGKLEGEREITLGFVDLLRDDLIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25412 - protein, 465 aa, Jepsonia parryi
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDLIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25413 - protein, 465 aa, Mukdenia rosii
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25414 - protein, 465 aa, Peltoboykinia tellimoides
  misc_feature (89)..(89): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEENQYIXYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACCVWKEIKFEFEAMDTL

SEQ ID NO: 25415 - protein, 465 aa, Rodgersia pinnata
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIPFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25416 - protein, 465 aa, Saxifraga cernua
VGFKAGVKDYKLTYYTPDYETKDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYAKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25417 - protein, 465 aa, Saxifraga mertensiana
  misc_feature (46)..(46): Xaa can be any naturally occurring amino acid
VGFKAGVKDYKLTYYTPDYETKETDILAAFRVTPQPGVPPEEAGAXVAAESSTGTWTTVWTDGLTNLDRYKGRCYHIEPVAGEENQFIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSYYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25418 - protein, 465 aa, Saxifraga oppositifolia
VGFKAGVKDYKLTYYTPDYETKDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25419 - protein, 465 aa, Sullivantia oregana
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSYYCRDNGLLLHIHRAMHAVIDRQKNHGIHFRVLAKALRMSGGDHIHSGTVVGKLEGEREITLGFVDLLRDDLIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25420 - protein, 465 aa, Tanakaea radicans
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLSYYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25421 - protein, 465 aa, Telesonix heucheriformis
  misc_feature (267)..(267): Xaa can be any naturally occurring amino acid
  misc_feature (377)..(377): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTAXTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHXPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25422 - protein, 465 aa, Tellima grandiflora
VGFKAGVKDYKLTYYTPDYETKDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25423 - protein, 465 aa, Tolmiea menziesii
VGFKAGVKDYKLTYYTPDYETKDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLSYYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 25424 - protein, 462 aa, Mesorhizobium sp. BNC1
MSDFDLIVIGAGPGGYVAALRAAQAGMRVACIDERATAGGTCLNVGCIPSKALLSSTEHWAGLKSLADHGIETEAARVDLSRMMARKDKVVSDLTKSIAFLFNKAGVEFIHGRASIAAPGRVTVGVREISSQHILIATGSAPAVLPNVPFDEKLVLSSTGALSLAKVPDRLVVVGAGVIGLEIGQIWSRLGAKVTVVEYLDRILPGMDGETAKNAQRIFARQGIGFMLNAAVEAVVDNGETAEIKIKSRASGKVEKLQADAVLVAIGRKPHTGGLGLEALRVRRDARGFIEVDEQFRTSVPGILAIGDVVPGPMLAHKAEEDAVACIDALAGKPHCAPDYGLVPGVVYTTPEIAGVGLTEDDASAAGRAVLIGKASFLANGRARAIGTTDGFAKVIACAETGKLLGAHILGHGAGELLQELVLALRFGASLNDVAGTSHAHPGMGEAVKEACLSVLDARSLD

SEQ ID NO: 25425 - protein, 457 aa, Mesorhizobium sp. BNC1
MLYHRAKNSWEQRDQENVFHGFTDLETLNQNGPVVLTHGEGIHVFDVHGKSYMDANSGLWNNVAGFNHKGLIEAICDQARRFPGYHAFFGRIADTTVALSEKLIEISPFPSGRVYYTNSGSEANDTVVKMLWLLHRRNGQPQRRKIITRVNAYHGVTVATASMTGKTYNAEFGLPLPGFLHADCPHHWRYGEPGESEAAFSQRLARKLEELIIKEGPDTIAGMFAEPVQGAGGVIPPSRGYFEAIRPILRKYGIPLIADEVITGFGRTGEMWGGDKYNVEPDAIVASKCITAGYFPMGAIILGPELADALTRACEAAEEFPHGFTSGGNPLGSAIALKALEVIETEGLLDNVRRVSPRFLAGLDRLARHDHAGEARGVGLMGAVELVADKNSKAPLDGALRIPERIANKALEKGLICRPLGQAIVLGPPFIITEGQIGEIFDILEDTMAEVFADVGL

SEQ ID NO: 25426 - protein, 152 aa, Mesorhizobium sp. BNC1
MRQARAGDVVRVHYRGRLTDGTEFDSSDGREPLEFQVGGGQVIAGFEKQVEGMEVGETSTVTIPANQAYGERDERQVQSVPRNTMPDNLDLQVGTRLTATTRDGKQIPLTVTDVNDEQVIVDANHPLAGQDLVFDIELVEIVGSEPGLKFGQ

SEQ ID NO: 25427 - protein, 306 aa, Mesorhizobium sp. BNC1
MILCCGEALIDMLPRETADGEAAFVPHVGGSVFNTAIALGRLEVPVSFFSGLSEDLFGVRLQDTLRASGVDLSHAIISTRPTTLAFVSLNEGQASYHFYDENTAGRMLFEADLPDLDESVEAMLFGGISLAPEPCGGTFEALMTRESPTRVTMLDPNIRQAFIRDPLAHKARMRRMMAIADIIKISEEDLAWFGGPASAGEAAQVLLAAGTRLVVVTSGGKGASAYWRGGSFVISAVNVKVADTVGAGDSFNAGILAALRKAGYLKKSRLASLTTEVVRDALSFATRVAAVTVSRAGANPPWADEV

SEQ ID NO: 25428 - protein, 294 aa, Mesorhizobium sp. BNC1
MNIGFIGLGIMGRPMAGHLIDAGYTVHLNRVKPVSQHLVDKGGRAVATAKAVSEAADVIILMVPDTDDVETVLFGADGVAEGLSPGKLIIDMSSISPVATKAFAERIEALGCDYLDAPVSGGEAGAINASLTIMVGGNPEVFEKTRPLFEVLGKSITFIGPAGSGQITKVANQIVVGLTIEAVAEALTFARVAGADPVKVREALSGGLAASKILEMHGERMIKRTFDPGFRIRLHRKDMSIAVDSARQLGLALPNVALVEQMMNSAIARGDGDKDHSGLVRTIEALAGASPDPE

SEQ ID NO: 25429 - protein, 493 aa, Mesorhizobium sp. BNC1
MSTSARNRFPGVSFDPKALRSNLFIGGAWKEGATGNRIPVYDPSTGTVIAEVADAEVEDVMGAIDAAHEALPGWAATPPRHRSEVLRRCFELMIENRDMLAELISLENGKTLADAQGEVAYAAEFFRWFAEETVRLNGELYKAPSGANRILVQHQPIGVSVLVTPWNFPAAMATRKIGPALAAGCTVILKPATETPLTAYALAALCAEAGVPDGVVNVYTSSRSGKTVSAMLHDPRVRKLSFTGSTEVGRILLREAADKVISCSMELGGNAPFIVFDDADLSAALDGAMVAKMRNGGEACTAANRFYVQSGIADAFAKGLAERMKALAIGKGYETGSQCGPLINKDAVERISGLVEEAQSRGARVLAGGKALNREGYYFPPTVIDNVDPASAIMSEEIFGPVAPIIRFDSEDEVLSAANGTEYGLMAYVYTQDLSKGLRVSEKIESGMVGLNRGLVSDPAAPFGGVKQSGLGREGSHHGILEFTETKYIATNW

SEQ ID NO: 25430 - protein, 462 aa, Mesorhizobium sp. BNC1
MAKSRFQFVCQNCGTVHARWAGKCDGCGEWNTLVEEGTASGIGTGPQALRKARPGRPVALTTLAGDIEDAPRIITGIGELDRATGGGFVRGSALLVGGDPGIGKSTLLTQAAAALASRGHRIVYVSGEEAVAQIRLRAQRLGVANTAVELAAETNVENILTTIEDGKRPDLVILDSIQTLWTDMVESAPGTVTQVRAAAQAMIRYAKSTGAAIVLVGHVTKEGQIAGPRVVEHMVDGVLYFEGEGGHHYRILRTVKNRFGPTDEIGVFEMGDRGLREVPNPSELFLGERSAAAPGAAVFAGIEGTRPVLVEIQALVAASPLGTPRRAVVGWDGARLSMVLAVLEAHCGVRFSTHDVYLNVAGGYRISEPAADLAVAAALVSSVTGLALPSDCVYFGEISLSGAVRPVAHAASRLKEAEKLGFTQAVMPPANEELAGGIAANAFKPEGLADLVARIAGSRVRE

SEQ ID NO: 25431 - protein, 139 aa, Mesorhizobium sp. BNC1
MQASELRFAPPSADKSALEEGRLFTPRFDANGLITAVVTDAGDGTLLMVAHMNAEALAKTLETGIAHYWSRSRSSLWKKGETSGNLQHVESISTDCDQDAVLLKVRVGGEGATCHTGRRSCFYRNVKVEDGRPILTENG

SEQ ID NO: 25432 - protein, 281 aa, Mesorhizobium sp. BNC1
MTPSGAEMAVRVRQADPDRYLATLYAPVEKRGALFALYAFNAEIAAVRERVSQPLPGEIRLQWWQDALENPEDPAAAAGHPVAAALLDTIRAHHLPVETFRNMIEARVFDLYDDPMPSRTDLEGYCGETASALIQLSALVLDPEAAGSTAALAGHAGCAQAIAGLLRLLPIHRRRGQCYIPHDLLQAAGTTRDGIISGEDRAGSARAIAAMVALARHHLSAFTNGAGELPASLRPAYLPLALTKAYLDPIESGAVDPLSESASLSVLRRHWLLLKHAMRGW

SEQ ID NO: 25433 - protein, 367 aa, Mesorhizobium sp. BNC1
MSEALEKPARVTAGVTFAARLAFEAVTHRFAAGQTTLDRVSLVAEPGEVLCLLGPSGSGKTTLLRIAAGIEAQTSGRVLLNDREIAGPDVFLPPEKRSIGLVFQDFALFPHLTILDNVRFGLTALSREEASREALIALRRVGLERYASAYPHLLSGGEQQRVALARALAPRPAVLLMDEPFSGLDSRLKDTVRAETLSILRQSRATAIVVTHDAEEAMRMGDRIALLKGGRLVQVGTAEELYLRPADLFAAGFFSELNLFDARVANGRADTPVGQFAAPGHKEGDSVTVAIRLSGFDVAETGGEIEGRVISRRFLGVVELLELAVPGAEEHVLARVRAGQLPPGVRDVWMNVRRSDVLVFETRRKSA

SEQ ID NO: 25434 - protein, 396 aa, Mesorhizobium sp. BNC1
MTKRFNDDWKPQTRLVHGGTLRSSFGETSEALYLTQGFVYETAEAAEARFKGEDPGFIYSRYANPTVDMFESRMCALEEAEDARATASGMAAVAAALLCSVKAGDHVVAARALFGSCRWIVETLMPRYGIETTLVDGTRMEAWEEAVRKNTKLFFLESPTNPTLEICDIASIAKLADSIGARLVVDNVFATPLLQKPLELGAHVVVYSATKHIDGQGRCLGGVVLSDKEWIDENLHDYFRHTGPSLSPFNAWTLLKGLETLPMRVRQQMESAAHVADYLADHPKVERVIYPGRPDHPQADLVKRQMKGGSTLVCLDIKGGKQGAFAFSNALEIIRISNNLGDAKSLITHPATTTHKNLSEEARLEAGIQQGTLRLSLGLEDTEDLLKDIEQALATV

SEQ ID NO: 25435 - protein, 475 aa, Mesorhizobium sp. BNC1
MLDDSKAGRTNRGGRRTPAFLKNLRGVKGWKEARAWLEWRGIEDIECIAPDQAGVARGKMMPSKKFISNTSLALPSAVFMATISGEYPEDGNGFTYPEDDGDLKLVPDLSTLSVVPWETDPTAQVICDLAHQDGRAVEFSPRNVLRRVVAKYAEHGLKPIVAPEIEFYLVHKNPDPDYPLTPPVGRSGRPIGGGQGYSIAGVNEFDELIDDIYHFSEGQGLEIDTLIHEEGAGQLEINLRHGDPVELADQVFLFKRTIREAALKHEMYATFMAKPIQDQPGSAMHIHQSVVTLKGGRNVFSDENGEETDVFRHFIGGLQQHIPNALIMLAPYVNSYRRLTQAGSAPVNTRWGYDNRTTAFRVPRSDPNSRRVENRIPSSDANPYLALAASLACGLIGILQKIEPDAPAGTAVNTDVINLPRGLLEAVALFEADESLRNIVGDLFASTYAAIKRAEFETFMKVISPWEREYLLLNV

SEQ ID NO: 25436 - protein, 440 aa, Mesorhizobium sp. BNC1
MTYILHRQIHGQLPVAAGGRGVKLFDSAGKEYIDASGGAAVSCLGHNHPDVVAALKRQAEKLAYAHTSFFTNEPAEALAERLVKAAPEGISHAYLVSGGSEANEAALKMARQFFVEKGEAQRRHIIARRQSYHGNTLGALAAGGNEWRRAQFRPLLIETHHIDPCYAYRYRQQGESDEEYGLRAAQQLEDKILELGPDTVMAFIAEPVVGATAGAVPAVSGYFKRIRDICDRYGVLLILDEVMCGMGRTGTLFACEEDGVSPDLVSIAKGLGGGYQPVGAVLLSRQIFDAFAQGSGLFQHGHTYICHPMACAAALAVQEVIERDNLLANVREMGSYLRARLEARFGNHAHVGDIRGRGLFLGLELVADRATKEPFDPARKIHAGVKKEAMARGLMVYPAGGTIDGARGDHVLLAPPFILDKETADTIVDRLGEAIDAALG

SEQ ID NO: 25437 - protein, 401 aa, Mesorhizobium sp. BNC1
MSGSALFDTFARLPLSFERGEGSWLITADGTRYLDFAAGIAVNSLGHAHPHLVAALTEQAGKLWHVSNLYEIPGQRRLGERLAEHSFADKVFFTNSGAEALECAIKTARRYHYVNGQENRFRIITFEGAFHGRTLATIAAGGQKKYLEGFGPKVEGFDQLPFGDLRAVENAITPETAAILIEPIQGEGGIRMPPAQFIQGLRELCDKHGLLLIFDEVQTGIGRTGKLFAYEWTGVAPDIAAIAKGIGGGFPMGACLATEEAAKGMTPGVHGTTFGGNPLAMAVGNAVLDVVLEPGFLDEVSRRGLLLKQGLAAIADTFPDIVDEIRGTGLLLGIRCKSPTSALQQALREEGILVAPAGENVLRLLPPLNVTDEDIQEGLERIHRAMESLVSASSIATATKV

SEQ ID NO: 25438 - protein, 290 aa, Mesorhizobium sp. BNC1
MMIARKTNKISFQGEPGANSDTASRDMFPHMEPLPCPTFEDAFNAVETGKADLAMIPIENTIAGRVADIHHLLPESRLHIVGEYFLPIHFQLMVLPGTDISQIKAVYSHIHALGQCRKIIRKHRWKPMVAGDTAGAARVVAEEKVVSNAALAPRLAADLYGLQIVAENVEDTDNNVTRFVVLSKEKAWAQRKSPDQRMVTTFIFRVRNVPAALYKALGGFATNGVNMTKLESYQLGGKFFSSLFYADVEGHPEDRSLALALEELRFFSHEVRVLGVYEGHPFRDTQSEDD

SEQ ID NO: 25439 - protein, 462 aa, Mesorhizobium sp. BNC1
MATPTDLVAASFRPPAPSPRQTPPSTLQMMRIVYRNPLELWGEPSYNEPWVQLTGGIGGPLLIANDPGLIRHVLVDNARNYKMARVRQKILRPILRDGLLTAEGEVWRRSRKAMAPVFTPRHISGFAGPMLQKAEAFAERYEQAIGGTVDVSRDMTMLTFDILSETLFSGEVAGDPGGFAHQVDRLFETMGRVDPLDLLGAPDWLPRITRILGRNSLAFFRNIVARTMEMRKEKLAGGDAEVPEDFLTLLLRAEGPQGLSRGEIEDNIITFIGAGHETTARALGWTLYCLANLPEERERIEAEIDSVLSSEPDPVKWLDAMPLTRAAFEEAMRLYPPAPSINREAIENDSYSDLKIAAGTQVLVMPWTVHRHRKLWDDPDAYRPSRFHPENREKINRFQYLPFGAGPRVCIGATFAMQEAVIALAVLMSRYRFDLLPETKPWPVQKLTTQPQGGLPMGVSRR

SEQ ID NO: 25440 - protein, 243 aa, Mesorhizobium sp. BNC1
MGENIVDFKGVRKSFGALEVLRGIDLRLEAGEVVALIGRSGSGKSTALRCVNGLEQINAGQLTVCGHHLHVPEVDLRALRREVGIVFQGYNLFPHLTVAQNVMLAPRKVKKIGLGEARDLAGEVLAQVGLSEKLDSYPNQLSGGQQQRVAIARSLAMRPRLMLFDEVTSALDPELTGEVLKTIERLACDGMTMLIVTHEMAFASSVATSIVFMHQGTVWERGSRNLLSQAATPELRQFIGNGL

SEQ ID NO: 25441 - protein, 475 aa, Mesorhizobium sp. BNC1
MFKNYIAGEWVEAEGTENINPSDTSDVVGVYSRATRENVLDAISAAKAAFASWSRSGPLQRHSVLRKAADEIMARKDELGSLLAREEGKTLPEAIGEVVRASQIFDFFAGESLRLSGEIIPSVRPGIGVEITREPVGVIGIITPWNFPIAIPAWKIAPAICYGNAIVFKPADLVPASSWAIVDILQRAGLPAGVLNLVMGKGSVVGQAILESPDVAAVTFTGSTQTGKHVAAASIEHNRRFQLEMGGKNPMVVLDDADLSIAVEAATNSAFFSTGQRCTASSRLIVTEGIHDRFVEAMTQRLSSLVVDNALKPGTHIGPVVDESQLQQDLDYIEVGQKEGARLHFGGRRLERETNGFYLEPALFTEASNDMRIAREEIFGPVAAVIRVKDYEEALAVSNDTPYGLSAGIATQSLKFATHFKQNAEAGMVMVNLPTAGVDFHVPFGGRKRSSYGPREQGRYAAEFFTTVKTSYSLA

SEQ ID NO: 25442 - protein, 344 aa, Mesorhizobium sp. BNC1
MAFGQTRAVSDVSFTVGGGEFFSILGPSGCGKTTILRMTAGFLEPTEGTILIGGRDMRGLGPDQRPTAMIFQSLALFPLMPVWENIAFGLEARGVAKRTRKAKAEELLKLVALEGLGNRMPGELSGGQRQRVAIARALAVEPQVLLLDEPLSALDLKLRQRMRAELRALQKRTGVTFIYITHDQSEALAMSDRVAVMSAGVLQQVGAPRELYDNPATPFVARFVGETNAIPGKVTAIDDGIATIESAYGPLRGRAGNGLSVSMAAKLYVRPEALEQRPDGDGYLRAAIERIDFEGAFALAHGRLPDGSMLIASIPSTELAGAPSIGAPADFSFRPANAVVLSDG

SEQ ID NO: 25443 - protein, 472 aa, Mesorhizobium sp. BNC1
MEKADIGLIGLGTMGANLALNIAEKGFRIAVFNRTTERTHEFAQEAGSLAGNIVPCDTLQALVEGIKPPRPIILMVPAGSVVDEQIAALDPLVARDDIIIDAGNANFRDTRRRMLELAKTGPRFIGMGVSGGEDGARHGPSIMVGGPDESYRRIEPVLEAIAARYEGEACQAWLGPDGAGHFVKTIHNGIEYADMQMIAEIYGILRDGHGLQAGEIAPIFAQWNDGRLNSYLIEITAKVLEASDPDTGKPIVDVILDRAGQKGTGRWSAIEAQSLGIPATAIEAAVAARSLSALKAERETAEKRYGSLAAAMAGSPGADELATLEAALFAGKIVAYAQGFSVMAAASREFGWNLPLGTIARIWRAGCIIRSQFLGAIAEAFDGAPETDNLLMTEAFSQHMEAAHPRLRRVVAKSAEAGLPVPSLSAALAHFDTFRRGRGTANLIQAQRDFFGAHGFERVDSEGSHHASWKRD

SEQ ID NO: 25444 - protein, 471 aa, Mesorhizobium sp. BNC1
MTVTPIIISGGAGSRLWPLSRDAHPKPFIELPDGTSLISRTYGRAARLQGVERIVTVTNRDLLFLTADVYAASDAPRRSNGYLLEPFGRDTAAAVALATLHVNEAEGPDAVLLVLPADHLIADEDAFAEAVGKAVEMAQTGRIVTFGIVPERAETGYGYIEAKGGRVLRFVEKPDAKKAADYVASGRFYWNSGMFCFPARTMLEAMEAHCPEVLVGARAAYRAARKFNADDREVFEIDRDSFAATPAISLDYAVMEKAENVGCIALDCGWSDIGSWSAVAELTPADENGNRLRGEVLLEDTSNSFVHSEHRLVGLVGVSDLLVVDTPDALLVAHKEKAQEVKRLFNRLKEQGHHAAKLHCTAHRPWGTYTVLEEGDRFKIKRIEVKPGARLSLQAHHHRSEHWVVVSGTAKIVNGDQEILLATNQSTYIPCGFKHRLENPGILPLVLIEVQSGDYLGEDDIIRFDDVYGRN

SEQ ID NO: 25445 - protein, 234 aa, Mesorhizobium sp. BNC1
MKAYIAEVFGTFCLVFIGCGSVVLGGFGPLIPTGGALGIAVAFGVAVLAMAYAIGPVSGAHLNPAVTLGAFLAGRLPAKDVAPYMIAQVAGGILGALVLWIIASGKTGGAPANLAANGWSEYTTSAAFLGEVVATFIFVMVILGATSERHTTVMAGAVIGLTLTAIHICFIAVTGTSVNPARSIGPALFSGGAAISKLWLFIVAPLIGGALAGLVYKSHALENTQADLLKKAKA

SEQ ID NO: 25446 - protein, 500 aa, Mesorhizobium sp. BNC1
MAKIIQTPTGAEALTFDDVLLQPGHSEVMPGQTDVSTRIAGDIELNIPILSAAMDTVTEARLAIAMAQAGGIGVIHRNLTPAEQAEEVRQVKKFESGMVVNPVTIGPDATLADAHALMGAHRISGIPVVENGGLGGHTVGKLVGILTNRDVRFASNPAQPVRELMTHDRLITVKESVSQEEAKRLLHQNRIEKLLVVDDAGNCVGLITVKDIEKSQLNPHASKDAQGRLRVAAATSVGDDGFERAERLIDAGVDLLVIDTAHGHSQRVLDAVKRAKMLSNAVRIIAGNVATADGTKALIDAGADGVKVGIGPGSICTTRVVAGVGVPQLAAIMSAVEAGQKLGISIIADGGIKFSGDLAKALAAGANAAMIGSLLAGTDESPGEVFLYQGRSFKAYRGMGSVGAMARGSADRYFQAEVRDTLKLVPEGIEGQVPYKGPAAGVLHQLTGGLRAAMGYVGAHNLRELQEKATFVRISGAGLRESHPHDVTITRESPNYPGAS

SEQ ID NO: 25447 - protein, 307 aa, Mesorhizobium sp. BNC1
MNWITNYVRPKINSMLGRREMPENLWIKDPESGEMVFHKDLEENQWVVPASGYHIKISAKDRLKHFFDNGAYETLENPKAGVDPLKFRDERRYIDRLRDAKAKTNLDDAVVNAIGRIEGLEILATVQDFAFMGGSLGMAAGEAIVRGFETAVERRLPLVLFAASGGARMQEGILSLMQLPRTTVAVDRLKEAGLPYIVVLTNPTTGGVTASYAMLGDVHIAEPGALIGFAGPRVIEQTIREKLPEGFQRAEYLKEHGMVDMVVSRLEMKATIARLLKILLKEQATEENGSRRLPAPEAAVVEAAVNA

SEQ ID NO: 25448 - protein, 281 aa, Mesorhizobium sp. BNC1
MTTTRIDRLFTKLKAENRPALVTYFMGGDPDYETSLSIMKALPVAGSDIIELGMPFSDPMADGPAIQAAGLRALKGGQTLDKTLRMAKSFRQDNDHTPIVMMGYYNPIYIYGVDRFLTEARASGIDGLIIVDLPPEMDEELCVPALRAGINFIRLATPTTDDKRLPKVLENTSGFVYYVSMTGITGSALPDTSKVAGAVARIKGHTKLPVCVGFGVKTASQARAIGAAADGVVVGTAIVNAVANVLGPDGKTTADPAEAVATLVRGLADGVREARITAAAE

SEQ ID NO: 25449 - protein, 460 aa, Mesorhizobium sp. BNC1
MAKYDLDLFVIGGGSGGVRAGRVAASMGKRVAIAEEYRFGGTCVIRGCVPKKLFVYASQFPEHFEDAAGYGWAVGESRFDWATLIANKDKEIARLEGLYRKGLENAGARLIDGRAVLVDSHTVRVGGETFTAEHILVATGGRPNPHVALPGREHCITSNEAFHLEELPASIAIEGGGYIAVEFANIFHGLGVKTTLIYRGREILSRFDGDLRKGLHEAMEAKGIRILCQDIIEQVEKQPDGRLAAHLMSGGVETFDKIMLAIGRVPNTEGLGLEAAGVETGVRGEILVDGYSRTNVENIWAIGDVTDRVQLTPVAIHEAMCFIETAFKDNPTTVDHRDIATAVFSQPEIGTVGLAEEEAGKHFEELEIYRASFRPMRHTLAGRQDKMIMKLVVDAASKRVVGAHILGPDAGEMAQLLGIAIKGRLTKDVFDRTMAVHPTAAEELVTMYQPSYRVRNGERV

SEQ ID NO: 25450 - protein, 426 aa, Mesorhizobium sp. BNC1
MTSHEPASSAPTTTPVRALSMSTIAFTVCFAVWTIFSIIGVRIKEELGLSETQFGLLVGTPILTGSLVRLALGIWTDRYGGRLVYTVTMLAAAIATFLLSFAHTYAHLLLAGLGVGLAGGSFAVGVAYVSRFYPAQKQGTALGIFGVGNVGAAVTKFLAPFVLVAWGWEAVAQVWALALAAMAILFWFTTGDDPVIRARRAGQGAQHSFAADFEPLKNLQVWRFALYYFFVFGGFVALSLWLPRYLIGVYGFDIATAGMIGAAYSIPASVFRAYGGALSDRSGARTVMYWTFAVSAVCALILSIPPTDYVVRGVNGPIAAHFEIGPWAFIAVIFVLGFFMSLGKAAVYKHIPVYYPQNVGAVGGLVGMIGGLGGFFLPLLFGWLNDVTGLWTSCFMALFVIVAGSLVWMHIAIRQMERRQAGLQPA

SEQ ID NO: 25451 - protein, 346 aa, Mesorhizobium sp. BNC1
MYQTVIEAIGNTPLIRLKRASEETGCEIYGKAEFMNPGQSVKDRAGLFIIRDAEKRGLLRPGGVIVEGTAGNTGIGLTVVAKALGYRTVIVIPDTQSQEKKDALRILGAELIEVPAVPYKNPNNYVKVSGRLAEQLARTEASGAIWANQFDNVANRDGHIRTTAEEIWRQTGGKVDGFVSAVGTGGTLAGVSAGLKARNPDVKVALADPLGAALFSYYTAGELKSEGSSITEGIGQGRITANLEDFQPDFSFQIPDEEALPIIFSLVQEEGLCLGGSTGINIAGAIRMARELGPGHTIVTILADYGTRYQSKLFNPAFLREKKLPVPAWMEGRSEIPVPFEQVAAS

SEQ ID NO: 25452 - protein, 1204 aa, Mesorhizobium sp. BNC1
MPALDALRDEIRKHYLADEDVLLRRLIESADLSPARREAISAKAAELVRAVRAGSTRHLMESFLAEYGLSTSEGVALMCLAEALLRVPDAETMDDLIADKIAPHDWSAHSGESASIFVNASTWALMLTGRVLDDEGNGIEATLRGMVRRLGEPVIRAAVAAAMREMGEQFVLGRTIAEAIKRGRAMTAKGYTYSYDMLGEAARTEADARRYFQAYRNAIAALKGEAKSEDIRANPGISVKLSAIHPRYEATQRERVMPVVTERLLLLAQDARAARMGLNIDAEEADRLDLSLDVIERVLADPSLEGWDGFGIVVQAYGRRAPFVIDWLYALAERLDRRIMVRLVKGAYWDTEIKRAQVMGLSSYPVFTRKVNTDISYIACARKLLSLTDRIYPQFATHNAHTVAAILAMAENRNAFEFQRLHGMGEALHDIIKRREGTRCRIYAPVGAHEDLLAYLVRRLLENGANSSFVHQIVDEEVSAEEIARDPFALAEAAGSAPNPAIPLPALIFGRQRINAKGWDITDETALREIETARRPFQAPHRWEGRPITRARGQGEARIIVNPARTSEIVGTVFDASPGQVSESVRLAVAAQPGWAATPVTERAEILRRIADLYEAHAGEFFALCAREAGKTLPDGIAELREAVDFLRYYANEAAQAEEGTGARGVIACISPWNFPLAIFTGQIAAALVTGNAVVAKPAEQTCLIATRAVALMHEAGVPEDVLHLLPGDGPSVGAPLTADPRIAGVCFTGSTEVARAIERQLAKTAAPDAMLIAETGGLNAMIVDSTALPEQAVRDILASAFQSAGQRCSALRILYIQKDVEARVTAMLRGAMQALTVGDPWQVPTDVGPVIDDEALSGISGYCEEMERKGRLLARIERPEGGRFVAPAAFQVSGIEEMEREVFGPVLHVATFEAEDLGHVISAVNAKGYGLTFGLHTRIDARVQEVVDGIHAGNIYVNRNQIGAVVGSQPFGGEGLSGTGPKAGGPHYLRRFRRGKAGPDLAPADAPAIAAEELVRAMPDAQKSGWADRTDRIVALRRALRGRWADVLASAAALDLGPVDLPGPTGEANTLQLAPRGRVLCLGADADALAAQVIQALAAGNAVLAVAKDAPAILQPLTRAGFPLAAFHGNVAPQTLETLALDLVAATGERQWLTAVRTALSAREGRIVPLVTELVYPAAYAHERSVCVDTTAAGGNASLLAAA

SEQ ID NO: 25453 - protein, 485 aa, Mesorhizobium sp. BNC1
MLKKTSHFLREANFIAGEWVNADSGATIEVINPATRQTIGTVPKCGRAETRRAIEAAQEAFQSWKKTSANDRAKLLRKLHDAIMDNQDALAELLVMEQGKPLAEAKGEVGTSAAYILWFAEEGRRIYGDIVPAPWTDRRILVTKEPVGVIGAITPWNFPSSMLARKLGPALAAGCTTVAKPASQTPYSGLAWGVLAEEAGFPKGVVNIVTGSASEIGDELTENPLVRKITFTGSTEIGKLLMEKAAGTVKKVSMELGGNAPFLVFDDADLDRAVKGAMIAKYRNAGQTCVCTNRFFVQDGIYDRFLEKFVEASRKLKVGSGLDEGVEQGPLIDGGAVEKVEELIADAVSKGGKVVTGGKRHALGGSYFEPTVIAEATPQMRFMEEEIFGPVAPVFRFKDEADGIRMANDTSFGLACYFYTSDLGRAFRVMEGLKYGLVGVNEGLITTVEAPFGGLKESGLGKEGGRQGIEDYLDTKYVCIGGLGL

SEQ ID NO: 25454 - protein, 467 aa, Mesorhizobium sp. BNC1
MVMTALATGASAPPVNLWLSEARATLSLAWPMILTNLAQTAMTMTDVMMLGRLSPEALAAGTLGHNLYFMLVIFGLGLLAAASPMMASAIGRKLRYVRDVRRTARQGLWLALVISVPIWLILWNTESILLAMGQDPALSRGAASYMNALQWAALPFFGYIVLRSFISALERPGWALLVAFICVGFNVLANWCLIYGNLGFPALGLQGAGLATTLSSIFMFLGLVAVVTLVRQFRRFSLFGRLWRSDWPRFKAMLRLGLPIAGILTFEVSIFNIAALLMGLIDAVSLAAHAIAIQIASASFMVPMGLGQAVTVRVGRAYGARDAEAITRAGWTAFVMGVSFMGMMALLMYFAPRLLIAGFLDLNAPENQPVISTAVTFLAFAALFQIADGAQAVGSGMLRGLHDTTVPMIYAALGYWGIGLPLSIVLGFPLGYRGVGIWTGLCAGLAVVAVMLLWRWLRREKLMPFSA

SEQ ID NO: 25455 - protein, 370 aa, Mesorhizobium sp. BNC1
MSSKLFTPMRVGSLQLDNRIVIAPMCQYSAENGCMTDWHTIHLGGLALSGAALLTIEATAVTPEGRISYADVGLYSDENEAAMRRVLETVRRWSDMPIAIQLAHAGRKASSEIPWKGGGQIRPGLPGGWQTEAPSAVPFKESENPPIALDRAGLARVRDAFAEATRRSARLGLDAVQIHAAHGYLLHEFLSPLSNRRDDEYGGSLENRMRFPLEVFDAVRAAFPAEQPVTVRVSGTDWAEGGWTIEDTVAFAKALEARGCGAIHVSSGGLSAAQRIPIGPNYQVPLARAVKAAVRMPVVAVGLITEFEQAEAIIGTGDADFVALARTILYDPHWPWHAAAHLGARVKAPKQYLRSQPRRYKDLFAVRADD

SEQ ID NO: 25456 - protein, 272 aa, Mesorhizobium sp. BNC1
MRENTMSAENLTAAEGIQLDPSKLKVSDTEVAIEIVGMHKWYGDFHVLRDINLKVMRGERIVVCGPSGSGKSTMIRCINRLEDHQKGKIVVDGIELTNDLKKIDEVRREVGMVFQHFNLFPHLTILENCTLAPIWVRKIPRREAEEAAMHYLTRVRIPEQANKYPGQLSGGQQQRVAIARALCMNPRIMLFDEPTSALDPEMIKEVLDTMVDLAQEGMTMICVTHEMGFARQVANRVIFMDQGQIVEQNTPEQFFEHPQHERTKLFLSQILH

SEQ ID NO: 25457 - protein, 470 aa, Mesorhizobium sp. BNC1
MLIGGEWTKGSGEPKEVINPATEEVIAMLPSATEADLDRALQSAQRGFREWQELSAEQRCDIIMRGCRILRERAAEIAPLITIEQGKPVEEARLEIIRAASIIEWDANEGRRAYGTIVPSDPGFNRYGIKLAIGPVAAFTPWNFPISSPGRKLGGALGAGCSVIIKSSEETPAATCALVQCLLDGGLPPEVINIVSGKSSMISAYLIASPVIRAITFTGSTPVGKHLAKLAAEAMKPVVMELGGHSPVIVFDDVDADKIARQAVAAKFRNAGQICTAPTRFIIQEKAHDAFVESFVKAASAIKVGNGLEADTQMGPLANSRRLRALEELVADARAKGATVATGGKRIGNRGYLFEPTVLTDVPDDADVVNVEPFGPIAPVVRFREFEEAIEIANRLPYGLCSYAFTNSQAYSHELAHRVESGIMSLNHFGTSQADTPFGGVKESGYGREGGYETLDAFMITKFVSQQITA

SEQ ID NO: 25458 - protein, 328 aa, Mesorhizobium sp. BNC1
MKAMVLKEVRRPLVLSKLPNPTPGRGEIRLKVEACAVCRTDLHVVDGDLEHPKLPLIPGHEIVGIIDMVGEGVDEARLGCRAGVPWLGHTCGACPYCLAGSENLCDQPLFTGYTRDGGFASHVVADADFAFDLDATGDPIALAPLLCAGLIGWRSLKMAGDGRRIGIYGFGAAAHIIAQICVWQGRDVFAFTRSGDTDAQRFALSLGASWAGSSDASPPDLMDAAIIFAPVGDLVPAALQAVRKGGRVVCGGIHMSDIPAMPYSLLWEERQLVSVANLTRADATEFFPVARRAGVRTHTTVYSLERANEALADLRAGRLSGAAVLVPG

SEQ ID NO: 25459 - protein, 373 aa, Mesorhizobium sp. BNC1
MYIAHHQVPAGDTAQPKVWLENVSKQYGSVTALQPSDLKVRSGEFLTILGPSGSGKSTVLNLIAGMTNPTAGRVWIDGRDCTNVPPSKRGLGMVFQNYALMPHMSVFENVAFPLRVRRVTEAEIKRRVGEALELVRLPSVAGRKPAELSGGQQQRISIARCLVYNPAIILMDEPLGALDKKLREEMQLELKRLHVELKVTALYVTHDQEEALTMSDRIVLFNGGRIEQAGTPHELYFRPRTLFSAKFLGDSNVLSGKLQGRAQDGLVETPVGLLRSSNGNEHVGDGASVHLMVRPENVLLLPPDNKHEYANGLEAMVVDTISFGGVIKTFARLSDGSTMTVQELTRARRQAFDRGARVRLAWQAEDMLLLPAA

SEQ ID NO: 25460 - protein, 457 aa, Mesorhizobium sp. BNC1
MTDRSNELNAWDRDHFFHPSTHMGTHARGESPNRVVAGGEGVYITDVNGRTSLDAFAGLYCVNVGYGRQKIADAIAEQARNLAYYHAYVGHGTDASIRLAKMIIDRAPQGMSRVYFGLSGSDANETNIKLIWYYNNVLGRPEKKKIISRWRGYHGSGIMTGSLTGLDLFHNAFDLPRAPILHTEAPYYFRRPDRSMSEEQFSQYCADKLEEMILAEGPDTVAAFIGEPILGTGGIVPPPAGYWEKIQAVLKKYDVLLIADEVVTGFGRLGTMFGSDHYGIKPDLITIAKGLTSAYAPLSGVIVSDKVWQVLVQGSDKLGALGHGWTYSAHPLCAAAGVANLELIDEMNLVENAGTVGAYFRAELANAVGSHPNVGEVRGDGMLAAVEFVADRDDRVFFDASKKIGPQIAAALAERGVIGRAMPQGDILGFAPPLCLTKEEADKVIAATASAVDSVLG

SEQ ID NO: 25461 - protein, 497 aa, Mesorhizobium sp. BNC1
MNAATAKIDLSAKLDLLHDKSLLRELAYVDGRWVTGHEPVNFEVRDPATGAVLAYVASLNAAQVDSAIDAAARAFLSWKRLLPQERAATLRAWYELIVAAKEDLALLMTLEQGKPLAESRGEIDYAASFVEWYAEEAKRLNVESVTSHLPGAEMMVRREPLGVVGVVTPWNFPSAMLTRKAAAALAAGCTIVAHPSSETPLSALALAELGERAGLPAGVLNVVTGDAATIVGRMCGDSRIRAMSFTGSTEIGRLIAAQCAPTMKRLVMELGGHAPLIVFEDAPLDKAVDIAIGAKFATSGQDCLAANRIYVQRGIYGAFCEAFAARIATLKVSDGLDETGDIGPLMHERAIAKVEEQVTDALGRGARCLIGGERHPAGRLFYQPTLLADVPDAALIMREETFGPVAAAVPFDTEDEVVRRANNTEYGLVAYVVTENGARQLRMGRALDYGMVAINRVKITGAPIPFGGVKQSGIGREGARHGLEAFTDLKYLCLDAA

SEQ ID NO: 25462 - protein, 406 aa, Mesorhizobium sp. BNC1
MSNTSHQAPRNEAERVSFAWDDPFLLEDQLTEEERMIRDAAAAFAADRLRTRVEHAYMNEETDPAIFREMGEAGLLGVTIPEEYGGAGANYVSYGLVAREVERVDSGYRSMMSVQSSLVMFPIYAYGSEDQRKKYLPKLASGEFIGCFGLTEPDAGSDPGSMKTRAEKIDGGYRLVGSKMWISNAPIADVFVVWAKSAAHDNQIRGFVLEKGMKGLSAPKIGGKLSLRASITGEVVMDGVEVPEDALLPNVSGLKGPFGCLNRARYGISWGVMGAAEDCWHRARQYGLERQQFGRPLAATQLFQKKLADMQTEIALGLQASLRVGRLMDEHKFAPEMISIVKRNNCGKALDIARMARDMHGGNGIQIEYQVMRHSQNLETVNTYEGTHDVHALILGRAQTGLQAFF

SEQ ID NO: 25463 - protein, 487 aa, Mesorhizobium sp. BNC1
METMMDVLGLTIDGEERAASDGRVFERYNPVTGDVATRAAAVNVDDAIAAVDAAAAAFPAWSQTSPGERRAILTAAADRLQAMSDDIVAAMAAEIGATAGWALFNVGLAADMLREAAGLTTQIKGEIIPSNRPGSLAMAIRQPAGVVLSIAPWNAPIILGVRSLAAPLACGNTVVMKTSEICPRTHSLIVQALNEAGLPKGVLNAVSNAPEDAAEIVETLIAQPAVRRVNFTGSTRVGRIIAELSGRYLKPALMELGGKAPLVVLDDADLDAAVAAAAFGSFMNQGQICMSTDRIVVDEKVADEFVGALAAKAKTLKASDPREGNTPLGCVVDAGAASRISQLISDAVAKGAVLSAGGGVDGTIIQATVLDKVTPSMRIYSEESFGPVVAVLRVGSVEEAVRVANDTEYGLSAAVFGRDVNRAMSVARRIQSGICHINGPTVHDEAQMPFGGVKASGWGRFGGSAGIHEFTELRWVTIQDGPLHYPF

SEQ ID NO: 25464 - protein, 503 aa, Mesorhizobium sp. BNC1
MSVLNENIARAVEYLKPFREGGVLNHVGGAQVPAASGETFETVSPVDMSTLAKVARGGAADTDKAVAAASEAFKTWSKTSGAERRKILIKVAEGIEARAEEIAFIECMDTGQALRFMSKAAIRGAENFRFFADQAPGSEDGRALRTPAQMNVTSRRPIGPVGVITPWNTPFMLSTWKIAPALAAGCTVVHKPAEFSPLTANLLVQIAEEAGLPKGVLNVVNGYGEEAGRALTEHKGIKAIAFVGESRTGSMIMKQGADTLKRVHFELGGKNPVIVFDDADLDRAVDAAAFMIYSLNGERCTSSSRLLVQESIYEEFTRRVAEVARGIKIRHPLDPETVIGPLIHPSHEKKVLSYFEKAKEEGAIIATGGEKYGEAGCFVRPTLFTNARNDMAIAQEEIFGPVLTAIPFKDEDEALAIANDVNYGLAAYLWTRDLGRAMRMTDNLEAGMIWVNSENVRHLPTPFGGVKASGIGRDGGDWSFDFYMETVNVSFPRREHKVSKLGG

SEQ ID NO: 25465 - protein, 300 aa, Mesorhizobium sp. BNC1
MTEPEVSSLPALAFIGAGVMGRPMIANLRKAGFALKAYDRSPAALENLRSDGVTVADSLAAAVAGADVVVTMLPDTPHVQSVLLGEDGIGTLLPTGTLVIDMSTISASGIRAIGQDLASRGVDLVDAPVSGGVRGAIAGELSIMCGGSPEAFAKARPVLEGMGTTIIHAGDLGMGQVFKMCNQLMVGVHIQAMCEAFALCRAQGGDLNLLRETLMGGAAGSWMLENLGPQVIAKDDSAGFRIDLQLKDLRLAGEAAFEKGLPLPGLAMATSLYLEARAHGEGSNGNQAMFRTYDRLTNQA

SEQ ID NO: 25466 - protein, 484 aa, Mesorhizobium sp. BNC1
MGKVTGFLEIDRQENKYQPASDRIRHFREFTIPMSDQEVSKQAARCMDCGIPYCHGPTGCPVHNQIPDWNDLVYQGDWEAAIRNLHSTNNFPEWTGRICPAPCEEACTLNLEDVPVTIKTIEQAIGDKAYELGFVRPQPADRKTGKRVAIIGSGPAGMAAAQQLGRAGHDVHVYERESRPGGLMRYGIPDFKIEKRYVDRRVEQMQGEGVTFFCGVNVGVDKPVSELLAEYDAVLYCGGSEKPRPAGIPGVELNGVYDAMPYLVQQNRRIGGENTQSVAWASVPILASGKHVVVVGGGDTASDCVGTAFRQGAVRVTQLDIRPKPPEKEDKLTVWPYWATKMRTSSSQAEGAEREFQVATLEFIGEDGQLTGVKCCQVDERRKPIAGTEFIIKADLAFIAIGFAGPLETGILDELGEKLTTDVDRRSSTNVVANDRDYRTSLDKLFAAGDVRRGQSLVVWAIREGRQAARAIDEFLMGSSVLPR

SEQ ID NO: 25467 - protein, 421 aa, Mesorhizobium sp. BNC1
MCDGFDTQAVAYVAPSIVAEWNMAPGSFGPVFAALLLGSMVGAFAFGYLADKIGRKYTLAGCVALFGILNFASAYATSIETFTVLRFLCGIGLGGTVPNVTSLVSEYAPARKRATLVAITWAGFGLGAVVGGLISVPLISHFGWPAVFIAGGILPLLLLPFIFFSVPESIKFLILAGGKGAAVASILKLICPSGSFKDNDVFVLEESRPGRGQISALFKDGLAIGSIFLCLAFFMSLLLVYLFINWIPLLLRQAGLPLQHAVMGTIIFNLAGIIGSVFCTQLIDRKVARPVSILIAAYFIGAAAVFSIGYAGTAFWPIMITIFLSGFFIIGVQLSLNAFITNYYPTSIRGTGVGWSQVIGRLGSLLGPLIGGALVSQGMAPSQLFQVSAVAPLLACVSLLIFARLSRADPKGQPAISDAAA

SEQ ID NO: 25468 - protein, 489 aa, Mesorhizobium sp. BNC1
MALLEHPQVGPAQNHIDGIWRHGPVSERRETFDPATGKILGHYDPGTVDLMDEAIAAARRAFDETAWASAPRLRAEVLLKLAARLSADHERLATLNAYENGKSFIQAKNEVATAISEAKYYAGLARSMTGRMMEPEPGCYSLISREPMGVAGIIVPWNAPVTLLLRSLAAALAAGCTAVVKPAPQTPLINAAVIQHLVAITEIPDGVVNSINDGGPAVGERLVASSDVDVISFTGSSAVGKRIMAAAAPTLKRVSLELGGKTPSIIFDDADLDKAISELARASLVNSGQQCVAASRFLVHRNVLDDFADGMMQRLRSVPVGPGYDTDNLVGAIIDRPNRDRLLGWLDRCADDGDILLRGETLDERYPGGAFLTPSLVLVSSTEALTVQEELFGPIITLEPFADEDEALAKAHATAYGLAASVFTRELDRSLRMARRLRAGTVWLNTHGKLIAEAEMEGHRESGIGRLHGADAIGEFQQTKHIYLPFGQS

SEQ ID NO: 25469 - protein, 351 aa, Mesorhizobium sp. BNC1
MVEDKMYAAVMHDFGGPEVIGWEMVPTPRPGPHDVLVQVHAVTVNRTLDIKVRQGAYAKRPVLPHVLGVDPSGVVVETGAEVSDFKPGDPVAVSSRIRYEPEDVPRMLGVDLWGGYAEYVCVPAASAFPLPAGLDFATASIAIRHVPQAFHMLETKAKLQPGEWVLVMGASGGLGSASVQVARHLGARVIVAAGADERVSAAMALGGEFGINYRSQDLHAEVMRITGNAGVDVVCENISDPVLFPAAFKSLRRFGRLVSVGTHGGGIVPLDVAFLYLNQLTIMGSTGQTPDDIRKGIELAASGKFRPLIGCVLPLYQVREGHVLADGNDVLGKVVLDPRARPNGAAQSLRS

SEQ ID NO: 25470 - protein, 383 aa, Mesorhizobium sp. BNC1
MCQYRSVAGGPTDWHLVHLGKFAVGGAGIVFTEETAVEERGRKTYACAGLYNDDHVKSYRRITDFIRSQGAVPAVQLGHAGRQASCHGAELGWKPLTEEDARAGLPPWQGVAPSPFAWCPDASVPHELSHADIKDMLAIWKESTLRAVDSGFDICEIHGGHGYLLHQFLSPLANKRTDAYGGDRSGRMRFVLEVTEAVRSAWPADKPLFFRMSVVDGRGGQWFVEDSIALAAELREIGVDLIDCSSGGMNGDGVFPPVPRVPEFQVEYSKALRHGARMPTLAVGLITSPRRAEAILQAGEADLIAIARGAIWDPNWPAHAAAELGKHEPYAVLPGDMAFRLRDRDSHRDSYPYGTKVDIPLSPDRSIPYSWPERGEYWPPVRE

SEQ ID NO: 25471 - protein, 504 aa, Mesorhizobium sp. BNC1
MEETMQTAHTWKADRQQSLRGHTVPTALLIAGEWIERDKSFTVTNPATNEEIARVSDGTAEDALRALEAATASQEAWAAWAPRQRANLFHRAHRLMLERATAFAEVMTLESGKPLAEAKAEFALSADFFLWYAEQIAHLHGTFASGSPGGYRIIATHRPVGPCFLVTPWNFPLLMIARKGGAALAAGCTTIVKSARETPLTAALFAQTLLEAGFPAGTVNLIHTTSSASISEALLADPRLRKVSFTGSTEVGSRLLSGAAQNIVNASMELGGDGPFVVLEDADIDLAVRQAIICKFRNAGQACVAANRIICHAAVVDEFTQKFVDETRKLRVGDGFEPGTDVGPIISSPQLERVDRMVAMLKDAGAELLTGGKRKGVTGNFYEPTVMRIKGSAPACRNEELFAPIAVIYSVDSVAEAIRFANDTIYGLAAYVFTRNVDRAIAVSEKLDFGMVGINRGIMADPAAPFGGIKSSGLGREAGHDGIYEFLEPQYLALTVNEAAGISQ

SEQ ID NO: 25472 - protein, 374 aa, Mesorhizobium sp. BNC1
MNVSSISRYGEVINPEVYGLHAISDPRQDEGAIVVEDLVKSFNGVEILKGVSLSIRPGDFATILGPSGSGKTTILRCLAGLEDPDRGRIYLNGKLVFDAEKGINSPTHRRRLGMIFQNYALWPHMTVLQHVLFPLKHRGEGKNVEKAREALKLVDLTEHADKFPHQLSGGQQQRVAVARAIVADPKVLLMDEPLSNLDVQLRRQLRDELKAAHLRCGATSVFVTHDQAEAFALSDYLIVMRDGKIEQQDIASNLRLHPRNVFIAEFLGYENLISGQDLRRICSAVEGTVEPGAHYAVGATALRPSDPKDGDCLRIDGCVLDSSSYDGLIHTHSFTIGDTRLEVKALEDFYSASQAGPMSLWLKRSDIIRIEANN

SEQ ID NO: 25473 - protein, 375 aa, Mesorhizobium sp. BNC1
MRTRAAVAVAAGKPLEIMEVDLDGPREGEVLVEVKATGICHTDDFTLSGADPEGLFPAILGHEGAGVVVDVGPGVTSVKKGDHVIPLYTPECRQCPSCLSRKTNLCTAIRATQGQGLMPDGTSRFSLNGEKVHHYMGCSTFSNFTVLPEIAVAKVNPDAPFDKICYIGCGVTTGIGAVINTAKVEIGSTAIVFGLGGIGLNVIQGLKLAGADMIIGVDLNNDKKEWGERFGMTHFVNPKEVGGDLVPYLVNLTKRGADTIGGADYTFDCTGNVTVMRQALEAAHRGWGESIIIGVAGAGQEISTRPFQLVTGRVWKGTAFGGARGRTDVPKIVDWYMDGKIEIDPMITHILSLDEINKGFDLMHSGESIRSVVVY

SEQ ID NO: 25474 - protein, 1115 aa, Mesorhizobium sp. BNC1
MNTMEKVASELMSPEEAEAVQVVPPAGPRPPDWYKDAVIYQLHIKAFHDSNGDGMGDFNGLMQRLDYVERLGVNTIWLLPFYPSPLRDDGYDIADYRSINPSYGTMRDFRRFVAEAHRRGIRVITELVINHTSDQHPWFQRARHAKKGSAARQFYVWNDDDERYPETRIIFLDTEKSNWTWDPVAGQFFWHRFYSHQPDLNFDNPRVLDAVIRIMRFWLDMGVDGLRLDAIPYLVERDGTNNENLPETHEILKKIRKALDEKYPDRMLLAEANQWPEDTRPYFGEGDECHMAFHFPLMPRIYMALAQEDRHPISDIMRQTPEIPESCQWAIFLRNHDELTLEMVTDRERDYLWRTYAEDVRARINLGIRRRLAPLMQNDRRKIELMNALLFSMPGTPIVYYGDELGMGDNIYLGDRDGVRTPMQWAPDRNGGFSRANPQMLYLPPIMDPVYGYQTINVEAQEADPSSLLNWVRRVIGVRKQHSAFGRGDFTMLYPRNRRILAYTRSDANETILCVANLSRSPQAVELDLSKYRNCVPIELVSQSPFPPIGDLPYMLTLTGYGTFWFVLASEAQAPEWHNNVPEPLPEFITLTMVDGRIERALEGRERRQLEQDVLPQFMQRQRWYGAKGEGIRSAGISDIAKLGDEGGLLTIVDVDLSVSGRQRYLLPLTVLWGEENVQFGAPKLSVTLARVRKGSRLGALIDGAYDDRFASELMRRMQENQEMQVPGGTLRFYGNEQLTAMHFEETPSPLMGEQSNVSVAFDRQVLLKIFRRLRPGDQPEVEVARFLTEVAGFRNTPAFLGMVEYEEQGARTVLASVSGFVENQGDAWGVFVHALERQIEDETLAPPAPAGATPAEGTTAQLLYPLDLLRRLGERTGEMHAALAIETDMEAFRCEPIRRADIASWVKDLKQQAASARAALERNKDRLPLNIRESVEHLLSLRQRIDRRISEFGKITPSGKKSRIHGDYHLGQVLVSKQDLYIIDFEGEPRRSLEERRGKSSPLRDVAGMLRSFDYAAWTAVRQVAARLPDQTRDGSSLARQWRERMSAEFLEGYRAAASVAQNQPADGATWEALLELFLLQKGFYEINYELSNRPDWVGIPVQGVLDLIERRSG

SEQ ID NO: 25475 - protein, 483 aa, Mesorhizobium sp. BNC1
MSGRKYPNPSLFINGRSVTGRGAKEEMVIDPSNEEVLGSYRSAAPEDLQELLDSAAAGFEKWRRTSAYERCEILHKVAAALRENAQEIGSLLTLETGKILSESITEVRGAADHFDWSGEEGRRLYGYTVPARRAESRLRVELEPLGIVFALIPWNFPLGTSARKVAPALAAGCSVILRPPEEAPATVEAFVRCCQEAGLPPGVLNMVLGSPKDVVEPLMASFSVRAVTFTGSTRVGKILIQQAADTVKHLVLELGGHAPAIVLPDADPKKVGVAAARAKFRNAGQVCVSPSRFIVHEKIVEPFTQAMVEETRSIKLGSGFDAGAQMGPLTTARQRERVERLVEDARSKGARILAGGQRPSGFNRGFFFEPTVLGDVPDTALIFEEEPFGPVAPIIPVRSVQEAVEKANAVKWGLAGYLFTSSLADATKVSEAMQVGMVGLNTFAAAAPEAPFGGVKESGYGRECGLEGIREFVSSKLIHTDIG

SEQ ID NO: 25476 - protein, 512 aa, Mesorhizobium sp. BNC1
MTSPFLRIFDLAQMDPERLYARFGERDITIGDVARNSEAVARILLASGLTPGARVAVMMENRPLTISLIFGIARAGMVWVPINTRQQGDSLAYQLGHCRPALLIVDEALLAKVRDCGADDGHLAIHSLADDADTLDLPNNGRADALPAPVEAGETFAIMYTSGTTGAPKGVQVTHRMFDYAARAVSIAGGIEDGDVMFVWEPLYHIGGSQLLLLPLMHRVHLHLVRRFSASGFWGDVHASGATHIHFLGGILQILLRNPPSPNDRGHRVRVAWGGGCARDDWQAFEHRFGVDIREAYGMTEASSITTINVGGPVGSVGKPVPWFKVELLDEAGQPVPPGERGEIVVSELEEGALFKGYLDAPEANARVLRGGRLFTGDVGIFSEDGWLTFQGRLNDSIRRRGENISAWEIESAALKHPAIAEVAMIGVKADIGEQEIKLFVRPADGHSIDAPQLHGWLTEQLGRYRAPRYIAFVDSFPKTPSERIRKGLLPQTTDDCWDAESHARTLLTRTA

SEQ ID NO: 25477 - protein, 153 aa, Mesorhizobium sp. BNC1
MVLNRSGQVWAGRRIRETASETDGTTMLWQMPQGGIDQNEDPLTAARRELYEETGIRSVSLLAEAPEWITYDLPEHLVGRALKGRFRGQKQKWFAFRFEGEESEIAINPPPGDHEPEFDAWAWKPMEQLPRLIVPFKRQVYEEVVAAFRHLAG

SEQ ID NO: 25478 - protein, 341 aa, Mesorhizobium sp. BNC1
MSERLEDIAARMVADGKGILAADESSGTIKKRFDSIGLESTADNRRDYREMLFRADEAMRNSISGVILYDETLRQQAKDGTPLVEIISRSGAVPGIKVDAGAKPLAGFPGETITEGLDGLRERLKEYYELGARFAKWRGVIAVSDDLPTWGSVKQNAQALARYAALCQEAGIVPIVEPEVLMDGTPATHSIDRCYEVTEWVLKTVFTELFDARVALEGMVLKPNMVIDGKNARKASREEVAEKTVRCLKATVPAAVPGIAFLSGGQSDEEATAHLSLMNASHSMPWKLTFSYGRALQAAALKAWGGKSENVAAGQRAFAHRARMNALAARGDWKQELEVAA

SEQ ID NO: 25479 - protein, 470 aa, Mesorhizobium sp. BNC1
MPDTYDVVVIGTGPGGYVCAIKAAQLGLKTAVVEKRTNHGGTCVNVGCIPSKALLHATEMFAEAGHSFADLGIDVGTPKLDLKKMLAHKEKTVDQNVKGLDFLFKKNKIDVFRGAGRIAAAGKVVVTGEDGKEQTVETKNIVIATGSDVAGIPGVDVDFDERVIVSSTGALELPAVPARMVVVGGGVIGLELGSVWSRLGAKVTVIEYLDTILGGMDGEVAKQFQRMLAKQGFGFKLGAKVTGIAKTEGGASVTFEPAKGGEAETIDADVVLVATGRKPYIDGLGLKEAGVEVDERGRVKTDGHLRTNVPGIYAIGDVITGPMLAHKAEDEGVAVAEIIAGQAGHVNYDVIPSVVYTSPEVASVGKTEEELKKAGIEYNAGKFPFSANGRARSMLHTDGFVKVLADKKTDRVLGVHILGFGAGEMIHEAAVLMEFGGSSEDLARTCHAHPTMSEAVKEAALATFYKPIHS

SEQ ID NO: 25480 - protein, 482 aa, Mesorhizobium sp. BNC1
MEIALLIKGEDRPALGGGTFDRKNPVTNEVVTTAPAAKKVDVDAAVAAADAAFADWSKTGPNARRTLLNKAADMLESMADEFVRTSIDEIGCTAAWAGFNVMFGAKILREAASMTTQIRGEVIPSDKPGCLAMAIKRPVGVLVGMAPWNAAVILGVRAVAMPIACGNTVVLKASEKCPRVHMLIGEAFRRAGFPDGVLNVVTHSPQDAPEVVEALITHPKTRRINFTGSTRVGRIVAEIAARELKPCLLELGGKAPLVVLDDADIDAAVNAAIFGAFMNQGQICMSTERIIVDERVADDFVAKFTERASQLPVGDPNGNVVIGSVVDYETIERVDKLVDASVALGARVTTGGKSNGSTIMPATVVDHVNETMPLFSDESFGPVVCVVRARDTEHAVEIANASSYGLSSAVFGSDINRAISVAERIEAGICHINGPTVSDEAQMPFGGMRDSGYGRFGGTAGIDAFTETRWITVEDPHQHYPF

SEQ ID NO: 25481 - protein, 478 aa, Mesorhizobium sp. BNC1
MKRSRKVKILATLGPASSDEEIIVRLHEAGADAFRINMSHTDHPTMRELVARIRSVETQVSRPIGILADLQGPKLRVGTFADKSATLSIGQEFTLDDNPAPGDATRVHLPHPEILQAVQPGHRLLIDDGRLQLAALKTDGRSIVARVIAGNKISDRKGVSLPDTELPLGALTEKDRRDLDAVLQTGVDWIALSFIQRPQDLAEVRKIARGRAALMAKIEKPQAVKRLPEIIELSDGLMVARGDLGVEMPLEAVPGIQKQITRACRRAGKPVVVATQMLESMITAPVPTRAEVSDVATAVFEGADAVMLSAESAAGQYPVEAVAMMNAIAIQVERDPVFNDVINAQRTEPEATGADAISLASREIAETLKLAAIITYTASGTTGLRAARERPKVPIIALSPVVETTRRLSLVWGTHCVVSEDATDLDDMVDRACRIAYEEQFAKPGDRVIITAGVPLRTPGVTNMLRIAYIGSDGLSGL

SEQ ID NO: 25482 - protein, 409 aa, Mesorhizobium sp. BNC1
MVPAHAFFARKTLTKTLSATVVLAGLLTASPQSAQAQSISTAPSAAEQQIEGLWLTTPYPDFFAQSGEEVDIGLTLANKGMPPQRVEFSVSGLPDGWQWEIDGGGKRVGAAIAASDQTVDLSLKLTPAEGAADETYQFTITGRTGDQTLELPISLTLAETEPAQLTLEPELPALRGTVRSSFDYQVAITNDGQEDTVVNLVSEAPAGFQVTFKERYGSQELTSLPLKAGEKKDLSVSVKAPENAQAGQYPVRVGAAGGDASAETQLVLDITGQPELSLAGPGGRLSGDATAGEQRSFNFTVENSGTAPARAVKFSASPPSGWNVEFSPEEIAEIPAGETAEVAVNMTPSDQAIAGDYVVSVRANGDGASDSASFRVTVRTSTIWGVTGLGVIAAAVVVLGFAVTRYGRR

SEQ ID NO: 25483 - protein, 180 aa, Mesorhizobium sp. BNC1
MPVVRGKEIEVLYSASTIARRNLELAKEIAARDYTDLLVISVLKGSFIFAADLIRAMHDAGISPEVEFIMISSYGAGTTSGGIKVLRDIDNDVSGRDILLIDDILESGKTLQYTRDLMLSRGAKSVSIAVLLDKHSRRQASLEADFVGFECPDYFVVGYGMDVAHAFRELPFVGIVKGEA

SEQ ID NO: 25484 - protein, 258 aa, Mesorhizobium sp. BNC1
MAGEAEPLSSLDCSALKPNSIAIFLDFDGTLADIAERPDEVSVPPTTREALARLLKSTDGAIAIITGRPIEVIDHFLAPLLLPVAGVHGMERRTAGGQHVGSVIDEEELSAVRAKLQAFADSHEGLLLELKHGSLALHYRQRPDLEAASIAAVHAAANDSKGLHLLHGKMVLEVKGGKATKADALTAFMQEDPFRGRTPLFAGDDVTDEDAFNQIAHINGFSIKIGGGKTSARFRADEASSFREWLERLAARFESRDY

SEQ ID NO: 25485 - protein, 493 aa, Mesorhizobium sp. BNC1
MIKEFCVAESYDVIIIGSGPGGYVTAVRSAQLGLKTAIVEREHLGGICLNWGCIPTKALLRSAEILHYAQHAKDYGLKLDGSIAPDTAAVVDRSRKVSARLNTGVGFLMKKNKVDVIWGEAKISKAAKANEPGEIVVSKPSKKAMEPQHPAPKNTLGEGTYKAKHIILATGARPRVLPGIEPDGKLIWTYFEAMVPKEMPKSLIVMGSGAIGIEFASFYRTMGADVTVIELLPQILPVEDAEVSKFARRQLEKQGMKFHVEAKVTKVEKGANQITAHVEMKDGKVEKITADRLISAVGVQGNVENLGLEALGVKVERGTVAVDGYGRTNVPGIYAIGDVAGPPMLAHKAEHEGVICVEKIAGVPGVHALDKSKIPGCTYCQPQVASVGLTEEKAKEAGRDIRVGRFQFGANGKAIALGEDQGFIKTILDKKTGELLGAHMVGAEVTELIQGFVVAMNLETTEEELMHTIFPHPTLSEMMKESVLDAYGRSLNA

SEQ ID NO: 25486 - protein, 424 aa, Mesorhizobium sp. BNC1
MTAIVDIVGREILDSRGNPTVEVDVVLEDGSIGRAAVPSGASTGAHEAVELRDGGPRYLGKGVARAVEAVNGEIFEAIGGLEAEDQIHIDRTMIELDGTPNKSRLGANAILGVSLAVAKATAAASGLPLYRYVGGASAHILPVPMMNILNGGAHADNPIDFQEFMIMPVGAPTLRDAVRWGSEIFHTLKSGLKAAGHNTNVGDEGGFAPNLKDANAALDFIMASIEKAGFKPGDEVAIALDCAATEFFKDGKYVYEGEGQTRDAQAQAEYLSKLAGEYPIISIEDGMAEDDFEGWKALTDLAGSKVQLVGDDLFVTNAARLKDGINMGIANSILVKVNQIGSLTETLEAVETAHKAAYTAVMSHRSGETEDSTIADLAVATNCGQIKTGSLARSDRLAKYNQLIRIEEQLGRAARYAGRTVVRG

SEQ ID NO: 25487 - protein, 254 aa, Mesorhizobium sp. BNC1
MTPTIRPLIAGNWKMHGTESSLGELKAIGSGFVEAAGAGADGVICVPATLLARASDILAKTPVATGGQDCHPATSGAHTGDIAAEMLADCGASYVIVGHSERRTDHHEADEDVAAKAEAAWRAGLTAIICIGETKIQREAGETLSVLSRQIAGSVPPGATAKNSVIAYEPVWAIGTGLTPTVEDVAQAHAHLRAELGMKLGIEADGMRLLYGGSVKPSNAGELLSILNVDGALIGGASLKAADFLAISAAVKGK

SEQ ID NO: 25488 - protein, 194 aa, Mesorhizobium sp. BNC1
MRLILLGPPGAGKGTQAQILVEKLHIPQLSTGDMLRAAVKAETEIGKKAKAVMDAGELVSDAIVNAIVAERIDQPDCANGFILDGYPRTLAQADAVEAMLGERGLKLDAVIELVVDDKALVGRIMKRAEDAQAAGQPVRRDDNPEVFEERLREYYKKTAPLVGYYYAKGLLKGVDGMASIDEVTRQIEGILAKA

SEQ ID NO: 25489 - protein, 361 aa, Mesorhizobium sp. BNC1
MPDFRNTSALKLENIRKTFGSVEALSSINLEVSAGEFLTILGPSGSGKTTLLRLIAGFVTPDSGSLTIFGEDMTMASAGKRQIGMVFQNYALFPHLTVLENVMFPLEMRKHSRREAAEKAAAALAAVHLDAFGDRYPKQISGGQQQRVALARAVVFEPKLLLLDEPFSALDRRLRESMQREVRQLQASLNLTTIFITHDQEEALFMSDRIAVIDGGTIQQLGTPNEIYYHPRSITVAEFIGDSNILEGTETPDGLRTRSGMLLRRASSSNSGRVLIRPEAIRISREPADGVAMNQFKGKIANRTFVGGFTIYQVDVHGGDTLTVRCLADEETMFDTHQEVHLSIREADCRPVPRDAKEPRG

SEQ ID NO: 25490 - protein, 405 aa, Mesorhizobium sp. BNC1
MEEFHKVRRLPPYVFEQVNRLKASARSRGADIIDLGMGNPDLPTPKAIVDKLCEVVRDPRTHRYSSSRGIPGLRRAQAAYYARRFGVKLNPDTQVVATLGSKEGFANMAQAITAPGDVVLCPNPTYPIHAFGFIMSGGVIRSIPAEPDHNFIPVLERAVRHSIPKPLALILNYPSNPTACLASLDFYKDVVAFARKHDIIILSDLAYAEIYFDTEAPPSVLQVPGAMDVAVEFTSMSKTFSMPGWRMGFAVGNERLIAALSRVKSYLDYGAFTPIQVAATAALNSDGTEIEEVRSVYHRRRDVMVDAFGRAGWQVPPPPATMFAWAPIPEPFRQLGSLEFSKLLVEKADVAVAPGIGFGEHGDDYVRIALVENEHRIRQAARNIKRFLATAAEHPSNVVPFAATR

SEQ ID NO: 25491 - protein, 450 aa, Mesorhizobium sp. BNC1
MAQRHYEDGIVSGRFSPEDYAQNFSDLHPALDTHEARVEADRCYFCYDAPCMRACPTTIDIPLFIRQISTGNPLGAARTIFDQNIFGGMCARVCPTETLCEEACVREHAEGKPVQIGRLQRFATDAAMARGKRFYTRAAASGKKVAVVGAGPAGLACAHRLAMYGHEVTVYEARPKPGGLNEYGIAAYKTPGGFAQAEVDYILSIGGITIEHGKALGRDFTLAGLAAGSDAVFLAMGLAGVNALRCEGEEADGVENAVDYIATLRQADDLSKLPIGGRVVVIGGGMTAIDAAIQSRLLGAEEVTICYRRGKEHMNASEWEQELAAAKGVTIRHWMQPRRVIAEANRVSGIEMEYTAIVDGRLIGTGDTLILKADQIFKAIGQSFDPAVLNGGGDAIVFEKDRIRVDGEGRTSMPKVWAGGDCILGGDDLTVSAVAQGRDAAESIHRSLIA

SEQ ID NO: 25492 - protein, 394 aa, Oryza sativa
MRMEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 25493 - protein, 293 aa, Streptomyces bikiniensis
MAQPGRTTFPLGGDLSVHRLGFGALRLTGPGYWGPPEDREAAISTARLAVDLGVSFIDTADSYGLGSNEELLAEALRPYPDGLVIATKAGQCRPRPDQWVPCGRPEYLRQQAELSLRRLRLDRIDLFQLHRIDPKVPAAEQFGALGELQDEGKIRHIGLSKVTVREVEAAREHITVASVQNVYNLTDRRNDEVVEYCEKHEIAFIAWLPIARGALAAGGSPVADIATELEVSAGQVALAWLLHRSPAVIPIPGTSSPAHLRENVAASGIALSDGQLARLNALGRTHDDATVPV

SEQ ID NO: 25494 - protein, 177 aa, Ipomoea trifida
MASPKQVMMEQQQQPQLQIPLLKNSGVISYSGNNPMGDDKAEEMTRTALSTFRAKEEEIERRRKEVTDRVQAQLGRMEEESKRLAEIREALEGFVDPAGKEAAMVRKKIDVVTRELKSLGQTCQRKEKEYKETLDAFNGKSKEKAQLITKLMELVSESERMRMKKLEELSKNVESLC

SEQ ID NO: 25495 - protein, 438 aa, Ipomoea trifida
MRSKDRISYFYDGDVGNVYFGPNHPMKPHRLCMTHHLVLAYGLHNKMEIYRPHKAYPMELAQFHTADYVEFLHRITPDTQHLFGSDLKRYNLGEDCPVFDNLFEFCQIYAGGTIDAARRLNNQLCDVAINWAGGLHHAKKCEASGFCYINDLVLGILELLKYHPRVLYIDIDVHHGDGVEEAFYFTDRVMTVSFHKYGDKFFPGTGDMKDIGERDGKFYAINVPFKDGIDDSSFIRLFRTIISKVVETYIPGAIVLQCGADSLAGDRLVLFGHHSTFCKDISVVYLFPSTNLSCNFLGDFYMGMFYLMLLAGHAECVRFVKKFNIPLLVTGGGGYTKENVARCWTYETGILLDSELPNVFFFPPEIPDNDYIKYFGPDYSLKIPGGHIVPPDFYIPDFDEDTQNPDERLDQHTQDKQIQRDDEYYEGDNDNDHSMDDA

SEQ ID NO: 25496 - protein, 292 aa, Brassica oleracea
ELVSEFSFWLNRNADDEEGGELVFGGVDPKHFKGQHIYVPVTQKGYWQFDMGDVLIGGAPTGYCESGCSAIADSGTSLLAGPTTIITMINHAIGASGVASQQCKTVVDQYGQTILDLLLSETQPKKICSQIGLCTFDGKRGVSMGIESVVDKENAKLSNGVGDAACSACEMAVVWIQSQLRQNMTQERILDYVNELCRRIPSPMGESAVDCAQLSTMPTVSLTIGGKVFDLAPHEYVLKVGEGAAAQCISGFIALDVAPPRGPLWILGDVFMGKYHTVFDFGKAQVGFAEAA

SEQ ID NO: 25497 - protein, 380 aa, Sclerotinia sclerotiorum
MVEILSSALSLLRLGAAVSAAPAPAPTAAPNVADALAAVEKRAGSCTFSGSSGAAAAIKSKASCATIVISAVAVPSGTTLDLTGLKSGTHVVFEGTTTFGYEEWYGTLVSVSGTDITVTGTSGSVLDGNGAKYWDGKGTNGGKTKPKFFYAHSLKGKSSINNVKILNSPVQGFSINSASGLTLSGITIDNSAGNSLGHNTDAFDVGSSTDITISGANVQNQDDCLAINSGTGITFTGGTCSGGHGLSIGSVGGRSDNVVSDVIIESSTVKNSANGVRIKTVSGATGSVSGVTYKDITLSGITSYGVVIEQDYENGSPTGKPTSGVPITGVTLSNVHGTVSSSATNVYVLCAKCSGWTWDVNVTGGKTSTKCAGLPSGVKC

SEQ ID NO: 25498 - protein, 380 aa, Sclerotinia sclerotiorum
MVHILSSALSLLRLGAAVSAAPAPAPTAAPNVADALAAVEKRAGSCTFSGSSGAAAAIKSKASCATIVISAVAVPSGTTLDLTGLKSGTHVVFEGTTTFGYEEWYGPLVSVSGTDITVTGASGSILDGNGGKYWDGKGTNGGKTKPKFFYAHSLKGKSSINNVKILNSPEEGFSINSASGLTLSGITIDNSGGNSLGHNTDAFDVGSSTDITISGANVQNQDDCLAINSGTGITFTGGTCSGGHGLSIGSVGGRSDNVVSDVIIESSTVKNSANGVRIKTVSGATGSVSGVTYKDITLSGITSYGVVIEQDYENGSPTGKPTSGVPITVVTLSNVHGTVSSSATNVYVLCAKCSGWTWDVNVTGGKTSTKCAGLPSGVKC

SEQ ID NO: 25499 - protein, 166 aa, Escherichia coli
AKGDPHVLLTTSAGNIELELDKQKAPVSVQNFVDYVNSGFYNNTTFHRVIPGFMIQGGGFTEQMQQKKPNPPIKNEADNGLRNTRGTIAMARTADKDSATSQFFINVADNAFLDHGQRDFGYAVFGKVVKGMDVADKISQVPTHDVGPYQNVPSKPVVILSATVLP

SEQ ID NO: 25500 - protein, 164 aa, Thermus thermophilus
  misc_feature (20)..(20): Xaa can be any naturally occurring amino acid
MEARTTDLSDLYPEGEALPXVFKSFGGRARFAGRVRTLRVFEDNALVRKVLEEEGAGQVLFVDGGGSLRTALLGGNLARRAWEKGWAGVVVHGAVRDTEELREVPIGLLALAATPKKSAKEGKGEVDVPLKVLGVEVLPGSFLLADEDGLLLLPEPPSGVRSGG

SEQ ID NO: 25501 - protein, 431 aa, Pseudomonas putida
MNANDNVVIVGTGLAGVEVAFGLRASGWEGNIRLVGDATVIPHHLPPLSKAYLAGKATAESLYLRTPDAYAAQNIQLLGGTQVTAINRDRQQVILSDGRALDYDRLVLATGGRPRPLPVASGAVGKANNFRYLRTLEDAECIRRQLIADNRLVVIGGGYIGLEVAATAIKANMHVTLLDTAARVLERVTAPPVSAFYEHLHREAGVDIRTGTQVCGFEMSTDQQKVTAVLCEDGTRLPADLVIAGIGLIPNCELASAAGLQVDNGIVINEHMQTSDPLIMAVGDCARFHSQLYDRWVRIESVPNALEQARKIAAILCGKVPRDEAAPWFWSDQYEIGLKMVGLSEGYDRIIVRGSLAQPDFSVFYLQGDRVLAVDTVNRPVEFNQSKQIITDRLPVEPNLLGDESVPLKEIIAAAKAELSSAPARHHHHHH

SEQ ID NO: 25502 - protein, 472 aa, Yersinia enterocolitica (type 0:9)
MMLLPVIMAGGTGSRLWPMSRELYPKQFLRLHGVNSMLQETVNRLEGISVREPVVICNEEHRFLVAEQLRQINKLSHNIILEPVGRNTAPAIALAALNAVSQGDDPIMLVLAADHIINDCDAFHQAVRDALPFAERGSLVTFGIVPTGPETGYGYIQRGEVTVNELSEAFKVKRFVEKPDTETAEQYISSDEYYWNSGMFMFRAKRYIQELEKFRPDILDACKAAMKDSDSDKDFITIDKDKFSACPDESIDYAVMEQTSNAVVVPLDAGWSDVGSWSALWDVSSKDKSGNSVTGDTFLHDTQNCYINTDEKLVAAVGVDNLVIVSTKDAVLVVDKSKVQDVKKIVEHLKQTKRSEYRRHREIYRPWGRCDIVVNEQRFNVNRITVKAGGAFSMQMHHHRAEHWIVLSGTAKVTIADKTFLITENQSTFIPIGSLHMLENPGQIPLELIEVQSGSYLGDDDIIRIKDHYGRC

SEQ ID NO: 25503 - protein, 390 aa, Yersinia enterocolitica (type 0:9)
MSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEAGKYLVDVILDEAANKGTGKWTSQSSLDLGEPLTLITESVFARYLSSLKDQRVAASKVLTGPTVKPFEGDKAEFIEKIRRALYLGKIVSYAQGFSQLKAASEENNWDLHYGEIAKIFRAGCIIRAQFLQKITDAYAENADIANLLV

SEQ ID NO: 25504 - protein, 169 aa, Nicotiana tabacum
MSHYDNQFSAGQALQTDEYGNPIRQTDEYGNPVHHTGGTMGDYGTTGTGGAYGTHAGGGAGHTTGILGGEHRPGHEHGTLGGMLHRSGSSSSSSSSSEDDGQGGRRKKKGMKEKIKEKLPGGHKDDQTHSTATTTTTGYGMEGEHHHEKKGIMDKIKEKLPGHHGPGHH

SEQ ID NO: 25505 - protein, 220 aa, Escherichia coli
EFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 25506 - protein, 307 aa, Helianthus annuus
MANFPVINMENLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHESS

SEQ ID NO: 25507 - protein, 475 aa, Cadellia pentastylis
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATEGTCEEMIKRAVFARELGAPIVMHDYLTGGFTANTSLAHYCRDNGLLLHIHRAMHAVIDRQKNHGMHFRVLAKGLRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 25508 - protein, 475 aa, Guilfoylia monostylis
MSPETETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYALDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALFKAQVETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 25509 - protein, 471 aa, Convallaria majalis
MSPQTETKASVGFKAGVKDYRLTYYTPDYETKDTDILAAFRVTPQPGVPAEEAGAAVAAESSTGTWTTVWTDGLTSLDRYKGRCYHIEAVIGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREACKWSPELAAACEVWKEIKFEFKP

SEQ ID NO: 25510 - protein, 482 aa, Castanopsis inermis
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFIFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25511 - protein, 482 aa, Lithocarpus wallichianus
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25512 - protein, 482 aa, Quercus cerris
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25513 - protein, 482 aa, Quercus ilex
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25514 - protein, 482 aa, Quercus palustris
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25515 - protein, 482 aa, Quercus robur
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25516 - protein, 482 aa, Quercus rubra
MSRREGLMSPQTETKASVGFKAGVKDYKLTYHTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25517 - protein, 482 aa, Quercus suber
MSRREGLMSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 25518 - protein, 289 aa, Malus x domestica
MEGKEEDVRLGANKYSERQPIGTSAQSQDDGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRAVFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKKHAWDDHWIFWVGPFIGAALAALYHVVVIRAIPFKSK

SEQ ID NO: 25519 - protein, 289 aa, Malus x domestica
MEGKEEDVKLGANKFSERQPIGTSAQTQDEGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRALFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKRHAWDDHWIFWVGPFIGAALAALYHVVVIRAIPFKSK

SEQ ID NO: 25520 - protein, 306 aa, Oryza sativa (japonica cultivar-group)
YIASWLVKLLLERGYTVKGTVRNPDDPKNAHLKALDGADERLVLCKADLLDYDSIRAALDGCHGVFHTASPVTDDPEQMVEPAVRGTEYVIKAAAEAGTVRRVVFTSSIGAVTMDPNRGPDVVVDESCWSDLEFCKKTKNWYCYGKAVAEQEACKAAEERPFAASRRVNASAVHILKYLDGSAKKYANPVQAYVDVRTSRDAHVRVFEAPEASGRYLCAERVLHREDVVHILGKLFPEYPVPTRCSDEVNPRKQPYKMSNKKLQDLGLHFIPVSDSLYETVKSLQEKGHLPVLSKEIPEELNGVPA

SEQ ID NO: 25521 - protein, 434 aa, Brassica oleracea
MAEKSFKYIILGGGVSAGYAAKEFANQGVKPGELAVISKEAVAPYERPALSKGYLFPEGAARLPGFHCCVGSGGEKLLPESYKQKGIELILSTEIVKADLAAKTLVSAAGDVFKYETLIIATGSTVLRLTDFGVKGADSTNILYLREIDDADKVVEAIKAKKGGKAVVVGGGYIGLELSSALRINDFDVTMVFPEPWCMPRLFTADIAAFYETYYTNKGVKIIKGTVASGFTAHPNGEVNEVQLKDGRSLEADIVIVGVGAKPLTSLFKGQVEEDKGGIKTDAFFKTSVPDVYAVGDVATFPLKMYGDMRRVEHVDHSRKSAEQAVKAIKAAEGGGTVEEYDYLPFFYSRSFDLSWQFYGDNVGDSVLFGDSNPSNPKPRFGAYWIQDGKVVGAFMEGGCGDENKALAKVAKARPVAESLDELAKQGISFAAKI

SEQ ID NO: 25522 - protein, 500 aa, Brassica oleracea
  misc_feature (262)..(262): Xaa can be any naturally occurring amino acid
MGRKMLADGELDKAVAAEEATETHYDFDLFVIGAGSGGVRAARFSANNGAKVGICELPFHPISSEEIGGVGGTCVIRGCVPKKILVYGATYGGELEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFVRKELPVRGFDDEMRALVARNLEGRGVNXHPQTSLTQLIKTDDGIKVISSHGEEFMADVVHLLLARNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAEIMQGIAIALKCEATKAQFDSTVGIHPSSAEEFVTMRTVTRRIAYKAKPKTSL

SEQ ID NO: 25523 - protein, 292 aa, Klebsiella pneumoniae
MKLGFIGLGIMGTPMALRLAKADHALHVTTIGPVADELLKHGAQHLACAEQVAEQSDIIFIMVPDTPQVAEVLFGGHGCAKAVLKGKIIVDMSSISPIETKRFAQQVRDLGADYLDAPVSGGEIGAREGTLSIMVGGDENIFARVKPLFDILGKNITLVGGNGDGQTCKVANQIIVALNIEAVSEALVFASKAGADPARVRQALMGGFASSRILEVHGERMLNRTFNPGFKISLHQKDLNLALQSAKALALNLPNTATCQELFNTCAANGGSELDHSSLIQALELMANHQIA

SEQ ID NO: 25524 - protein, 388 aa, Ustilago maydis 521
MIANVSKSTASMLRPYKKPQHALAVLNGATTQRIACGPQDLVSCRPLSTSTLTAQSNPSGVGSSSLSSRSAPPASTELSPLQSPHKYLLEELVKRDHPSYLAHHFYPKHLQTHFAAIRTFNVEIAGLKDTVSNELLGRMRMGWWRDAVQGAYQNRPAKHPVVLALRDAFQDPAVRSNAGGGLMLDHFLRIIDVREADLSDDFQPPTLESLESYAESTSSRLHYLSLNLLGVRSDAIDELFSHLGKVSGLSLAISSIPYHTHPPPHMRNSTTKGARKLVLPREFLHLHKVVEEDVFRNGPEAHGFRDAVFALATRANDYLITARKIINDEFSGKLPMAVIPALVGVVPARSYLERLEKADFNPYDASLQSGKHWRLPWDMWRTSRKCSI

SEQ ID NO: 25525 - protein, 1599 aa, Ustilago maydis 521
MSADFPLGFLYSLPNRPKTKSLGDHIAEHVTDNGRISTLIDCLPSTSNPALWSPDLSRPPLEHRHIKSFVSNFILPCSSTRSPLGPNDRVMMALPTGPENALALLSVAAYHTCAPVNASCTAGELRDDAVRLRARAVVTTRDAVERLELHTLRDQDNMEIIFVEPRSSGPAGLFDMHLLGEKAIASTAGRRPSAPHGLEHQSLVLHTSGTSGKKKVVPYSLRHLIVGTCCVVYSWDLRPESVNMNMMPLFHVGGIVRNLWSPVFSAGSAIMCAGFDANAWWPLAKQLGATWYYAAPTMHHAILASKPEGIDAAKETNIKMIANAAGGLLPSLAVQLKETFAGCAVLPSYGMTECMPIASPPTNYQLDRPGCSGVACGPDLSIRDPFDKERELPVGQTGAVSVRGLPTFSGYETSPDPFEPLDTSAFSSEGWFDSGDMGHMDADGYLYITGRSKEIINKGGEVVSPFEVEEAITQACSDRVKQCLAFSVEHNVLQETIGIVIVPVPNQPRVGLAELHNMLRSHLHPSKWPFAAVYMDDLPKNQAGKPLRIKLGTRLGIGPLSDDVPPLQRHFEAKAPGKEVPLSEPIPCNLVTVDVRAVERACYRIPGIIEAAVRQRRDGSPEAFIQVEEDADYDAADIDRALAQVLHGYVVPNPLHVFRQPLAKNHGQIDFDTMEAEVRRQNASSMTRTALIVRDIIARLLDTEAGSITAESDFFLLGGNSLLLGRLVHLIRKETGVSLEVATLFNNSTIAGIADLIDDEQGDVDEDEDDFYDGYDDKNTLGATYAAHRYEDDEDVAFQSHGYKPRSQTHPWVLLIQAIPFLFFYPFKAAWTWTVILHGLAFSAFYIRDIFWERVGALLASILIARLTSRIICPITAIAFKWVVIGRYRPGKYPMWCNYHLRWWIVNQSLKTAGKGLFAMTPGLQKTYYRLLGMQIGSDVKIDQFAKIGEHDLITIHDGARIDKCLLRGFCVERDGYFRLEPIIIGRDCVVNTFTQISPGARLADGTVWGPQSSSHEEPSSDAFAAYNRNNAPQPHWALMVLIGWPIIFLVRFACYVPWFASLFMLLSQPFAFDHHDSVKGVIAWFAYPRRIGWHYVARIVRNGMPPLINLALGICVKRILGLNKEGSMRNATQYALFRRWMNQQLLSQPRVRRALAILGTHYEMTSVIFRAMGARVGKRVYWPGSSIYCPDPELLEIGDDVVFGSRSEVFTSDSIGWARVRVGRGAMIADRVVLLPGTIIGKQCVMGSGALARRNGHYEEGSVWMGCKHGEAVSFGKAVAEKSEGYTSDGSEETITPFGRAFYKRQANFFVFPYLMLVVINVGMTIFSSAYWASAAVGTVLVLNVLRKHFEFSPIGYLFDDHWWRPGLIYAMIAILFVVILTIQALLAFMWTIGTKWAVIGRRREGRYDWDKSSYCQRWQLHLTLQKLLGRGFGGHIYGNISGTAFAVWYLRALGAKIGKDCAIWAGGKPSLQLTEPELVSMGDRVSIDDCSVVAHINSRGRFSLNKLRIGDGCAMRTGSRLLSGASMEPRSMLLEHTLVASGEIAEAGAVYAGWPARQLRVRKANRGAGVHGEASAMSSTANLHMPQQVPPPGYYGQ

SEQ ID NO: 25526 - protein, 200 aa, Ustilago maydis 521
MTTTYFEQCKRSFADVPTEGGVDTVTFLEACEGLVKLFDLLGNSAFKVVQNDMNGNIAKVNNRLNATGAEKSGTLEKLVQNEGPGGSSKRPATEGLMWLLRGLDFTAQAMRNSVDNKNEELATSFTNAYSTTLRPHHGMLIRPVFALAMKACPYRKDFYAKLGEPQAKVDEELEKWLAALEKIVAHMKSFYASGKYDKGF

SEQ ID NO: 25527 - protein, 420 aa, Ustilago maydis 521
MSSVENTPPTVTAPPGSGGRLSTDSAFSQSRPRRLSMLRFERHKHHGASGNPLPHRRHAFGKPSFSGFQQHFMAGLGELIGTTMFLFLAEGGAKTAQLSVSAAQNETATPLSNETIMFIALSFGMSLLVSAWMFYRITGGLFNPAITIALWWVGVLTSCRALVLFIAQILGGIAGAALVLGLTPTNSISQVTTTLQPGISLAQGFLIEMLLTSILVFSVLMLAVEKHRATYLAPVGIGLTLLAAHLFGVVWTGCGMNPARSFGPAVVAGEFNSDHWIYWIGPLAGGILAVAYFSFLKVLKYNSVVMDQDSDKEITGLKPMHVRIWNLVRHRQNPGALNPESSTHYDKSARQNFDKEETEAFEEREAIRKQMMDKPVFDGHAHEAANGRMSERNNAELMSTSTGSTARLSSGGHQGAILPK

SEQ ID NO: 25528 - protein, 1722 aa, Ustilago maydis 521
MPDPRLYPDKHASTSSASSVNRSNDASARCSSLSPSHNILPSSRSTLRFPSQTPPASSSAAFVNAPPKPLDTHPRPSPSHADVAASSVYDERRRQSLAPDKAQRKSSGARSQPSSDHMPTSRQNIPPSHPSPKPNNIATRPPDTSTSKSAATLGNYQLGDCLGRGAFGSVYRGLNYMNGETVAVKQIQLGNIPKAELGEIMSEIDLLKNLHHPNIVKYKGSEKTKDYLYIILEYCENGSLHHICKRFGKFPEGLVSVYISQVLQGLIYLHDQGVIHRDIKGANILTTKDGSVKLADFGVATKTGAMIENAVVGSPYWMAPEVIDQSGATTASDIWSVGCVVVELLEGKPPYHFLAPMPALFRIVQDDCPPLPESASPIVKDFLLHCFQKDANLRVSARKLLRHPWMASARKQLEQLKSGGSLRAGGGVTLNTPHEEAVKSVQEWNQALNEPPKQTLQRLQEPETVRAPMKSSLRRVNAIAAELGTAKPLGGRRTRHTSRPTLPVDFSPPSAVPRKESATAYAPRISTKLLSPSFEPASASSDQLSLATNSKQPPSPVNGSGFRTPIAGAAPATSLMNHRVKLADLQQPESVDDNWDDDFEDNITTTKIAAALERSSSSEGTEAAAAGKDAAGKIGTAAVCRLASHSTAGHSSSSRSPTRLVGSEAEFDQRTIRPVAGPFLRSVASSSQVRNSPDLTADSSSPPSSRSFDDETGDDYSDLVGDGQEDVLNKRIRDLQMKNSVGKRLFHPNDLVRLASPAAGDKVSASAHGDLSPASPSKPSDRRTKASSDAMRSSLAASTARPPSDPVSPQTTLRLEKEGKWKQMRRTLGKYSEDHSTEDYSDLFGKADEGSNSKDDSVGSGNTLQLTARLSNRSWLRDDDADEDDPFAEIDEGFNAEADLEANVARDQHARMCAFVTELVESLDTHAGVDELLQVCEDIDQVLTDMPEMKAQLLASHGALALIQLLEAAADRELATRLLGILNLVIFEDPEAQESLCLIGAIPVVMTFTTKKWPHDLRLEAAHFVFAMCSTSRLTLQFVLSCRGLRTLVNLIDEDYLEQKDLVWIGVGCVSSVLELQSPASRNDFCRMLAQEGLLEPLSSALQSVIDDDQDEYASQARANILQILLIYSQSDNFLKRQVATRSVLRRILRSASRLEPESLTLMLKIVKNLSMSPTILDEMQNANTIEILTSILAQHHSGPHGTEMSNQVLNTMYNLCRLSKSRQEEAAQAGIIPQLLRVARTNSPLRQFALPILCDFAHAGKATRKMFWQHKGLNFYLKLLEDPYWQVSALESILVWLQDETARVEEVLLQPTSIESMLCVFATSKANSFENLLEPFAKVCRLSSGIVAAMARNTLFVKRLIERLAHPKAVVRLNLLRITKMICDLKGDVHSPLVDQLKVYDVVEKLSSTDNAVLVKELARDILSQRHIQWEASRTVRRTLSDTHMGEGARVSSNTGSMLPQGSAALGQLVGMRASAPYRRKMSNGTSGDAGDISSSSVAKSTIHERSISGSLIGSSPSSSSSMVGTPSTARSTAMRNLVGRLSQPRRAVTPNRDLMMNQSHTKFGSRGTSPLMVLEPLPQGEAVRLRQNSQPQMDSARGANDGSPDSLSSSRDAMEIKMADNSSGSHLGLSRGMSPRVRSISNEIKRAAAYANLGNSEDVQAQRISRHASVDVGARRGNLEELENEDAGQMQLHSADKDRTMRPPSRRPIPLLPSSPGFSP

SEQ ID NO: 25529 - protein, 193 aa, Ustilago maydis 521
MQTIKCVVVGDGAVGKTCLLISYTTNAFPGEYIPTVFDNYSANVMVDGKPVSLGLWDTAGQEDYDRLRPLSYPQTDVFLVCFSLVSPPSFENVRTKWWPEVSHHAPNIPTILVGTKLDLREDPETIAKLRDRRMQPITYAQGNQMARDIHATKYLECSALTQKGLKGVFDEAIRSVLAPAPVKSKKKNNCMIL

SEQ ID NO: 25530 - protein, 1066 aa, Ustilago maydis 521
MSFNWKGLLGVNQTSTSSSLGSPGTSVSNNASPASSSNGTSHVTSTSGATTHTTASSISAGSTAMSPVGPRAPLNANPYSLTQPSAPSAPLFGGMMPGSTSHHSTSYIPSSSSTTQSSVISRKPSEIPVNAAEGGGYLLGMENFGNTCYVNSVIQSLYFCRPFRDSVLSYKPSGRDRSGSDLSSTGGVHSVGDLASRTPPDTATQVIDGVPPSDTLFASLRDLFEVIQQSGYQKALSSPTRSTAPAPLPLASPISPSPPATGTAEYPSIARKTSIRGRPSTAGASSARVGAGNHLVSSASVGAGATAAQAIPIMPNSVAGSGPPNLSISTSSAGTLASGFPSVDSGAVKSFLTTLKRENVLFDSTMHQDAHEMLNFVLNKVGEDLIDADKAKSRVKSQSRDAYPNSRNMRNGSDKTVDVQRKRNVMEVAPNGKTCVHRLFEGVLTNETRCLTCETVTSRDECFLDLSIDIDKNSSVTSCLRQFSASEMLRSRNKFFCDSCSGLQEAEKRMKIKKLPNVLALHLKRFKYEETVQRYVKLAYRVVFPLELRLFNTSDDAEDPDRLYELCAIVVHIGAGPHHGHYVAVIKVGGRWVQFDDDVVTYIDEAELTKYYGDRPGLGSAYVLFYQAVDLDFEGLGLEDPALQASTQQRVVAGAASEARGRAGLKVPGGADPRSNISPDRSGAAATANQTRLNSVTEGSPLVSAGTGQPEAQGGNSWFGSFRKRAGSQSRRRPKTMSSMDVVTGGLSGLPELSASTAHGDLARQAVAEVDSTTPDNASVSTHSTTANDAASRVTPIKTSSSMPPATEHSALPSMHPLPSRTDSPSAGTEAAAPMRNALLPMTTASASVLDANATRATTESPSESKYVRMMANQSDAAANRETREQNLRRGEMNRRARAASEGFPSSGILSEAAISSGPFVTGPKDGTRVLLTPTAVVPNTLAASSSIAPQREASSGSGFAPLERFLSSKTQKSQAKMARRASSSYTPLSPTTDKGERKEGMLLNLFNSSSPSASSAAQSKRNSMQHLSNGSTNVVGGAEDTGLPTRKSSISTRTFSKTFGFGRKS

SEQ ID NO: 25531 - protein, 374 aa, Ustilago maydis 521
MDLRVGGKYRIGKKIGSGSFGDIYLGINIISGEEVAIKLESIKAKHPQLEYEAKVYKTLAGGVGVPFVRWYGQECDYNAMVIDLLGPSLEDLFNFCNRKFSLKTVLLLADQMISRIEYIHSRNFIHRDIKPDNFLMGIGKRGNQVNVIDFGLAKKYRDPKTHLHIPYRENKNLTGTARYTSINTHLGVEQSRRDDLESLGYVLMYFLRGSLPWQGLKAATKKQKYDRIMEKKMTTPTELLCRGFPSEMAIYLNCCRSLRFDDKPDYSYLRKLFRDLFVREGFQYDYVFDWSIQQRSEDAKADPVVKQQQAQQQAAQLPRRKVLPQEGDEAVANGMDTTRTAYGTARPADKAYLTSQNMPSSSRPPKREDQTGYY

SEQ ID NO: 25532 - protein, 491 aa, Ustilago maydis 521
MAQPLSQPYHNSFASMTSHASHASSGSNVVGVHYRVGKKIGEGSFGVIFEGTNLLNSQTVAIKFEPRKSDAPQLRDEYRTYKILSGCPGIPQVYYFGQEGLHNILVIDLLGPSLEDLFDMCGRKFSIKTVVMTAKQMITRVQTIHEKNLIYRDIKPDNFLIGRPMTKGANLVHVVDFGMAKQYRDPKTKQHIPYRERKSLSGTARYMSINTHLGREQSRRDDLEALGHVFMYFLRGGLPWQGLKAATNKQKYEKIGEKKQSTPIKELCEGFPEEFGIYLNYVRKLGFEETPDYDFLRELFTKVLKSSGEQEDGVFDWMLLNNGKGWEAGTSRDRRDERERERQRETRASAAPQASAAAAQQPAALARNGSKGGRKSGGAQQHLQSDRSQAGQLRASHGDYTQSGSGYGGVGHASNVAVHDATVVGIPNQNGTREHSHVGHMTPTAMSSGNGLDRRGDTRQAVGISNGDDHHPAERKTVGQKLMDVLTCRCG

SEQ ID NO: 25533 - protein, 191 aa, Ustilago maydis 521
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVHHHCPGVPCLIVGTQVDLRDDHAVIEKLARSKQRPVPFEAGERLARELGAVKYVECSALTQKGLKNVFDEAIVAALEPPVIRKKSKCAIL

SEQ ID NO: 25534 - protein, 168 aa, Ustilago maydis 521
MSKTLLKKSEWERQLSSINVAKDDLNRLVMDYLVIEGYKDAADCFSKESGLKPFVDSDSILNRMIIRGAIQRGDIDDAIGRVNELDPEILDNNPLLFFHLQQQRLIELIRAGLVNEALAFAAEELAPRGEEHPDLLPELERTMALLAFDVPKAAGVAATVSDSRRLES

SEQ ID NO: 25535 - protein, 424 aa, Ustilago maydis 521
MSAHPSNPHRTPYNVLNQTFLIDNAYAITKDLGQGAYGCVAAATHKGTGESVAIKKITNVFTKKILTKRALREIKLLRHFRGHKNITCLYDMDIIDPVGFNEVYLYEELMEADLHAIIRSGQPLSDAHFQSFIYQTLCGLKYIHSASVLHRDLKPGNLLICDFGLARGFETDPELAKQVGAGFMTEYVATRWYRAPEIMLSFQNYTTAIDIWSLLGGRPIFKGRDYVDQLNQILHYLGTPSEETLRRVGSPRAQDYIRSLPYQPRIPFDRLYPQANPQALNLLERMLEFDPAKRISCEEALQHPYLSVWHDPADEPVCPRKFDFGFESVDEVQGMKTLILEEVRSFRTEVRRQARLMQQPKRQESLPIPSREDIQRSSPTEEGNPAYSVLGASAGIIQGATNSEHASGVLNDACSKDVGLGSLG

SEQ ID NO: 25536 - protein, 1012 aa, Ustilago maydis 521
MASFFQKARERAEAAAQQLQAHHAASSATKINDTSASANVTASGAGSASSFTYTGSVPHLFRQGLASVDPRYESTRQFHLLSQAFKSFNIDHEAAGREARGLAKATFVWGQHHLPEKRDDSVGDEMLADVTDRLAYVWHELGQLETAHSQRSEQARGRLKSFEKAEMELGQRRAHRSKLRKELHALVPERAIAAGSSRVQDLETRLEQLINDDQADEEYLSRTKRQSVKEGYAAMFDSLIELGEKMALVARYGKLLTTLMPIEKSPFPGTVKQRGDNIPLWEGASKTADVRAALASALSSFRPDLSLPILPADSALAATSSLGRTDTVSYAVSHQSELQADYTAPVVSPAAAPLAQLSSPRSPGLSPDRSDMVQLANPTSQHSGSGSAQKLNLSPSALPVPLLPPRPQRSPSATTVDTLRSPAADPFADSAAAAAPSSSISAAQTEEALPPPGPPGPTVAETGVVPSGPGGPKSGTLQPRRSSASQRSVSISAGAVAYLGPTGTYSHQAALKVFGATGTNLIPMQSITGAIDFVRRGTPGNAKIAIVPIENSTFGPVRDTLDNLLGISNGDRHAFKPADGAQLHVVGEACLSVDHALLCGPKTYHHLLQLQGDTDPNAPIRDDTLSNITNVISHEQALGQCSHYLTRYMPQAKKRAVESTAAAAITALEFEAGTAPGRTSTSIDHAHESLGFSSNSLVAAVGAEVAVTAVGVRVLRSRIQDVKDNRTRFLILASEPLEALLSINALPLTISRLYSASSAARKTGRSLLSVSDTLVSDLAAEADNYSSSDSSVLDRLVAQLAKLNDVSVRKLDRRTASTSEAFAASGSSVWRSSYLVELQYAGASAAVAEDKIRRLVAELSIGSSATRLLGDTAPVKHLGSWLVDATMLRGESTDNAGGQAAQSVLTAGPSGSHLSQSTLPGSLQLTERERKETEARQEAAEVQRHAAQARLSRQQQQADLYRVEAQPSGSSTSGSRLTLPLAGLQESEAEPRLDEEEGLPAYQPLDPGSRSR

SEQ ID NO: 25537 - protein, 462 aa, Ustilago maydis 521
MPSHQSTNAACADMDTSRFVSGLTPPLVDSIDALKISNFVPTRSGHPPPGSVPESILPEGVKKPALFQTLTLPFAAPEQAGKMTFKNRIIVSPMCQYSANNGLPTPYHIAHLGSFALHGVGNVMVEASGVEPEGRITPQDLGIWSEQHRDAHKALVSVLKSFTDGLGVGLQLAHAGRKASDWSPFYRGEKKQKFVTQEEGGWPDRVVAPSAIAYAQGHVTPRALTTEDINKLQDKFVQSARWAFEAGYDYVELHSAHGYLMHSFLSPLTNQRTDEYGGSLENRARFLLNVARRIRQEFPNKGLWVRVSSTDWADQAHQADSWTVDQTVELAKMLQEARVDLLDVSSGGLVPFQKITVGAGYQLFGAKAVRDALAKIEPDASKRMLVGAVGMMEGSYDSPNGQDRSQIGKLAEQSIQSGECDAVLLARGLMSYPSWTEDASVALMGTRAAGNPQYHRVHVAKK

SEQ ID NO: 25538 - protein, 496 aa, Ustilago maydis 521
MASTGLPSSLGDRSSGSVSPTQTVDVEKNGASHDEPVKVSQTQPATQTEFGEKREQYRSEEDYMYEQQKRSEGDHKFHRLGWKKLTVCLIVEAIALGALSIPSAFATLGMVAGVIVCIGIGLIAIYTSYIVGQVKVKFPQVSHYADAGQLMMGRFGYELVGAMFALQLTLLVGSHCLTGTIAFLNLSNNAICSLAFGVISAIILFIVAVPPSFSEVAILGYIDFASIIIAIGVVIIGTGIRKSQPEHALTLTEWSAWPKEGTTFADAWVALTNIVFAYSFAVCQFSFMDEMHTPTDYVKSIWALGIIEIVIYTVTGALIYAFVGTEVKSPALLSAGTTLSKVAFGIALPVIFISGSINTTVVARYVHGRMFKNSVIRYINTKMGWLTWLGLVALITVIAWVIAEAIPFFSDLLGIMSALFISGFTFYLPALMWFLLIKEGKWNATRWNTILSVVNAIVFVLGLLILVCGTYASVQDIIDQYNKGTVRGSFTCGPIG

SEQ ID NO: 25539 - protein, 397 aa, Ustilago maydis 521
MQLKLSFVAGLIASSALAVAAPVEQERGIEVGISKRATLTKEGSSEIDWAKVDAHMNGLRAKYSKSFSNYEKNTGKVHPAKRDLPEHLAKRGTGTIGLTDQQNGELWTGTLAFGTPAQSFPIDFDTGSSDTLVNPGAYDPSQSSTSATNGDQFSTAYGDGTTAQGTIYTDVVHAAGLTASNAAIGVSNQEFISSSEGSQGISGMALPQLSAFGSNYPPYFYSLKQSGAVSSGKFQFDLRTSGSTLFLGGTNSAKYSGTPVYQSIDSSRGFWQVPASVNGQSIESIVDTGTTIIVAPTSQAKQLFSKLGLPTFTQDGSTYAYYNCNSPPTITFKYGSYSKSLSAATTSFGTTNNGQCVLSIAGGNVGVNGWVTGDSWLQNTVAIFDTDSNRVGFANKA

SEQ ID NO: 25540 - protein, 422 aa, Ustilago maydis 521
MSARGFSSSRSLAPTILQSTLAARATIITRPSRAFGHASIAPRCGQQFNSSRPSIVATCLKTVQFRTMSTEIPSQMKAILVKDGKGPSDNLYLGEAPVPELGEDEVLVKIKAFGLNRMDIMQREGNYPLPPHAPQIMGVEFSGHIVATNKPKEIQWKVGQEVFGLAVGGAYAEYIKVPSRMILEKPGELDWVQAAAIPENYLTAFQALRTIGGLQRGEDVLIHAGASGVGLAAIQLARAFGAGKVYITAGSEDKIKFCQEVGADKGFNYKAVDWAEELAKHTGAKGPAGSVDVIVDFIGAPYFNGNLQSLKRDGRMILLAFMGGAKIKETVLAQILFKRLRIEGSTLRSRSVEYQSNLVQGFVEEKGLERLISGASKDADSNDASHRLVIHKVYSWKDIKEAHDEMEANKNIGKIVITIDDA

SEQ ID NO: 25541 - protein, 110 aa, Ustilago maydis 521
MAQVERSSPAAAASTGPSPLGSVTEPFDLIRLSISERVYVKLRGDRELRGTLHAYDGHMNLILGDVEETIYVVDVNDESGSETVRVVKRQSEMLFVRGDSVILVSPPSST

SEQ ID NO: 25542 - protein, 348 aa, Ustilago maydis 521
MASYTSIVRDMLRPSTSSSSSTAWWDPNTSMPVLDDRIVIITGPTSGIGYETLRQLVLSSAHVYLFGRSLGRLEQTRATLCVECSAALDALEPRSLRYGAKVGSMHLIQCDLSDLHSIQRAVTEFLQSETHVDLVFANAGVMLSGKTAQGYEQMFGTNVLGHHALVRLLLPALRRSATLRNSASTGETRIVLTASDTHRWVNHRDHVTLSDDATNAKLGHMHLYGRSKLGNIYTAAHLAHLSHKHAWGLTVCSVHPGGVKSQLGSTNRILTAIKNMFLVPATLGAVTQLWAGAGAQAAQVNARYLVPYATVGTESELASNKLVRDNVWTWCEQQCLKHGLTQPQDLIL

SEQ ID NO: 25543 - protein, 1220 aa, Ustilago maydis 521
MSSSAETSPPRAGSYILISSSTAALDAPAPAADESARVFGSRPRLFFFLPLLAALDVATTLTLGILVLNQLAKHDEPAAHILGGPLSHDPVMTSSLPGRTDPRLDDAAWERRKIVLLVIVFSIARAFSYGIVGFSIRIRQLGVTVAAISILSTLFYVSVANLLFQARPKPGIVDKRSNSWSGVLASDAWRWPDAFRHFEPTMPILVGVQMAFTLFEWILYIAIVGVKIPPGGNPVEAKRWARDLADDPQYRRGADMHSLYLSDDGHDQDITEEVRQPLEHLDAQDGGELQEVRTQLSSPISNLSCRGKSDGSDQPLLGASSSTPRGYGSTLADPKTPQGPGSVRSVRSPVALQQHGMSRSSSALSGLYSRSPGTAELGPADRYEEVLADDDDDEDEQDGEGDEDAEGSDPDDIIDITPNRAVARKEARLRLARAALPARRASGGTLSTLNLFGGGGGSTNGSSGDAVSTRTGGGGTGGAGIFSDEAGSPLGRNAREGDVSRPALLSVATSDEASRGESLAADPSIQSSNSMTLPSSSSTRTASTRASSFKDRKFKLPKWIKRGNSRSSCERQACPPTTKSRMSAQLSRADFVLHLARASLSPPIDRECEITNRESRFVISTGLARIQNPYKLTSSTVTALFKALRSAARSVKITPLALFSSVRVLRASRALGPSTTTTFTRAISVGVATIDKLRSSTTSACARLPIATASVAANRLQQTSTHLSSFSHFSTSSAVKMPPVPKPTSTHYDMVVIGGGSGAMGVSRRAAAYGKKVCVIEEDGRLGGTCVNVGCVPKKLMWHAADMAEHLKEAPEYGFGDVVNKPKVPEFAWKYFAEKRDAYVRRLNGIYDRNLDKDGVEYLSGHGKLTGKNEVEVTMRGQDGSFNAGTYKITGDRIVIATGGRPVIPSDDKIPGASLGIDSDGFFELKEQPKRVAVVGAGYIAVELAGVFNTLGSQTHLLIRHDTFLRPFDPIISETLQDYMSRTGLNVHKQTNITKVEGSKGGPLTIHTDKGDSIEVDCLLWAIGRRPNTDNLGLETVGVQLDKGGNIVVDKYQETNVRNVFAIGDIQGKALLTPVAIAAGRKLSNRLYSNHASLKDDHMDYDNIPTVIFSHPTSGTVGLSEAQAVQKFGRENVSIHTSKFTSMYYGMLDHKAPSAFKMVVAPGDKVVGLHIVGLGADEMLQGFAVAIKMGATVKDFQDTCAIHPTSAEEVVTMIPTTKHA

SEQ ID NO: 25544 - protein, 452 aa, Ustilago maydis 521
MPAADFDAAAFGETHITKGIGRLSKHVFEDGKGSWITTDKGVKLLDMTSGIGVCNLGHCHPKVTEAAVKQCAKITHAQVNIGFSAPQIELIKNLLPILPHASLDTVFFWNSGAEAVEAAVKLARAATKKQNVIVMQGSYHGRTAATAALTRSKTIYGEGHGPLMPGVFATSFPFYSHFGLPVDTDVEELVRQSLHQVRLTLQQQTAASDTAAILIEPVIGEGGYVPAPASFLHGLREICDENELLLICDEVQSGFGRTGTMFAVEDSGVRPDVLIFAKGIANGFPLSGIASTNQIMSRQKPGSMGGTYAGNAVSCAAATAVIKAFKDEHVLDNVAQRSKQLVSFLRALQHESKYGHLIEDIRGRGLMIGVQFGSPVTKTDSHNSTAANPRKPEQIAPKVVAECLKRNMLLLSTSVFDVLRFIPALNISQDELSHACTIFKQAFEAAAQELGH

SEQ ID NO: 25545 - protein, 374 aa, Ustilago maydis 521
MSAREKRSGDAESTPVTVADGVHTHGVLNQHPNASPSAVAGEVANGSSAGSKADLSFRVGISEDSNKRWRRAMEDAHAFVYDFAGVHGQGFFGIFDGHAGKDAAEWCGQNFHKSLLKTLELNPDKPVPDSLNLTFHSVDRELANLASQQGSSSGCTAAIAFLRLEDESGQPLKVGGRASTGPDGHAHEEATRPEHSSERTSGDGLWGKLSKRFDSSDPKNERNSSPSSRRVLYTANVGDARAVLCRGGKAIRLTYDHKGSDAQEAKRITDAGGFVMNARVNGVLAVTRSLGDSAMKEFVVGSPYTTETVLGNEDSFLIIACDGLWDVIEDQEAVDLVRDVQDPQVASQELLKHALNEFSTDNTSVMVVRFASPS

SEQ ID NO: 25546 - protein, 342 aa, Ustilago maydis 521
MSGGRSCARVYPGANEKFGRPWWDYDNLAVQWGTQDNYEILRKVGRGKYSEVFEGVNIASASGVPEKCIIKVLKPVKKKKIKREIKILQNLAGGPNVVGLLDVVRDPQSKTPSIITEYINNTDFKVLYPKFTDFDVRFYIFELLKALDFCHSRGIMHRDVKPHNVMIDHEKRKLRLIDWGLAEFYHPYTEYNVRVASRYFKGPELLVDFQEYDYSLDMWSLGCMFASMIFRKEPFFHGHDNYDQLVKICKVLGTDELYAYLEKYDIDLDPQYDDILGRYQRKPWSRFITSENQRYISNDAIDFLDKLLRYDHQERLTAKEAQDHPYFEPVKAAAARGEVVAS

SEQ ID NO: 25547 - protein, 464 aa, Ustilago maydis 521
MTMPNATGSTWRSAHSSPRRVSMATPIRALVHVANLPATTTERALREMFGSLGQMQSARVVASRSAGGLAYGFVEYVDVASAERAIRTMNGWVWFGTPIKVCWAKHSMHPDAVNEWVEVDRPVGMRSGVHSHLFVGDLSPDVDDALLQSFFSRFTSLADVRVMYDAATGKSRGFGFINFRSKQDADDCIATCQGQWLRGRQIRVNWANQKNQPSQAPATLTPTATATATATCSAYSDTPLSLSHAGSGVSTKTSATPSELSSTSSLINDASLQVALPRRHTTLGSQPQLSTITRNPANILRYNYDRVVSEAPSSQTSVYVGNISPLTSQQDLVRIFSPFAHGHHLEARIPPGRGYGFVTLNTHEQAASAICTLSIQGVFMHSRWLRFGWQKNRPSPLPIQHRSESAPEHMLYTLHNQPRQHTPNQSSQSLPSQQNILSRTQPQPHQQKPPPPSSSSSSNEFQPF

SEQ ID NO: 25548 - protein, 1152 aa, Ustilago maydis 521
MSSKAIREFDAKLLVNYWLPRSPLAHADLKVNADFVAPAPKVAQIAWDPVTNSITDASQLPAWVQSSKLVAKPDQLIKRRGKAGLLKLNCDWADAKTWIQERAGKAQKVETVTGTLNNFIVEPFCPHPADTEFYVCINSAREGDWILFTHEGGVDVGDVDAKALKLLIPADPAAPFPKREEWTSTLLGGVPAAKREVLTDFLIRLYSVYVDLHFAYLEINPLVATDDGQIAYLDMAAKLDQTADFICGPKWAIARDPSIYLGASAGASGNKGEDRGPPMYWPAPFGRDLTKEEAYIAKLDAGTGASLKLTVLNPTGRIWTMVAGGGASVVYSDAIAAHGYAHELANYGEYSGAPSEGQTFEYAKTLLDLMTRGEVNPQGKLLIIGGGIANFTNVASTFKGIIRALKEYKLSLAKHGVRIFVRRGGPNYQEGLKAMRLLGEDLGVEIQVFGPETHITDIVPLALGVKTFEEVTLASQQQNTLPSGAATPAHGAANGTKAENKAIGTVDHNTGERVQPQDQIVHFGAGSTTGERPAYRPFDANTRSLVFGLQPRAIQGMLDFDFSCGRKTPSVAAMIYPFGGHHIQKFYWGTKETLLPVYTSIKEAVAKHPDADVVVNFASSRSVYSSTLEVLDCPQIRALALIAEGVPERHAREILHRAEKAGVLIIGPATVGGIKPGCFRIGNSGGMMDNILASKLYRPGSVGYVSKSGGMSNELNNILSITTNGTYEGIAIGGDRYPGTTFIDHLLRYEQDPECKMLVLLGEVGGIEEYRVIEAVKKGTIKKPIIAWAIGTCAKMFTTEVQFGHAGSMANSDMETASAKNAAMKAAGFIVPDTFEDLPAVIREVYNKLVASGTIQPKPERPAPAIPVDYKWAQELGMVRKPAAFISTISDERGSELMYSGVKISEVFESGMGIGGVISLLWFKRRLPDYCTKFIEMALMLTADHGPAVSGAMNTIITSRAGKDLISSLVSGLLTIGDRFGGALDDAATEFSSAYDRGMTAREFVDSMRKANKLIPGIGHKIKSVSNPDYRVQVVKEFVLTNFPSHKMLDYALAVEKVTTAKKDTLILNVDGCLAVCFVDLLRDSGAFTIEEARDYLSYGFLNGIFTLGRSIGFIGHHIDQKRLKAGLYRHPADDFHIEMATPARVMGTLKK

SEQ ID NO: 25549 - protein, 339 aa, Ustilago maydis 521
MASNIRARDDLLEGDLAYVEAEQIEEDEEEEDEDVNIGAYEDEIYESESPSESGTESLTWISWFCSLPGHEYFAEVGEDFIEDDFNLTGLNALVPFYKEALEMILDVEPPEEDSLKIPDVSIVESSAELLYGLIHQRYILTRHGMQQMVDKYEAGHFGFCPRVFCHSHPVLPCGRSDLPGLDTVKLFCPNCIDNYSPPSSRFHGVDGAFFGTTFPHLLYQCYRDLFPSILDPKQAGAESNSVLQYNADASGAGADSSITPVIRGATIEASAAADAQAASKATTLAHRTIQPEQLGKRVAFTRTYTPKIYGFKVSEYAKTGPRMKWMRLRPTSLDQLDRI

SEQ ID NO: 25550 - protein, 280 aa, Ustilago maydis 521
MSAQATNNAAGEAVGAGASAGAAASPQKPFQTKLVLLGEAAVGKSSVVLRFVQNDFQENKEPTIGAAFLTVSMSVSSIQKCRLEDRLIKFEIWDTAGQERFHSLAPMYYRNAQASAVIYDVTKASSFEKAKSWVKELQRQANPNIVIALVGNKIDLLNETSSSSSANAETEDDDDDDTATTTPEATAAAESLRAVPKDEAEAYAKEAGLLFFETSAKTGEGVIEVFTEIAKKIPIDLHLARNAAAGAAAGNGARQASGGQAGSVDLQNNQQGNRKEACNC

SEQ ID NO: 25551 - protein, 155 aa, Ustilago maydis 521
MCSDGYEMKLVEDVVYEVDAAKIVVSDGDVDIGANPSAEEAAEALENGAEQVINIVHSFRLQSTQFDKKSYLAYLKGYMKSVKAKLAESNPDRVPAFEKGAAAFAKKIVGSFNDWEFFTGESMDPEGMVALLNYREDGVTPYLVFWKDGLRETKI

SEQ ID NO: 25552 - protein, 451 aa, Ustilago maydis 521
MSNALRNSLPALRRAVATSGVRKPTPVALTAATSSVPIRPYGTTPDTAREQYNMTKFSKFDWQDPMQMFETQLSEDEKAIAQTAHDFCQETLKPKVTEMYRNESWDPTILPSLGELGLLGSTIEGYGCAGVNSVSYGLIAREVERVDSGYRSIMSVQSSLVMGPINQFGSDAQKEKYLPRLAKGELVGCFGLTEPNHGSDPSSMETTATDTGDGHIVLNGSKTWISNSPHAHVFVIWAKCKWDNKIRGFIVEKGTKGLSAPAIKNKLQLRASVTGSIFMQDVKVKRDESLLPHARPGLGSPFECLNSARYGISWGAMGALEACIAEARQYALDRSQFGRPIAAFQLIQQKLADASTEAALGLLCSLQLGRMKDSGAWSPEMVSLAKRNNCNKALQQSRSLLDIFGGNATSDEYHTGRHVQNLQTVNTYEGSYGIHTLILGKGITGLQAFAN

SEQ ID NO: 25553 - protein, 136 aa, Ustilago maydis 521
MSSGGKSGGKAGDASSKAQSRSAKAGLQFPVGRIHRLLRKGNYAQRVGAGAPVYLAAVLEYLAAEILELAGNAARDNKKSRIIPRHLQLAIRNDEELNKLLGGVTISQGGVLPFIQSELLPAKSGKPKKAGGSQDI

SEQ ID NO: 25554 - protein, 1955 aa, Ustilago maydis 521
MSFHLDSFVNSPASADQAPAWQLHSSTDSYLEWDANPKSLIEQQPSSTTTSPPPSMSRLRSTSSTVATLAPGAQTPAEPPSTDSASVLSHNGHTTSPERSVSPSYFTKLYFHPPDRTTSATSPTITFTSAIEPSLVAHAQPSPLLPTDAQSASHLPSPARESHTGRRPSISAVGSSSTTSPLTTPLSPTLSSRSSAAGGGFFASLRPSSPGNLPISTSKPQDGDNLGKPRRPSSVFDHVGNVWERFGRKVHHTRTATSEHHSSSSSHTRRSASQASPPIGLTPESADPFDTARNSPSGSFISQASPSQSTTTDSECRTPATPGGEPPAQLSTPQPLPSAPAYTSVSALDSSVNAPQQEEAEELPYLAPESPRPQPQSFNTIGSPRIPSGQRSATSHRRTSSLLERVLIQVTDDNERFSVVDISGVDSADAIKERMFAKLHLFDADHSSFQLFRTEIGQSEATGPVVSDDALLVLCLQMGDDRGTLKFLVQQIAPPPNSTVRALPPPTSTIVSQRAINNIRRTSGTGSAPGQHLRTESQSSKSSLSDALVYPEMIGADAAHEGSNRNSGSSLTRSKAQTRRALPSAPPVDDLRSPTHSCISSTTQSAVQDRRSIASSGDGSANESWARHGASASDGAPSAIPTQRSSSVNANASAAQSSSSGSAGRHPSNLEDDRQRYDAEPGVNRSLHAPATGSSHWQERSDEGARESLRVQTTAQLPGLTLHNAKSMDDLHRPSQSASQPSTLTTQAEVRKQAGMDRDGRYPTPAIMRPSTAAPAGAGARESASSHRQYSSDALGSSRSPQEPTLGLDPRMLQRNRSAQAAIPSGQQLVNHGPTRMSSTPQIRSPPMQHVYLGQGQIDPRFNTQPPHSAHPMQAHPSNMVARPPYSAAPSFASQPAYQSQSFGQAALRPMGHGFVNEFGARAPAASVNFNTYHGHDPRMNASAMQGSLTPRPYSYYEQPSMHQQQPMYRPYAQPSLVTASPYRTREDPFTTRYFPASSSRQVSEFQMQAGRLEPGMTVQQTLRTQEAIWGHTSAGSPGQAYQSAHAHPPGPSYGPRDPRQPGQSNQYTGMQAYPNASAAPQMQQRPSYQGSAMPNLHHVPPPRPQSYPSAQPQPQPPRNAHDRHPAPPAGHSGPQMMPQSSGSSAGRAPMQPQQNQQLSQPSQPSQREQPGHAQAMPGSESHRRDPPVRTNASERSSGSSFSSQGSFQHGRPHNDDCNSRNSIEESFSAPTSARSSQSEAASAKPVNVEHRSSYADQERDLADDELEHVRPLPKLPHSSATTRTDAFKSSSCDASGATVGGSVRRSEDEDTLRAGEWAQLWRALDPKSDGTVSGTAISGSSGGDGDTVRAEPSTPGASRPQTKDGATLPISLEPPRIPSPSLAPEENGTVSSFGTFDDDETESGTWAQPLDSDVNAPRLPLRLDADSEALSDDHATLLPGQDTLLQASTRGTRGFSAASNSPKRPELRLTIDPAAGPTVMTWTASQASTNSPRASTSHLSSALNSGGITRSNSFARRDDDWAFRPPPEQLYENLDDFFPKHDLDKPLLDTTAGPESGLVSSPRAEASVPSVASVGAQQGLSQRSRHKKSIRLVAEDRKRILERADTRRAAQGAELSSGLVRRRSTKLWGTKVVEMTPGQELATPASATSAESPWSDTASTTGQPVFKWVKGDLIGKGTYGRVYLALNATTGEMIAVKQVELPRTASDREDSRQKGVVAALKSEIETLKDLDHPHIVSYLGFEETRQFLSIFLEYVPGGSVGSCLRKHGKFEESTIKSFLHQILEGLAYLHSKGILHRDLKADNILVDFEGTCKISDFGTVRRSDDIYGNVENMSLQGSIFWMAPEVVSLSKKGYSAKIDIWSLGCVVLEMFAGRRPWSDDEAVQAMFKIGAQRKAPPIPADVKLTKQAAHFLKNCFEIDPAKRPTAQRLLDHVFTVPVPGWQFSHSALCRSLHR

SEQ ID NO: 25555 - protein, 364 aa, Ustilago maydis 521
MANLMSVFTPKGGLEATTTAIILPPSSPTPFTFTYARLHELVLDLQSQLASYNLAPGIAVSSSLANGIEFTLAFLATGAERLVAAPLNPNYSQGEVEFYLQDTKSQLLLLPKGALKAGHPAVEAAKKVGGVDVVEIVFDPSHSGSISLVRADGSNVGKKSQIRKPQDDDVALVLHTSGTTGRPKGVPLTHRNLYTTMGNIIATYNLTPVDRTYLVMPLFHVHGLLCGLLATLLSGGSAVIPPKFSASVFWNELSTNKCNWYTAVPTIHQMLLNSPLPNPVPKLRFIRSCSSALSPSTFHQIEKTFRAPVLEAYAMTEAAHQMTSNPLPPAKRKPGTVGIGHGVEIRILDEQGNEVAQGTIGEAT

SEQ ID NO: 25556 - protein, 213 aa, Ustilago maydis 521
MAAESNYDYLFKVVLIGDSGTGKSNLLSRFTRNEFSLESKSTIGVEFATRSISVDGKTVKAQIWDTAGQERYRAITSAYYRGAVGALLVYDIAKHPTYVNVSRWLKELRDHADSNIVIMLVGNKSDLRHLRAVPTEEAKAFAAENNLSFIETSALDASNVEQAFQNILTEIYRIVSNKALQSSDDVIKPSGGETITVQPSADDGGQTKKNGCC

SEQ ID NO: 25557 - protein, 511 aa, Ustilago maydis 521
MPTSSPPSRGDAKSSVTTRFRFVLLWILFSAANYGYGISELNALQPMLTCQVRSPSPSPSASVSVSASASPSSGCISLTEAQFGLVTSLFTLGGLISSFLISPLSKSLSWGRKTCITASASFGILGSLVLTFSSSLTGLGIGRFVQGIGSGIGVVIVPIFINEISPTALKGSIGVLNQFSIVLGIFVAQAIGASWLGSDGWWWRSVPGVSGALSLLQLLGSLTVGLESPGWLEGEGKKSWTMRANDEADEVRKVLWSAKEVQSWKEGRRSTGSNDDARSDEERQALLAGSEADASRANVSSMEVKVGLCTLFSDPELRPGTLLVMLTQLGQQLSGINAVLYYSVGILGSIVPSLAGSIGIVITLINIVMTFPPIWLIDERRVGRKTLMLASALVMSIASALLATGIVYGYKIISAICMILMVAGFSFGLGPIPFVILPELVASRAVSTTTSLGLTLNWTANFVVGSAFLPIKNWLAGYDADHTGGAVFWIFALTNLATAITVAKMYRYQPE

SEQ ID NO: 25558 - protein, 238 aa, Ustilago maydis 521
MTRISSTLVLAAALAFMSSSLLNVSAATLPAHNVAERDIQVQSTPGQALAPGLATRDAQEQKSADATNSWDCKWWYGRWVCTWKDDWSRNSHDAHNKRDDIGTLDEGHEISELVERDDWRGGHGGHDRDHGHHRGHRGHGGHDRDHGGHRGHGDHDRDHRDHRGRSDLMNGHDVKELEARDNGWGGWGGWGGGGGRGGGGGGRGGGGGGRGGGGGGRGGGGGGRGGRGRFVEAEAKQE

SEQ ID NO: 25559 - protein, 161 aa, Ustilago maydis 521
MVSFYDLKAKKPSQEDYTFDQLKGKVVLVVNTASKCGYTPQFAELEELNKKYADQGLQIIGFPCNQFAGQDPGSDESIGEFCQRNYGVTFPMMAKSDVNGSNTNEVFQFLKKEKAGILGTEMIKWNFTKFLIDKEGNVIERYGSNTKPSAIAPAIEKLLSQ

SEQ ID NO: 25560 - protein, 383 aa, Ustilago maydis 521
MGLFDAEKPVSKLDRHRVLAPKGGVRVSPLCFGAMSIGDKWKDMLSGGLGKQATFDLLDAFYKLGGNFIDTANVYTDGQSEEFLGEWMEIRGIRDEIVLATKAASPYKNRELGTHIGTNFVGNSTKSIFVSTRDSLKRLRTDYIDIMYIHWWDWSTSIEEMMQALNQLVVSGKVLYLGASDMPAWVVSAANTYARAHNLAQFVVYQGKWNAMERDFERDIIPMARQFGMALAPWGALGQGRFKTAEQVAEREKTQGPLREGGGALTDKEKNISAVLHKIGQEELDGLSITGVALAYLFSKYPYVFPIVGGTKISHLEDNVKAIGVVLTDEQIKKIENTVPFDIGFPLNLIQQDPHLTGETQFSLHAHGGHLDWVKHPKGPSFK

SEQ ID NO: 25561 - protein, 1737 aa, Ustilago maydis 521
MDAVALTTLLSDSTQKLVQLHSQIGHPAEALQAALDALHQALKTAVDDQIGRVEREAHNLCAECSQIEADNADIKRALGDKSLVSSPSLQNAIGKRMVSAASTPSSTSEPSSPDSKPLLQRRAQLQIDQTRLKATYSAKEAQLDRLSAKLQTYVPLLGSFVKVPRDGSQDSVNTEAVPSVTFRDVSQPRIALFEAEIIRCSKEVNARAERLQTSLLEIVQLWSELNFEPAQPVAPCDEHVFQPDQAGDQADCGGGTLEFDRAILSHLQLEPMHDQETRTFIGEFISTEQPQRRDAASSRSDSRAIDDLLEQTPTRASLGGQPVRDSGDLALQLSSASKTASEPLPPSHLLEPTEANLARAATKLQWLEAEKQRREMLIQELYDELSELWAKFDVPEEEMDAFVMDHRGSTMDVIQAYQAELDKMKQLKAQHMSLFITKTRERIATLWDSLFLTDHERQASFPPFFIDVSADADPNLDEPLPTDDILASHEQMIDLLTEQVRVKAPVLKVIGRYKELLDEARQLDESASDGSRLLGRSNRGDPGRLLREEKMRKRVKVQKPKIEAELLKVIPAWEEEHGEPFTINGVRYLDELLEQVEGSKENANRKRTRTTSGAQTPAPPVSAPASARRGPLAPSTTSNRGVTATPMRSMTPHQGTIKKPRIAAAPATVAAPSTRTPSVRQAAAPASISRIASARAPMSAAPKAQYGGGAGSISRPASSMAGAYRTVSTASYAAGTSSPSRIPGPSPHLVSRPFGAPPSVPGYASVYGARSVTTTASAGLAARTVKAQRESFRPRPSIVAKVPRNATVVGGVASTKDAAAGISPGRASKWGEMGPPRWPVAGQPSHAHRDVSCVSASSSNHTDITTLIHPGIPQMTRTAEPVRRARRAPSMSLEACLANLAAASSQGKSRLGDAARDLGISSIRSVSSSDDIVNQAGEVADHGHDKTARVRGWKDGLRIAGAGLDDEVDLDADAAPTLARSGSSNWELVGEAEPEPTYFADQHAALAAPQKCSTSSAAMCPCATTKCTNPISDRIRLLSLPIVVWRSSAHLVFTSILLIFTRRADSASCTMTGVVCLRAEARSIAIRASASVTAAATRTSPPAQQGEYASRSAALSARRSYSYHAISGKGRVLSVSAFEPSQLSCFRQSQRPRSDVRLLSSLVTPTRLGMDSEADLGRHFYLNKVLEQWAAKPATRMTLRQLIFFGRTLGRDREKILKSANYVRTELPVRIAHRIRDLQALPFVVMTNQHLEDVYQKYWSAFETFRRFPHIKTMDDNERFCNLLRRLLDDHLTIIPSLTIGIVESSHHLGAKQLDKFMERMLRSRISRRVLAEQHIALSEALDDPFHFFNEPVRRTEGEEDSESHASTDEVGDHVGIIYTRLSVASVVNKGIKLLTQMFTNVQGVGKHRIPEVKVDGDLKARFAYIPEHLEYIVFELLKNAIRATIRKHAPEQQTGVVRVTIVEGPPEEDLIIRISDSGGGLPDLMTQLSSPSRSGAAAAMKPTAATPMFASGAAGGVANNVAAEPSLQMDAQYPIPFPDTGHIGGYPPRGSRARLLHRDDETIPVTLSDDTMAGTMQVDVSSFYAEPWAQDSLPSSRTWSARGGVGSAGGTGGSTPPNEFGTVGTSTTSTQGYSDPLIDALCSFSNVRKRLEIEARLRGASQDSTASANYGLSSTAPHASCSSATTSAAADLNSAGLGTRDRFDALKSIGKFKGTVTEQASDCPWPKCTATSLAGA

SEQ ID NO: 25562 - protein, 370 aa, Ustilago maydis 521
MAPAATSSRSHADPREQQLQVSGQNRVAIFDKQGGPVSVKEAPIQKELKRGEALVRVIYSGVCHTDLHAMLGDWPLDNKLPLVGGHEGAGVVVALGEGADQYVKVGDRVGIKWIATSCLNCSFCRTGAEPNCPHAQCSGFSVDGSFQKYAVSYANHLSIIPDDLPLDQAAPILCAGVTVYKALKEAQLNPGQWVAIPGAGGGLGHLAIQYAVAAGYRVIAIDTGADKKQLCESLGAERFIDFKTSKNLVDDIKAATPDGFGPQAAVVAASGAAAYEQALDYIRPRGVLVAVGLPGQADIKANVFFTVFRSVRIVGSYVGNRQDAQEALDIAAAGKVRTHFRTLGLSQLPQVYDDMQSGKIAGRIVLDIDQ

SEQ ID NO: 25563 - protein, 357 aa, Ustilago maydis 521
MASKQVARASTSSSSFLIRHAVYVPLGIATVYVTFFVALLTPLFQRHFIFLHAIQFPFFPSYDKPANYGLAPFKTRALKLSTNDGETIGAWHVLPEVYYQRLASLDVSEWRQEVYQQAMVEYPTILYLHGNSMNRAAPFRIGAYQTLTGRIDANVVAIDYRGFGDSTGTPSEQGLVEDAESAYRWIRHEQRGAAQSVVVFGQSLGTGIGALLATKLERQRQSVDGLVLMAAYTDIKSLVKDFSLAGLVPLLRPIAWIPFNNLILDRFLKTHLSTITTLPHLLNASSTHHTSIVLLHARDDPVIPITHSHRLFRTMLRASATPANENITLHSRTIPDYAYIQHFHLSAQQTAHLTLSD

SEQ ID NO: 25564 - protein, 357 aa, Ustilago maydis 521
MPRGYGIADSKNWTDFKVYDFDLKKETDDDVDIAITHCGVCGSDVHTISGGWGPLKHDFCIPGHEIIGIATKVGKNVKDIKVGDRVGVGAQVDSCGECVPCQDEEEQYCRGNGTKKLVDTYNDTYSECGTKAMGGYSTHIRTQQQFVFPIPDKIKSEHAAPMLCGGLTLFSPLIRNGAGPGKRVGIVGIGGLGHFGVMFAHALGAEVVAISHSPRKREDALKMGAKEFVSTGENPNWAEEYKNKPFDLIINTASSNAVDLRTILTTLKVHGRLICVGMPEDVFKVRIQDFAGNGCLMGSSHIGSKKEALQMLELAAEKDIQPWVEILPMKDCSKAVKRVADNDIRYRFVLEQDLEKH

SEQ ID NO: 25565 - protein, 484 aa, Ustilago maydis 521
MPDNTDPNTKDGQPAPSILTSKFAKLNPFSKTGASDPEGGGDNLGEEVDFDSIAGGGHAARRTKITKSELRISHALRHFLVQENLISPADALLDQPRASSSDALKAFVDQSHINVPEYVRDRSRPLSEYFVSSSHNTYLLAHQLYGSSSAVAYEHVLIAGARCVEIDAWDNEDDPQEPKVTHGYTLASHVPFRAVCETMKQAIQKEQDEAQRDHSFKVAPILLSLENHCGHAGQKRLVEIMHEVWGDLLISGPVDKNEPASEHTALDHLGAKIAVMVEFYPSEQPPVAEEQDSDDQEEKKNKAKRNEAKKAGIIPELCSLGVYAQSVKPVNDSWYAATLTNGPHDHLINISETGLLDLLPKHSTAIKKHNAQHLMRVYPKGTRISSKNLNPVPFWGVGAQVCALNWQTFDHSMQLNEALFSGSDGYVLKPPGLRIGGDGQTSLGRHKLILYIAGATDLPLPAGRDADEIRPCALERTARVGIRT

SEQ ID NO: 25566 - protein, 340 aa, Ustilago maydis 521
MPLFKSSDIPDLTGRVAIVTGGNSGLGEVSCLELARNGAKVYMASRTESKAQEAIQKIKQAIPKADIHFLQLNLTELAAVRKAAEDFLSREQRLDILLNNAGVMATPYTFTKDGIELQVGTNVVGHYLFTMLLLPTLYKTSKLPEYSAPDSPSVRIVQVSSLGHVASPSDTSFKDLEAVNKQHWPEVKGTWDRYGKSKLGNILIANELSKLLPKDARITSLSIHPGVVRTGLLRGPNESYGKIIGSVNSLLSRFFTAAEDGALTQLYACTSPEVDRLNLNGAYLVPVAKLGQKSKLAQDTDGRLGQELFSFCNSFIKEKLDLDLPAHLKEIGVQLPQSHL

SEQ ID NO: 25567 - protein, 240 aa, Ustilago maydis 521
MTESRMKWVPLESNPELFSSWCSSMGLDTSKYAFHDIYGTDAELLAMVPQPVAAVLLLFPITPSMEQLRQAENATAQPSPSDSDILWFKQTIGNACGTIGLLHALANSSASTAIKPGSPLDTLFEKARATQDAHERADILVNSKELQTVHEATASQGQSQAPEDLDNVILHFVCFVRSKNGELVELDGSGGRKGPINRGKKVASQQDLLPVAVDYVKDNYMALNPEEVNFNLIALAPSFD

SEQ ID NO: 25568 - protein, 381 aa, Ustilago maydis 521
MASTLPRSLVGIARSSVRALHSSVATAASTSTLSPVAAAHMRPVNGFVGAIGNTPLIRLNKISDETGCEVLGKAEFMEPGGSVKDRAALYVVKDAEERGLIKPGGTVVEGTAGNTGIGLAHVCRSKGYRCVIYMPNTQSQEKIDLLRMLGAEVHPVPAVAFDNPDNYNHQAKRHAERLENAVWTNQFDNTANRRAHIETTGPEIWDQIDGNLDGFICATGTGGTLAGITSYLKQKSNGKVQCWLADPPGSVLHSYIQTKGKLMDREGGSITEGIGQGRVTENLKPDVEKLDNSVHVPDEESISMVYDLLHEEGIYVGASSALNVVAAKKMAQQLGPNKTIVTILCDGAYRYQARLFSRKWLESKKLDTAIPEHLQKYIVLP

SEQ ID NO: 25569 - protein, 292 aa, Ustilago maydis 521
MSAIFDSSSPYGYGAQASGSKASQATSSGQAGNPLDFYSNPSSNHPFSSYYSSGTGHDGFATGSNARPSLEGNMSSSAGYAPGSAAHAMMSSQMGFWSAFGTGGFPDEPPLMEELGINIGHIVDKTLTVLNPLHSYSASHAKDAHMMDDADLAGPLLFCFLFGMTLLLAGKSQFGYVYGVALFGAISIYTLLNLMSEGGIDAYRVASVLGYCLLPLCILSTASIVVRLDSFIGYIVSPLFILWCSTSASGIFVSILRLSEQRLLVAYPHCQRLDSEAAALAIDPIETGLSIH

SEQ ID NO: 25570 - protein, 2799 aa, Ustilago maydis 521
MSIDMTGGAAPTDDDFTKLPIHDRLASKLWKARVSAYEELSKAFPNTSSEDDPIFRQYTRNPDILKSIVVDTNAVAQEKGVDAVRAFVEFGAKPAGSTRELVVPALVEKCLGSTRAGTKNNALQLISFYAEMEDVLGCEPLLADLLDGLKAKQPKVVAGCVTAIMHLVRDFGHKQVSPKPILQRLPDMFAHSDKNVRAEASLLALQLHRYIGAALEPTIDTLKDIQAKELRQQFAEIDAAAASKPLPTRFLLSQREKLQAAAAPISQPGTDAAASISAAQQDHRDDDDDDVDPYDLAEPVNVFGSRDYPADFEEMIVSKKWQERKETLETILKILSSSPKIQPDNRFDGLVDHLALKISKDANINVVLVSCQCLNAMAKGLRDNFARYKDKVVPPIIEKLKEKKPATVEVLAKALDAIFQTVSFSEILEHIFTGIKHKNPAVKTESIRFLVRCLRTTKLAPAKADIKPIGDALVVAMADGSPDVRDAGAAGLGTLMKLIGERPMNIFLDGLDDIKKAKIQDECNTAEVKVKMGAGAGARPPLSSAARPTAPIPASAPSAVTNRAAPPAAVRAKPPSATQAMATGKENQAPRPVARPTPSMAARPIGTRPAAATSSAVSSAPAPARKATPAAAAGSSKVAASATEPVKYRFHPDDAEARAADLIPAAIATQLASSAWKERLAGMTQFNDWLKVEAESVESEIIVRALGKKPGWKESNFQVMAEVYKALQLLANDCPTFSRPSVALSVQPLCDKLGDIKLKTPAGETLVTFAEKTSFGFLLAQALGPLGSLKAPKAIADSVLWVDQTLLEFGTAGVDVRSLIDYLITCLKSANAAVRINATKAIGTLARFLGTALNSFLADLNPQLRTTIEAEIEKAASNPPPAPVRFSDETKAPAGKAAVAGGEDAAGPAAQDNAADEDMLDQLVPRVDLDRLVSAAAIARMGDANWKERKEGLEEVLAVVNANSRLKGNMAELANALKMRCSDSNIMCKSMALDAIAKIATAMNKHFEPQARILAGPVTQVLADAKAPVRASATTALTAIAEQVGAGPLLPGMSTVVEGKTANPMLKQELFGWLAAWFELHPPEKGMDLAPLALPCVQCLDDKLAAVRKASLACLPHIITRAGYKHVMEQANQLKTASKNTAIPLIDAAKIQAQNSARAAGATATAAPAATATVPAPTARVAAVSARTATASPARAAGVGSTSSVAPATSSPRTSAIARPGGIKPPSAVGRSLKAPSSIIARQARLASDSSNGAVPSRNALASANGAASQGAGPGGAMEGSAPLISADTKAKALREKREGKAANWIGADGAPRPELVEVLRQQCDGQLSRGITDSMFSKSHSSEKDYYAALTLLSDFISSPTFAEEQYGLSRQETIERTLANSDLIFKYVSIRLTDNNTSLSLKCLDILEHLVALLSEQQYHMSDYEAACILPCLTAKFGDAKVAFRDRIREIFRKMTFIFPPSKLLTSYLENGLPSKNARVRTECLSEVGYLFSKNGLQVCSPSRTLPVIAKQISDRDANVRTAALSAIGEVYKIIGDEVYKLVGALPGKEMSMLEERLKRTTAPPASVAVAVAKSAGAASTAGRAGPRASVVPSSAPGPSSPGRLSAGAPSSRLARPGSALQQPAAPSAGVRSRLAAPGAARRESAIGLPRAAKPPSVASPRASMLRAPSEAAARATSIIAPGRNKVLADELPEEEDEELSVDQAINLVVNDNFEQSVFAIKHVEAFIQEEEPQLISYVDQIAIVLSKQMQKAFSLDPSDLGNERLRKHLLVANISLFDKDRVWEDGRTLGSYLSRSALIPLLTVLVQQLIQSSFRAEDPSAQNESKYLNIILLRCFSACSLNLLYGACLQMLSEATEDLRELEGDVLETRYEFAKLLIKCLWKIAKRLEDDLSQRKVEPQQLFVDIESFLQTIEPFEWRQRAEDGVPLADVPLRTVKIILSSVVNHFGEEALGMLDMIPQPENSYVYKYLVRMLNFAFGDGGVDEEGDAVGSNAGTRTRTDAKAPSQAVNEADTVVEAQRNIAPEDRGVDKAAVVDEEGDAVGSNAGAGANAPSQAVNAADTVDGAQQNSQNGHAADAAVDEESSIRLAELHAELHEIFKRISDKKLSRQGLQEMYEFRKRYPYLESYIQSLLQTTGPMFQRYIKRVFANYAAEDPDVINAAQPPPVDAYIIALIDTHRTSRQLHSQPVVVHTFAAILLLPSRLLSAEMNVQQSHRIEPGRAVHMMCTCSRAEHRSEDMRPNVQGEHQQYDEHEYDGHGAESKPVQLDQLLQILEHDFTVQLALTLLAQTEAERNFCDIGTVQSDFETLGIDMMIGCVEAVFCDSKESTHGVRGGCERTREHARTGRNDSSMQGPVLVHADTDAVACTEDERLLPVEREQKRGYRLRRMLQVSVHTDHSLAASFAKSSNHSGRKPAFRRAHNDAGRRLRFSRNAGTITEQLGVEDVDHPEDPGCFRILADASMSRAIDIEILDVSAADPSQRPRRRESRTVNRESRIACFVTRGSWFVRAVRTLSECYIASQRMYLFPVSRVVCLFNDSRLYISSPCTLDSPLDCESRIHKTSNSTDQDASYRRDCQLPTQPSARTLYRASLDSVMLRVKDPKISLDFYENVLGMDLIDKHDGGDFTLYFLAYQHQKGITQRGEREAILELTHNHGTENDADFSYHNGNQEPKGFGHLCVAVDDIHKACDRFEKLGVKFQKKLTDGKMKNIAFILDPHTPEAGWLKLTLSLVCLVGATNACSHARACASSVVGNLRNDISSPNRPPQSKSPRPTEDHQCVPALRDPASVLQNVSVA

SEQ ID NO: 25571 - protein, 481 aa, Ustilago maydis 521
MNPTLSMTPQHSYYFAQVSVGTPAQNFNVVLDTGSADFWLVDSDCGTAQNCDSDLNKYDTSASSTNIGSNTPFTITYGTGAVRGVLAADKVSLAGYTVNNLTFAEASAVASNTVEYPTSGIMGMGFQSLSTSGATPFWQVLEKQNVLQTNAFTFQLARNIDNLNPNDPNINDIQSPGGVFTLGQIDTNQYSGDITYTNIPNNLQNQQGLGYWTIPLQGITVNGNSASIGSNPLAAIDTGTTLIGGPSLAIRAFYSQISGSRSVSSADMPGYYLFPCSANLNIQLTFGGKSWSMNPQDFNLGSYPYTNSQTCLGALFEIDLGSRQYGVPQWIVGDSFLKNVFSVFDGAGRIGFASLKGTEAQIVSVTSGAVSSQTPQPTSRSSSSSMGAAGGGLPIPNGASSFASQATASGVFGGGSLPVPSASSAVVTSTPSLSAGSSNSNSGSSGSSSGSSSAASSLSAMVGVSAASAAALLAGAVLIAL

SEQ ID NO: 25572 - protein, 299 aa, Ustilago maydis 521
MATTTTRGARDSPFPAPSEGEIKKELNMKGDTISGGSTELSYLKSLVSQLNDKIAQLESKASSTISSITGSTPSGVRMILIGPPGAGKGTQAPKILEKFNNCVCHLATGDMLREQVSKQTELGKMAKKIMDQGGLVSDEIMVSMIKDQLETNPSCKGGFILDGFPRTTPQAEKLDGMLKQKNQKLDHAVELKINDNLLISRITGRLVHPASGRSYHKEFSPPKKPMTDDVTGEPLIQRSDDNAETLKKRLATYHAQTAAVTDYYRKQGIWAPVDASQSPKVVWQSIQAIFDNKQPQPSN

SEQ ID NO: 25573 - protein, 457 aa, Ustilago maydis 521
MPPAALQATVSESVKDAIISKLRQPPSAVPSREWSAETRTSLTPADAGIAEARASAEDIELVDLQHHNFSEPRKRIVSPASLSRFEHSQAFAEILAFICVCNTRVVGKTLTEEIQISSACRTILEMLDQVAALRESTPPDASIGSSRFGNPAFRTFYAKIRENTDRLHRMIPGLETDSEWSRAARAELSVYFQECWGNEKRIDYGSGMELNMACWLLCLCKLRILRLPEDGACIVLRIFWTYVQVMRDIQSSYWLEPAGSHGVWGLDDYHFLPFLWGAGQLSSHRHLRPKAIHDAEIVDEFAPKYMYLACIQFINSVKTASLRWHSPMLDDISGAKSWSKVNQGMIKMYRAEVLKKLPIAQHIFFGSLLRFPEPATGELEEEDVEEDAHGHIHPAGKPHAHGTGEGQAAGWGDCCGIPIPSAFAAAEQEKKRQQGNFSSTMLGEKPFGTGVRRIPFD

SEQ ID NO: 25574 - protein, 1244 aa, Ustilago maydis 521
MEVDPMENAADSASPSNPQLTTLQPAAHRDRFLHLQTSARYAGAVDPSARFKTILALVDAYRNAAEFTSLLQHDWDIFLALETRLAAETSPLSPDTLQTLFELHKNAVSHLPTNCLIKRYISILLTYFSQLYHVDNALVVLQSSKDTSTTSDPALKWTSLDSCPTINLPHSTYIPSSLPPLARDVAETAVWEAVCGVEAIRWRIREAYTRCAYQLQESQDVWKLYLGFEEMLLASTHVARDQQLETVRQVYLARLRVPHTAIDDTFQAYSSFVTQHLPPQQYESEMSAANVLVAESKAILRQREQHEDALAMLFRPGQLHGTGSRQDLDGFAACCKAYVRWQSARAVRALRSKDKSAAQTELNLTCALFDRLVAHFGLHPPTTHKHELVYYSDDVSSSEGYPREFKRLGQAEREARIQQEQQLFSERHSLATELWLDYIAVLTCSPRPDASLIMDVCTRAVQCLPTAVSLHCVLMRSSARFQRSRAQIEQLFEKVATPGALELKGPELTDLCLARIDCERELATFDLVVKAGAEIDVDPAQDMDKFTEIYALLSYSLGKLAELHDDQRDPSLRLEKAIVNWVERAVFAMGGPASEGGAGLNELAESVWQTAVVQQPDNALVYREAAGYWLRRFEARKARGWFKAGISKLERKQSQDARPEYQALLQDWVQFEHLHGSIEEVEYAEGKSRAERQRALEAWYAQYAQYGYSTEPQTQAQSYSHMNRDLNSTMQVESPSNHLDRNQTGKRKADDDEKEADTSIADAPMSIRADALCAPIDTSSEQPKKTRAHDAESAPSRDREHCSVLVSNLDPTADASAVRHLLRGCGRIVELSGPNILTSPTGSTSAAALVEFADPNGASSALTRHNKTISSTPVSIHIGWKCTLFVTNFPEDWNDSSIRSTFAAHGLVFTVRWPSKRFASTRRFCYVQYTTPDSAAAAVAALDKTEVAPGRMLNVALSDPSRRKQRTDAQENAKELFVSGFARNITEEELRVYFESYGTVKGVRLLRNAEGALRGIGFVDFESQLEAQRAMRELNSTKWRGKTISVTIADTRSHGASCSAQREDVQERRAKSVRVTGLPVDAQEALIQQAVEREVGLGSVKQVLWRPDGVNQKATVEFSEFKDAGKAVLIGGAGGIRYGDVVLNVSAAEEEGAAGDGPKPQVAVGEVQPAAALSFMPRSSRGGRGRGRGRAFALAYASHAATSHVAAEGVSNAGEDMDVEPAGNDETSGKPSGQDRFRAMLQRQ

SEQ ID NO: 25575 - protein, 372 aa, Ustilago maydis 521
MSTSTTTSQGPKVLLTGVSGFVGSHVLDQLLKSSRSYHVTCVIRSKAKTEPWLSRQFAAGFQQNRIDVIEVSDLLASGCLDSAVEAKDYIVHVASPYVLSAKNNKRDIIDPAIKMTQNVLDAALKAENKAKAAGEKPKLKRIVVTSSFAAILNPLKGIEQRDYTYTDKDWQPIQYAFMGMFYSPLAYLISKTLAEKSVWNFLEQHKPSFDAATVNPPNIYGPIIHEVKSEDAINTSSAEPWKLYKAGGPNGDGKVPAEALWSFCDVRDVAKVHVAALDNPKAHNTRYLACGGSISWQEVADEIHSNPEYPQELKDHIPRGTPGQRHRPSPLAKLDTSRAEKDLGIEFLDWKESVIKGSLYSFIEIEKSWGHQ

SEQ ID NO: 25576 - protein, 452 aa, Ustilago maydis 521
MKFTGATLVSSGLLAASAAMAAPAPASTGADTPVHIPIQKRSVVKRSGDDLLHWAYDQKALLQSKYNLPTNSSQNQRRAGATWLTNVQYDSSWVASLSGGTPAKDYEVVLDTGSSDLWISSQYYQPSSSSTFRNQSTPFDIQYGSGSVHGYQATDTFTLAGTTVNNLHVAVATSVSSGLTSAAMEGIMGMGFQRLASSGEPPLWVAAGIDTFSFYLERASLSTRDQTQPGGIFTLGGTNTSLYQGDISYNSLLEELYWMVRLGAIGTMGANVPLNGLTRAAIDTGTTLIGGPDSVVQQLYANIANSRSQGNGYYSFPCSSSVDATLTFGNQQYTIPSTDFVAGTLDQSGSQCLGAFFGLGSSSQTDLQWIVGDAFLKNVYSIFTTNRNNGNSGVGFASLARGLNSGTISKSVNSTSNSVSSDSPAATTAKRWNNVSALMATVALPVLALVFG

SEQ ID NO: 25577 - protein, 1673 aa, Ustilago maydis 521
MAAATAAILPPATDFVNMDHRSADSHRMSPASFADASLANGRPLRSAKSVPSPSTPTSPFRLRGTPHSPSIPHRRVYNIDDESITSTSHSFASETRSSDASITPSQSASNVSAPASPRSYAHLALPLPPSSPGSPSRPLAHKKSAERRRKATRNQHLTNLEVASLSTPELHLASDPMLDTQEPSFLRKLVRGSRAHSNDAVSSAGSEGQTQASSHTDNASSRLGVSPGLAYSSFAAAMSAVDACEDSSQPDANPQVHCFRKKSTSTLRSADSEVSRASWSILNTSTDTLSPPKDINVRSSPTKSEPKSSAGTWFRRHRQQSDPSRKLNQNFDASGANSSTQVSVQRSQMSDATVGSGTTLLSQSNYTGLSSATTASFDLSELASPQAALESIRKARSFMIRELGRIAEPGDASDKPRISALVSQASLEVHDLHSEASSFWHSIADGVLLCLLANRLRPGSVDRIDRRDLEWVKSNNISRFLRAARDHLGLRSKDLFQTFDLTDSTVGGLLRVVHTLQATEKMARRSSKVTAARANAIKIEPRTTSMTPPTTPRAQDRKMLPVGNGDLECIENSSELFLNDDTPKRAVLSIQQNRREAERILIGKSDSSRYTSTSFDAKRRSIELGHPKPKGSSITFADSVKQNSYSADDDNRLPYRDRKLSESVISLTGVAEEPEDGVVTNDDSLPTAESFSTSSTPSVSMELSQVRRGSSESDKSTKSFAVKPPLLARSTSQKRISQELALGQLPRAVIGSTENLDDYLFISGSPTRHAPTRRHSARLYAGPSLLNPSRESLLNLGSQANGESDALASSRVPFPRGANDSPGARRMARHLSMNAGVSDTISTASGPSTAIATNGSSSSSKVSSRPHFRHMRYSSDLHLPSMSRPTSVGGRSPDPSVDERSYISTSRSRFDSEIGSIYTNTLGSLPTDESGSTTTRASRDATGPKHKIVVAEEGKPSVTYQLGNCIGRGQFGSVYRALNLNSGRMVAVKRIKLEGRTDEEINDLMGEVDLLKSLTHPSVVKYEGLVRGPDVVSIILEFVENGSLLHTLKAFGNFPEKLVASYVVKILEGLNYLHGQNVVHCDLKAANILTTKQGNVKLSDFGVSLNLKAVKKMGNKNDAIGTPNWMAPEVIELKGVTTAADIWSLGCTIIELLTGKPPYYDMLAMSAMFRIVEDDCPPIPEKCSDALRDLLMQCFNKDPAKRPSAEMLFEHEWMQQVWSGHKDLRELRPQDSVPFLRRISADARRLDPRIFEEDERAVQPAMERSTSSPAPTLQRPGLEALRANTSPAESLAAVATEMANGVSPTTSPAVHSNPLPSVDTSSKNQAQSPALTPANPTVFLPAGETSMLDLGLMAEEEAKPHAFVKSTFSKAVVCKICREPVKKHAVLCEECGLVCHARCAVHAPSPCNLRAQLLLFQQRASMDQTSPMSSAAQLAPVSPMLAGGAPNAAVPINFRFPFGMKRQSKSPTADSQPQLGLVASASSETEVRGSPSPPTGNGVTAAKPAKDQAAVRKRRISLIPGRQRSPSPPPAETPEAMRSPYGNGALHGTRRHSSMSYGSISGASSISSAGGILLGHSSSRGSSAQQHQAQQAHPHASTPVLPVEQLHARPSKERFRRRLSSGVVTSGARAEALSAKHTTKGGVSTGQVTPTPRSAIERQKSRRSSSKADCTIM

SEQ ID NO: 25578 - protein, 1020 aa, Ustilago maydis 521
MLSRSSLSLATSSRLARWACATSTSTRNTTATTLQIPTACSITRCLATSVSVASGREASSPASNRNQDRSDYRPRRRDEDVRSNHRSGGPNHGVPVAQYSRNQRFAADGTRKRLPHPNAKPRSDREGDRNQSANDQRSSRPRDGPSRFKKAGEAGYSSWRNKDDSALKFGYTAQDGMGSNSASNAATKRDSTVSRLRARNNTPLDDADDRGFRNTEADRFGDATSIEDDASARSPRGVAVDDGILKGNSILERSDRHHTAKQKKKEGRGSLLDPEHDHDHNPSSRSWPTSSSNRQPRHASVSPDNMHASRLDRAPTPRVKPKLLPKVERNIFLPSVISVVMLATRMEKKLRAVQNVMSELGMEDTRPDLMLKFEDAEMIAAQLNVVAIPNDEASFDIYPRPPPSTPEEAASLPRRPPVVTIMGHVDHGKTTLLDKLRSTSVAQGEAGGITQHIGAFSVPISGREQLKGKRKGYQGIQTITFLDTPGHAAFTAMRSRGAMVTDIVVLVVAADDGVMPQTREVIQLVKDANADMDSNDIASSQPHVQMVVALNKIDKPDADPERVKRQLVAAGVELEELGGDVPCVHVSGKTGRGLDDLEETVAILGELAELRAERTGLPQGYVIESKVDKGRGNVATVLIKRGVLSKASPIIAGTAWCKVRQILHSSGRPLANAFPGDPVLVTGWRELPSAGDMLLGATDEQSCKRACENRKQLQEHKKMMQDVEQINEARRAKAEQEEAEAKKEFEDRQRRRAARLAADDGKDPLAVLAAMEAASSGATGETVQVDQDADGVEIAESKDSTTSAGQGKKLLNVIIKADFSGTVEAVVGAISSIGNNEAGVKIVSASVGEPSESDVAKAAALSATIIGFNVTPSKSVLQSAARAQPDPVPVIVSDVIYRLMETVSARVSTLLAPLTEARVHGEATVSQIFDINLKGKTFKKIAGCKVTNGTISKSNAVKVLRGAERKEVYRGKLDQLKHVKKDVAEMRKGTECGMSFEGWQDLKEGDVVQCFSEVEVARSL

SEQ ID NO: 25579 - protein, 495 aa, Ustilago maydis 521
MTTAADSTSPMAGLTRSSQASTSASTLESFLESATALVSPASETTFPSTPASDRLPISRTRPAATLRAGKAAATAAETPLTPTEIARVRAYQQLHRTESALNASPAGNVVEVESSSSSQRDANQHVRSHAHPATNHAFLITYFVAGGAAGATSRTVVSPLERLKIIMQVQPQSSQSSSSGAASTTAKSRSAVKNRAYNGVWTGLVKMWQEEGFAGFMRGNGINCLRIAPYSAVQFTTYEMCKTYLRQEGSDELDVMRKLTAGAIAGIASVVSTYPLDLVRSRISIASANMYNEAKSEAISASTKMAVAERVPEQVLRTQIAARQKAVPGIWAMTTKVYREEGGLRGLYRGCVPTSVGVAPYVALNFYFYEAARKRISPADGSDPSALLKLACGALAGSISQTLTYPLDVLRRRMQVAGMKDSQEKLGYKDKNAINAIQNIIKAEGVTGLYRGLLPNLLKVAPSIGTSFLTYEAVKGFLEVHLDDLHKPEDTSKAA

SEQ ID NO: 25580 - protein, 358 aa, Ustilago maydis 521
MADFVKLSIFGTVFEVTTRYVDLQPVGMGAFGLVCSANDQLTSTSVAIKKIMKPFSTPVLSKRTYRELKLLKHIRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDVWSAGCIFAEMLEGKPLFPGKDHVNQFSIITELLGTPPDEVIKTICSENTLRFVQSLPKRERVPFSQKFKNADPMALDLLEKMLVFDPRTRISAAEALAHPYLAPYHDPTDEPEAEEAFDWSFNDADLPVDTWKVMMYSEILDFHNIDNSGQDEGPVPPVNN

SEQ ID NO: 25581 - protein, 192 aa, Ustilago maydis 521
MAAKVYVGNLSWNTTDDSLAHAFSTYGQLTDYIVMKDRETGRSRGFGFVTFATQAEADAAIAALNEQELDGRRIRVNMANSRPAGGMGGGYGGVTGQYGANAYGAQGGYGGYGGQPGGFQQPGGFQQQGGYPQQGGYGGYQQPGFQPQQGGYGAPQQGYGAPQQGGYGGYGAQQGFQQPAQQNSGSYNGQGY

SEQ ID NO: 25582 - protein, 174 aa, Ustilago maydis 521
MSIVHLQSVEILNAEASFKDPYVFKITFECISPLQDDLEWRLVYVGSAGDEKYDQELDTCMVGPVPVGVNSFEFEAAAPSPSKIPPEDLLGVTVILLTASYRDQEFIRVGYYVNNAYESEELRENPPEKVDLTQVRREVLVSKPRVTRFNIKWDDSATASASTQQQGSAEGLTA

SEQ ID NO: 25583 - protein, 508 aa, Ustilago maydis 521
MISGLLSRSSVGPARAFQASTLPRVVSTLPRVHSRGLATGADPYDVVVIGGGPGGYVAAIKAAQLGLKTACVEKRGALGGTCLNVGCIPSKAMLNNSHLYHQAQHDFKSRGIDVGSISLNLETMLKAKSSAVTGLTKGIEGLFKKNKVDYLKGAGSFSSPTTIKVALNDGGETEIEAKNIIIATGSEVTPFPGIEIDEKQIVSSTGALELQKVPEKMIVIGAGVIGLEMGSVWSRLGAKVEVVEFLSTVGGAGIDGEIAKNFKKTLEKQGLKFRLGTKVIDAEKKDGKVYLNVEDAKSGDKTQLDADVVLVAIGRRPVTSGLNLEAVGIEKDERGRIIVDDQYNTTCKGVKCIGDATFGPMLAHKAEEEGIAAVEIIKSGHGHVNYAAIPAVVYTHPEVAWVGKNEEELKKEGVEYKVGKFPFLANSRAKTNADSDGTVKFLVEKETDKVLGVHIIGPNAGEMIASAVLAIEYQASAEDIARTCHAHPTLSEAFKEAAMASYSKAIHF

SEQ ID NO: 25584 - protein, 221 aa, Ustilago maydis 521
MAAAPRNPRQLQFKLVLLGESAVGKSSLVLRFVKDQFDDYRESTIGAAFLTQTVSLDAQTTVKFEIWDTAGQERYKSLAPMYYRNANCAVVVYDITQPSSLDKAKAWIRELQRQADPNIIIALAGNKADLASTRRAIPTEEAEKYAQEEGLLFLETSAKNSSNVSELFTMIARKLPTEQAAESQRSGAGRAGAGAAGAGGARPGVDLRGQQGGQEQDACNC

SEQ ID NO: 25585 - protein, 214 aa, Ustilago maydis 521
MAPAAIRRKLVIVGDGACGKTSLLCVFAIGEFPQEYEPTIFENYVAEIRLDGKPVQLALWDTAGQEEYERLRPLSYSQAHVILIAFAIDTPDSLENVQVKWMEEVRQICGPSVPVLLVGCKKDLREDAIAKGKPVQGHYVERQQAKLVAAQIGARSYHECSSLNNQGVDAVFEAATRAAMLVRNSGASSGGAISQSKTKEALHNDAGSCKCIVL

SEQ ID NO: 25586 - protein, 497 aa, Ustilago maydis 521
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 25587 - protein, 364 aa, Ustilago maydis 521
MPFDAMACLLLVGWVLLSLGTSNTQAADCTFADAASVKLGKRSCRMITLSSIKVPAGQTLDLTGLRTGTKVIFEGTTTFGYETWPGPLIAVSGKNIDISGSSGSVLDAGGGQWWDGKGSNGGKTKPKFLFAHGLINSSIRYLNVKNTPVQAFSINGCSNLRVDHVTIDNSAGDVNRLGHNTDAFDVGNSDGVFITNANVRNQDDCLAINSGTNILFSGGYCSGGHGLSIGSVGGRSDNTVDGVHIVNSQVVDSQNAVRIKTVSGATGVVNNVTYSNIKLSGIFKNGIDIQQDYLNGRPTGKPTNGVKITNIHMNGITGTVNPGATEVYVLCGQGSCSRWRWSGVSISGGLRSTKCTGVPSGAFC

SEQ ID NO: 25588 - protein, 432 aa, Ustilago maydis 521
MAIPETLQIASPSGKTLTVPTGLFINNKFVPSVDGETLETINPATGKSLGFVSAATASDVDIAVSSARTAFNTTWGRNSSPTQRASILFKLADLLEQHAVELSELESLDNGKPRWIAETMDIADTAGCFRYYAGLADKIEGKTIEQKEGEKLAFTKLEPLGVCGQIIPWNYPIGMLGWKVAPALAAGNCIVLKPAEQTPLSALRIAQLSVEAGLPEGVFNVVNGLGPIVGDAITGHMDVDKVAFTGSTAIGKRVMERAARSNLKKVTLELGGKSPVVVFDDADLDQAVNWAALGILFNQGQDCTAGSRLFVQEGIYDKFLPKLVAAFRAHTIGDPFSNSTFQGPQITQRHQQRILDYIESGKQQGATVEVGGGAWTDGQGEFANGFYVQPTIFSGCKKGMKIVDEEIFGPVLAVAKFKTEQEAQREYVHARR

SEQ ID NO: 25589 - protein, 369 aa, Ustilago maydis 521
MVQDPRETQLEVTPTNRVAIFYENGGPDKISIKQLDNIKPSELNAGEVLVRVLFTGVCHSDLHALQGDWPFPPKLPLIGGHEGAGVVVALGAGSQEYVQIGDRVGIKWIADACLNCEYCRLSHEINCAQYKSSGCECGSALKLVGFERDKYVRHTARYLTKIPDALDLAQAASILCAGVTIYRALKEAHLEAGNWVVIPGSGGGLGHLGVQYALNAGLRVIGIDTGSDKQHMSLSLGCEVFVDFKTSDVATAIKAATGGIGAHAAVVAAASSAAYELALDYIRPRGTLVIVGMPNSILPLSIFKTVLMTHKIVGSAVGNRQDAVEALDIASRGKVKVHFTMKGLTDLPHVFQDMIHGRIAGRIVLDVDK

SEQ ID NO: 25590 - protein, 404 aa, Ustilago maydis 521
MRPQAILPDALSAVGETPLIQLNRIPQSEGIKCNVMVKCEFFNAGGSVKDRIARRMLLQAEQDGTLIPGKSVVIEPTSGNTGIGLALACAIRGYRCIIVLPEKMSAEKVNTLRALGAEVIRTPTEAAHDDPRSNIMVARRLAKSMPNAVILDQYNNPNNPTAHWATAEEIIQAIKAGPAPPSSTSLLHGMDSLSLTNDKEPLDSANARPLTPDSNRGADELNGSTQTFSNKVDVFVAGVGTGGTISGIASRLKRADHNPDCFVLGVDPIGSDLALPVSLNALPEGSDGSYKVEGIGYDFDPNTLNKKVIDEWYKTEDEQSFVYARRLIKDEGILAGGSSGAAVNAAINWLKPGGAGWDKFGSKAGLNAVVVLPDSIRNYITKPWLVSEAKAERRQDEIDFDHFQ

SEQ ID NO: 25591 - protein, 247 aa, Ustilago maydis 521
MIQWIKQTYPQIDVVAGNVVTREQAASLIAAGADALRVGMGSGSICITQEVMAVGRPQGTAVHAFGVPVIADGGISNVGHIAKALALGASAVMMGGLLAGTTESPGDYFYRDGKRLKGYRGMGSIEAMEHQKKGKIAGATGKGAAKADKVATDENAATQRYFSESDAVKVAQGVAGAVQDKGSVKKFLPYLYTGLQHSLQDMGVPHLYQLRSAVASGQVRFELRTASAQVEGGVHGLHSYEKRLFSS

SEQ ID NO: 25592 - protein, 492 aa, Ustilago maydis 521
MSSQAVADIGLIGLAVMGQNLILNMNDKGFTVCAYNRTTSKVDDFLANEAKGTNVVGAKSIEEFVAKLKRPRKMILLVKAGPAVDAFIEQLLPHLEQGDIVIDGGNSHYPDSIRRCKELEAKGILFVGSGVSGGEEGARHGPSLMPGGSDAAWPHIKEIFQKTAAQSDGEPCCDWVGQTGAGHYVKMVHNGIEYGDMQLICEAYDILKHGLGLKEGEIGDIFTKWNTGVLDSFLIEITRDILKYNDEDGAPLLTKIMDSAGQKGTGKWTAINALDLGQPVTLIGEAVFARCLSSLKGERTRASKILGGPQIKPFEGNKEQFIADLEQALYASKIVSYAQGFMLMREAAKEYDWKLNNPSIALMWRGGCIIRSVFLKDITAAFRKNPELENLLFDDFFNKAIHNAQEGWRRVVAQAILWGIPTPAFSTALAFFDGYRRELLPANLLQAQRDYFGAHTFRVLPQFASEKLPEGQDIHINWTGRGGNVSASTYQA

SEQ ID NO: 25593 - protein, 1762 aa, Ustilago maydis 521
MLAPTLLDCWHVGDLQRFRSLLKGSPPDKSASTQPSAIPSYGGHSAAFSKSPHSYKDPSTPCPPAEVNRRDHLGRTVLHHIASSSDPSCLSYLNAILAHPSVNVNLQDAESGYTPLHRALYLANLHTAILLLRRSDLDLRIKDFEGLTAFDLYNSTVAGTNPPPDALSFEPNRHHHSRTLTQLFTWGSNRNYNLGLGDGDDRQLPDKISLRAPSTSNINTSHSIHHSFHTSLPAGKKFDRIGIKDVAMGRLHTVILTDEKVANVWLCGLGSNGRLGRSPQTQTSFEPLKDFTDTARSLAVAQDHTLIITASGAVYSFGLNRFAQLGYTIEHGLGTVASTTPKFGAGAGVTFGQTSASSAQNLELDIQISPRRIAGPLKKEVVLGAACSKLHSVVFTADALYTWGTNTGQLGYDKSATAVQVQPRKVTALAAGAGIQQVAASDFGTACLMHGGEVFVWHNDTHFRINFPLARFSSSISVFRPRQVQPKTLISKLSSSGNTFAALSDMGDLFTFNLEHPSEYGNTATPPRAAPSTSSTPKSSAVQLAPKPQLLWSVRRKFTAVRDVAIGADGSVILCTESGHCFHRPRRSDAAGAKPGGGKNFKFHQIPYLQRVVKVATSESGALAAIKADPSLPDLRVKGRSVEEALCDLLPHLKVQTLSQAIDQEKGITSKVVEISESPSRLDSDTDSEDERPDPALSTDTAKAAKRWVAGRMVSGPSSAQTLHDLTQTQTAPTTTRRQAFYGPHNLTPPFGCDAFLIADGHYLPVHKVILGARIPSLRTVLQDSSAKDSLPPGIKLSAVPAAAGTNKSVSILTLSNCSLISVLFLLHYIYSDDLPPIWVPSVGLVIDKELKAAKVDRIRIHDELQLLSQRLGLSALTTSVQASMPRSPEPTLRANMSTLFESFVSMHVDKTQETKTFNDVLLRLEDRTVPAHSVILRRSPFFSALFQPHWTAARWDSSNIITLDMSHLRWEVARIVLMHLYTDNGETLFTGCDADRSLEQYMDFLVEVMAAANELMLDKLKLIVSSLLRKRILAHTVGAVMTEADFYNADQLKDITMDYCTKSMEALLEGGRLNELDHGMIQALTVYVRHKQDEKLHRSLAQDRLAALVEKHRDFYDNLDIPPPSLHLIVNKVRPKKGTGLAAAKSPPLLAQDAGRRHSSARFGVASATSPGALRPVTAGIMQRSMADDTSEVFSMDDDDFTTPRKYPSARPHGSPWAVLPQVAHLSLDDSMDKSAPSRPWKSRTVEAERKQAGVNPSMSPALRPADAPTDLRSIIAREQKRQQQQSVVPHISNATTPSGSGTCTPVHKSATPGFELSPISIANARLSQKERKRQQQEAGLAAAAAAQAQPIVARRGSVSSPWKLAAAGSSPPDKTTASSPWSRKAAATTAMALESSHEGTPPLTTTFSSRRPAALPLQSGSGTATHATFSETGASPANGLGPTYTPMRMGSKCTPKRMGSNEPAWSTPAVAPPLGMYGTSPSPAPPLGASRAARPEAQRGASSNLSSSLRNADAQSIARSSSEVAHIDQAGSLACTAQLTFAQIQEQQRMAVEAEQETIRLAAAARKSFIDIQEEERQAEERRKEDQKQAAEFERWFAQESKRMQKEKKANNAGAKGKAHKKQVKQAEQSRSQSQSQSGSKASQDTGLASGANGNSSKSKKSQQAGKKSGNEGRQLNGATSSKGAQSKGGAKQTSGAANHGENDKLSHRSNTKSHMGSADATTSNAPPHASSVQLPSKHPPPARSALLSAAAPTFMPRQE

SEQ ID NO: 25594 - protein, 333 aa, Ustilago maydis 521
MSACLILAGLLALTCCRLDSSQDQRALAIIGAAIFVERILAGQTVQHRSSRLGLWQLAHTRAFSKHHRRLPFVSRSLPYTSTMPFSTPAQPSCSAASPLRLRYIDASTAQKIDEDLMSASGGFSLDQLMELAGLSCAQAVFECYPPTKYPNVLVACGPGNQGGDGLVAARHLYHFGYEPVVWYPKQGKTELFSRLKVQLHNLGLPFVSQDDFQDALEEADVVLDSIFGFNFKGDVREPFRAPLEILKYESRIEFEARKKMPPIVSVDIPSSWHVELAPKLGALAFAGRHFLGGRFLPEDLEAKFDLQLPDYPGTEQVIEITGAKPLQTQEADL

SEQ ID NO: 25595 - protein, 470 aa, Ustilago maydis 521
MPVYPSVEPSNSDFPQQPELDSLVQDELQGGLAPWRTCAINAPANLAGGRGNLASDASPLVFGGGVFGQDMYNTSETLASDLPIRTVRLALRYGFNAFDTSPYYFPSEFTLGNILRRLQPEFPRESYFIITKCGRYGPEKEHFNYTATKIDESVRASCRRLGTEYVDVALTHDAEFVCEKVGRSHDQGWESGVVSGLVAPKEVGLDSKEQVLASLGLAATLKDASKVHGQGDEQFLEAIRTLFKLKDEGVVRSVGISGYPLPVLLRLSRLVATTAPFRPLDVVLSYSNHCLHSDVLMGWKDLFAADPRGKDGEDSLKELHWKAPLLMNGSPFSMGLLTDGTPPPWHPASNALKAATKEASQTLISQGSSLTLTSLAYGFRGSELPHPSGNGPQLRTLVGLSHPDHVHSAVEAYRVLSAGAAEAGTALYPGKQEDKDANLAKYKKQTQNEKVIRELFAQRGVREWSWASGL

SEQ ID NO: 25596 - protein, 340 aa, Ustilago maydis 521
MSIPTREFGKTGEKVSSIGYGGMGLAAFYGEPAPQSTVDAILDKCLANGVTFWDTADMYSPVKSRRLGYNEEQFGAYFKSHPEARSKVFLATKFVNRVKENGERFLDGSPEWCHQACNDSLRRLGVDQIDLYYAHRSDPNVNVTETVRAMKELKDQGKIRYIGVSEYNLEQLEAANKVAHIDAIQIEISPLTPEALTNGILAWAEKNGTALVAYSPLGRGFMTGQYKSVEDFDEDDYRRFSPRFQGENFQKNLELVSKIKKIADKKSATAGQIALAWVLQKSPIIIPIPGTKKEKYLDENINSVHVKLSDADVAEIDDVINSFEVSGTRYAPESMKVCAF

SEQ ID NO: 25597 - protein, 1053 aa, Ustilago maydis 521
MSYHVIHYRRFTIGFADLTHRRSTHDVRQFALELATVTGKGGFDMHIQLAVPERSIILKTASASASPSTSASPSACASSFSSPSPHLTLSSRLDRAPKMSSSSPSSASASSRRPLVGVSFKMYFDIPKTKAYVDETISLLSSTLPSLGQPIDVFVIPDFITLTSVAAQICSSSSTLLLGAQDVHSHDFGAFTGEVSPNVLSQVGVKLVEIGHAERRRYFGETDQDVANKAAAIAKNGMVPLICIGEVSRPKNLDQLSIQDVDLVVNECWRQIQPALDAIESHVDVVLAYEPVWAIGQPQPASPDYVVKITKALRKRYNKEYVDSHKARSDASLRILYGGSAGPGSLINPRLLSIPSRKSPVQTSRLQNTPLVQVRALVPILMLLPQHLERSLSLLGHVFLLAHHHLCTRRLGITIEAIASLTIQTSTSSIGDLERIVKLVLRERKDDTDHREKSSYELLYCTPTELNASVRGGGGANSLSSKGSVWWARCVSIRGQRSRYRQRIPRYSTPSCSGCIIHPTAVNIRSQSKTCHLLATTPPSDKGIEVRLPVITTNMQPSSRNRSTCVETRSKCVSNQAAVAASYASCFPSRRRGWQNEARGSSALSIMFSQIQAPIATLPFGSELHRYPIGLAPSTKPRSGLCPQLGCNNFISIRFARCRFVIRDILRFILDSRKSRRLTAFHPGNLILTTSSKLGGAQEKEKQEQRAPTMMTSRFLVSGNPATDPKAAAQWLAEQRRRPIRAPHKTVQYGELVITRGGLSSVSKEDLWSILEQVAIAAIEVARFDLAELCISRLSSRFANSQRVTSLQGMLLEGQAKSRDAIRLYESVLETEQTSLILSRRRIGAIKSTGDIKQTLHALNSHLDIFYNDPEAWQELAEVYATQSMYAQSAFALEELLLQVPQNGFFQLKYAETLYTAAELTKSYKAYLRVLEMCQSDAATTQPVAPNTTAAHGAWLRALWGTKMVSTQLHYFRTLQTETDPNPDDLICIDLAKVTTALIATPPRASSTDDAIDQAKVLKIDELVTKLLLTNVYTPQAVACKHLRDVARAVLAA

SEQ ID NO: 25598 - protein, 365 aa, Ustilago maydis 521
MSSTDALFEGWVGHDKSCIGNMKWETYTPKQWRETDIEIKIECCGVCASDLHTARSGWGPTRYPCVVGHEIVGTVARVGKQVSGFNIGDRVGVGAQSDSCKSCEACKNGDEPWCEKGIVGTYNGDYSSTDGSGFSMGGYAKYSRVPAHFAVHIPDSLPSTVAAPLMCGGVTVYNPLKTNGCGNEGVKRVGVVGIGGLGHFALIFAKALGAEKIVAISHTHSKEDLARKLGATNFIASGDEDPWSAHKRSLDLLILTNNNADMPITDYLTLVRPHGKVVAVGVPEEPCMPTPLPALAFSGVFLGGSLIGGPAIIKEMLELAAKQNLKPMIEQRDMKDANQVVKDMDAGKPRFRYVMVNKDYEPVKA

SEQ ID NO: 25599 - protein, 413 aa, Ustilago maydis 521
MDESIQQFAAITGASADRARFFLEASGGDLQTAMSSFYESEPSQSEAGAGVEDTAEASSSPSVEQNYTGPRTLSGQPVDPSSLSGFGSTSLASSQSSRSRASGGIATFRDLQTLNSSPASGKRASSDDGDDDEGDDDEMNYYAGGERSALSVENPEARRRRNQPGGDLVQEILKRAAEEGKRHPEELAAGRAKASGSKPPSSASFAFTGRGRTINDAAEAESSSLSTPSMPGGFGSRLGGAGANEANDEEEDGEVAIRNLTFWKDGFSVEDGELMRYDDPAHAQTLAAINSGHAPLDLLNIRFGQQVHVHVHRRTDEEYKPPPMKPFAGSGNRLGSPAPASFASSSASSSRSQPTAAAASSSASAATASTGDFKVDTDKPTTQLQVRLGDGQRMTARFNTQHTIADLRSYINA

SEQ ID NO: 25600 - protein, 1499 aa, Ustilago maydis 521
MGSISAVGAVARIAVLTSATLVNVAPSGKASTSSFSSVADKASELNAQLDVEHLNQHVELGSVLSQLKPAGNGLISVLSHAHQPTFTRLVPHLPKLVHTPLVFHVASAGEHSDIMALRQSGLVLLHSSTAAQAHDHALLATKIATSAKRAVLHFFEDASGPVEEVTNVDLASFIGSVAASTSTDAAAPKINGLNGHANGINGHVNGVNGANGNANGYASAVASEAGFDDLESAIDAAYEDVAELVGHAVEPFQLVGASDAQNLAVVLGAGSETLQDYTAPHNDLAVLDIRLVRPSLPQRLLDTIPAGIKRIAVLEQSVRRTTKLGPLFVDVASAFQGSERTLPSVFVSAILGHIDNGDNAAKELIKALQAPKPKHAFIVGDLKKLSARAQASPATAATTAPVQVPKHEEAYNLMLEQVFADRLALVNSANEESDDHPAARSPEYAFGQVLAQLEQRDELIRAVNDVLRDGGVSTELHEALSQWLVAKQDVKKNVASSNKVASLLQSSTSGAALQNIKSLSEHLLLKSRWIVGSDAWAYDAGMGGVHHVIASGRNVNMLIFDSVPYTKRDAQAAHKRKKDVALYAMNYGNVYVASTAIYADYTQVLHALMEADKFDGPSVVLAYVPYRTEDAPALDVLRETKLAVDSGYWPLFRWDPSAEARGSDVFRLDGVRLREQLQQFLDRQNLFTTLINSRPELSYDIAASQGNALRELQRRKAKEAYEKMLGSLDGPPLLILVASDGGNAEKVAKKLAVRAKARGVAARLLTMDDFPVTEELKDEKNVVFLTSTAGQGEAPQNGRFTYKALHAMADAALPDTLNFTVFAMGDSHYWPRPEDAHYYNKPGKDIDVRLEQLGATRMTPIGLGDDQDADGYQTGYKIWEPLLWKALGVDTVEVKEAEPEPITNEHMKIASNYLRGTIKEALVDTSTGAIPETDGQLTKFHGTYMQYDRDTLEERKAAGLEPAYSFMIRARIPGGVVTPAQWVQLDDVAEKYGNQTIKITTRQTIQYHCVIKSNLKAAMQGINKSMLDTIAACGDVNRNVMCSPNPNLSELHEDVYEFSKSISEHLLPRMNAYHEIWLDKETDSSKQLLIGGVLQDYEPLYGPYYLPRKFKIAIAVPPRNDTDCFAHDIGLIAIADPVTKRLAGFNLAVGGGMGVTHSMKATYPRLGNVIGFVTPEQTLDACRIVMLIQRDTGNRANRKQARLKYTIDKHWGGADNFKAEVERRLGYKLAEPKSYKFETNTDLYGWTQDYKGNYHCTLWLENGRVKDEPGAPFRTGLRELCKIHKGAFRLTPNQHIIVSDIKPEDKDTIDAHLRKYKMNNWEHSGVKLSASACVAFPTCGLAMAESERYLPLLMDKIESIFEANGLRSTDTVFRMSGCANGCSRPWMAEAGFVGKAPGQYVMTLGGSHNGTRLSKIYRESVDEKEILEIMNKLVPLYAENRIEGESFGDYVIRAGIIKPTTEGKAFYEDMCPSDVVPPSAAAKKGPAQATEHYDRASSA

SEQ ID NO: 25601 - protein, 294 aa, Ustilago maydis 521
MSVATKNLFAILGDDDDVAAPKAAPAKAAAPAATPAPQRNIPGAGNQRRGGARNGAPRAAAGADAVEGEQQKDARAGRPRNGESRGRGGRGRGRGAPRGRAFDRHSQTDRVDSQKAVAQGWGGEDGKKELDNEQKAEADAQAEGAEAGATATPAEAEKVPEEEEDKTMTLDQYLAAQAGKKLNIESKAPREVATDDSAYAKLTKHEKEEADYFASTKTQKAKTRTQKEGKQLLDIEQTFNQPAVQRGGRGGARGGARGGARGERGAGRGRGGRGGRGGNVSVNLADKNAFPSLA

SEQ ID NO: 25602 - protein, 1491 aa, Ustilago maydis 521
MSASDRHAASDRAAGRSVRSWLRSLLQGPSDQHADRGTYASSQGSAVVSSTGPASVGTDMISFHHTFEDVERPSFAPPPRSFSGGSSNGSLSYDAAAKRTLAQPIATPRAGAAHSSTNLLSANSLATSPSPSASPPKSPRIARTLTSSVASLTDRLHHQRRASETYRRMRSGSTSAEVDSQQIVLSRSLSKTLDRDSPLLASPSAISENEPVSSPPPTHLSHDSQLSPTGSLANPSDSNRYGPETSGVRRSDSSGTTTAIGESLSPSQSSAGAAPSTCEASHELLLPEGEQMLKVTHKKVKPRTFKLDPDRGQILWESKKNNRVNLESIREVRFGPSAASYRTSLNISSAHESRWLTIIYQNNGIYKALHLIALSDQSLSRWRASLLHLQSLRRELLGAVGASSSLENRRHLWMRHHWKDADESNDEKLSIEEVILLCRRLGIESNKAHLRRCFNLADWRNRGFLDFQDFQHFVSLLKQRADIETIFAAWADQPLEQPLEQLRRGSGVTKDDHDLRGQAPELEGSPALSDASSVDTQSCPAPSVMQTSRVMGPEPCRTQAMSIDSFRRFIREEQGNHNFSNGQIDDLFHRHCNSRLSSSHHADAPTERAQMDYDGFLDFLSSSDNPPLLDQLPLFSTIVSNPVDATVLGRPPCSGSIDAVEYSDTQQCSQQQDTDANQCPQQRTPSRAFANTTDELIAAGASDSMANTRKVAAHLRKSTIQHDMTRPLSEYYISSSHNTYLVGGQWKGDSTVEGYIRALLQGARSVELDCWDGPNNVPQITHGRTLTSRVPFQDVISAIARYAFVTSPYPLILSLEVHADPPQQEVMARILIDTLGEMLLSQPIDSQTLPGSTDELPSPEKLKFKVLVKAKNVAAADGHQALPLPKAADGLALSAKQKDGTDVIPTMVLEPPTSATDTTSTTDSEIESRLTSAKQLVCRVTRRSHRVQATSAGQAGYRSGDASDDGTAKASYETPGNGSRSSKATKKMMSTALASLLIYTIGVKCRGFNKKESYATQHMVSLSEKTALKMIRDPISNEALIKHNRSHLTRIYPSMMSFARLHASRNFVPLDMWAAGCQLVALNWQTTDLGFELNQAMFSRNGRCGYVLKPAALRTKEHGKTLQGKVVRFQLDLRIVSAQQLPKKNKAGASKDKDKDKGHSYHDNREPIDPFVVVSLLTPGCWGKQPKGLLQKASTPREAKELPLSPAPPVDHCEAAPDSVIQTRQTSVSEQSSGDGTIAAASSHTDKRLQHSADVGSSSEPSPGPQRAKSSAKTTALAPTHLLRTPTVKGNGFSPEWHTHMSVLIDVPAGASNELAALVEASKASQGAALTYPELERLSRGLLDLCFVRFEVFDDDLDDDVAEEQATSRTTRGSEDTLAPTPSISTAVVESGSRLSLNPTAAIRQSNTEAAADDDAGSKAGSETSSTSSTSSIDAESVAAYSVSVGALQQGYRHLPLYDHQLSQFLFSTLFVHSRLRLVGLVDGVAPGKQS

SEQ ID NO: 25603 - protein, 445 aa, Ustilago maydis 521
MAIQKIQARMVIDSRGNPTVEVDLTTEKGLFRAAVPSGASTGIHEAVELRDGDKSSWMGKGVSKAIDNVNNVIAPELIKSGLPVTSQKEIDDFLIKLDGTPNKGKLGANAILGVSIAVAKAGAGEKGVPLYKYLAELSGVKAPYVLPAPAMNVINGGSHAGNALAFQEFMIVPTGAKSFTESIKIGTEVYHNLKKVINTKYGIDATNVGDEGGFAPNVQSADEALEILTEAIKKAGYEGQVHISLDVASSEFYKDGKYDLDFKNPNSDSSKWLTGKELADVYLGFIKKYPITSIEDPFDQDDWEAWSHLRANAGITIIGDDLTVTNPLRIKTAIEKKACNGLLLKINQIGTISESIQAAQLSQSDNWSVMVSHRSGETEDVTIADLVVGLGVGIIKTGAPCRSERTAKYNQLLRIESLEPSAVYAGIDGFTQGETAPKLITNKSA

SEQ ID NO: 25604 - protein, 248 aa, Ustilago maydis 521
MARTFFVGGNWKMNGSLESTKQLTQTLTQAKLDSNVEVVVSPPALHLLAVQEQLKGSKVAVAAQNAYHKPSGAFTGEVSVTMLKDAGIPWVILGHSERRTLFHESDANVAEKTAAALAENLSVILCIGETLEQREANETVNVVVRQLDAVADHVKDWSKIVVAYEPVWAIGTGKVATSEQAQEVHAAIRKWATEKLGKDTADQLRIIYGGSVAAKNCKELAQRPDIDGFLVGGASLKPEFVDIVNANA

SEQ ID NO: 25605 - protein, 354 aa, Ustilago maydis 521
MSHAHGQQPNHSTTFKVGETYKVVDVVGEGAYGVVCSAIHVPSSSRVAIKKITPFDHSMFCLRTLREIKLLRHFNHENIISILDIVKPDDYDSFSEVYLIQELMETDMHRVIRTQELSDDHCQYFIYQTLRGLKALHSAQVLHRDLKPSNLLLNANCDLKICDFGLARSANQPEAEGTGFMTEYVATRWYRAPEIMLTFKEYTKAIDVWSVGCILAEMLAGKPLFPGRDYHHQLSLTLEILGTPSLDDFYAITSTRSRDYIRALPFRKRRNLSLMFPNANPLAVDLMEKCLTFSPRKRITVEEALAHPYLEPYHDPEDEPTAEPLDPSFFDFDYCKEQLSRSELKRLIYNEIMR

SEQ ID NO: 25606 - protein, 368 aa, Ustilago maydis 521
MSPIPTIALGGSASHIQIGRVAFGCMGMTWCDPKDRTSDQQAFETIKTAVDSGSSLLNTGTFYGPQTDPYANLELLRRFYEAYPEYKSKTILSVKGGIPIANYRSKGMAGLTPDASLDALHDDLGAIREHLGTDHGGKEIDLYEMARRDTKVGIKQTMNNMLSLSSETYIDSEGKQQQGKRLFKHISLSELGLESIREAVSVAPIACVELEVSPWELGAFDQGIVSFCSSQKIPILAYSPTGKGILTGNIQSVDDLPESDIRRHMDRLQGENLAKNLELANEFKTLAKQHKPQVTPTQLGLAWLIASSHVIVPLPGTSKASRAQENAESANVQLDPDTKAKLDHKVKHFKTAGGRYNKAAREHSALWG

SEQ ID NO: 25607 - protein, 462 aa, Ustilago maydis 521
MAPTATASVGAAVASIPTTLKTVAHAVSATASTSASTLSTSEVIHKEAEYGAHNYHPLPVVFDRAQGAHVWDPEGNQYLDFLSAYSAVNQGHCHPAIVGALVAQAQKLTLSSRAFYNSAFAPFAEKVTKTFGYEMVLPMNTGAEAVETALKLARKWGYMKKRIPEGKARLLSVSGNFHGRTLGVISMSTDPESRTGFGPFLDRVGPGVDDMTIRYDNADDLEKVLDKYGHEVAAFLVEPIQGEAGIVVPSDGYLKRVQELCRKHNVLFICDEIQTGLGRTGKMLCHQHDNVRPDIVTLGKALSGGVYPVSAVLADKEVMLCIKPGEHGSTYGGNPLGCAVASAAIDVLVNENLCDRAEQLGARFRAQLRDIQHPLLASVRGRGLLNAIVIDEQKSTKRRSAWQLCLLLKSKGLLAKPTHVNIIRLAPPLVITEADLDRGVEIIKQALDELDSLDSIPGDDQH

SEQ ID NO: 25608 - protein, 394 aa, Ustilago maydis 521
MDLVLEIADTYALDKVWATLWPALPRSVAHNASALASLADASATSSANLTSLLGLSTEAATWAASASSSALSPSHWFENTVLKQAVSSSLSGNKVNWSALGHVSALPRDNLVRQTISLHVLTYLGILVLYFTFAGLSYKYIFNKEMQKHPRYLKNQVRLEIESSMRAFLPLVVMTVPWFVLEVRGHSKLYNNISDHGWEYAVLSVPLFLVFTDFLIYWVHRIEHHPRLYKHIHKPHHKWIVPTPFASHAFHPLDGYVQSLPYHVFPFVFPLHRVVSICLFVFVNLWSILIHDSDMICDSVLEKLINGPSHHTLHHMFFTCNYGQYFTLCDRAGGSYRAPRREDDPLLAVNAAELKKAANKKAAAKAAHVASSESDASSSGDEGVVIKKLSRKNK

SEQ ID NO: 25609 - protein, 1260 aa, Ustilago maydis 521
MAATSSQSLYQSAAIFAGGLAIGAGTLALSRAAFAPAHKPNKSIKRKVSDAKLRTADASKSSSTAVTAKNTATALAGITADGRTDPPASQQLDHVDAKGAGPAAPAKPELPGHVAPNGVDATAGGQKLTGLVNAQPINAAAPEPEPANRAKHVDARMDLSTVQGPSEAETAAKIAAQSWLLGISSTKLTSTAAIDSIAYGNSTAIFSYESQANGGFGSFSEQEAQLAAEKGWFKGRPSVFKMQTRSGAGNAIIGYLNAKGGSSSTEPTKVVTALTNAAGFAAMAPALVSYHGSDNAKLVLQVSAATHAAEHGQELNITNDYASILSTAAALGDSFEVVLSATRQEAVDLAQYAYQSPKNVVHIFDGAFAGREVGTLNIPTKGQKVDAPEPFLFTGSPKAQTVLVVPSGSHSQAARAVLVTLPPAVRHNVALLSVRSLRDWDEADLRKALPKSVESLHVLEEVSGGVVAGQLYEDIVSSVFDVEFAGSDIPSHVFPLALAPGQNLTAAELSKLLETLSGNHNAALKLQDVIDEADGDHADLLALSGASVLSFFDSEISPTAPLAQLTARAIRDRGSDTQLHARLLSRYDNFEASGILRSDIILSSRPESAADAPIVLAAEENVAKVLVVSDPATTLRSYAPFQSLARGGTVIFNTPGWDVAELDSKLRAEDKRVLAQKSARLLLIDAAAVVEKLNTKTANASGGKAKVGDNVVPAEIAAAVLLVAVLRVQLNISGAALAAFLKRVIGTAPVGINGVEGLVLAAESAIQLHAFNDEEWSRAEPISEAEQNAPLRPTQIRYNGFGPNPDAATVGIEAAPFRSTWAQSAWQHLFSEAYDTKLDSLRPDLPEQTWVVEVTENRRLTPVDYDRNVFHMELSTKGTDLKYEVGEALGVHGWNDEEEVAEFIRWAGFDADEIVNAPSLTEAGKHESRTVFQTLQQNLDIFGKPPKRFYEELGKLATNRDEARWLRFISSAEGSYTFKKLSEIETLTYADVLRMFPSARLPVDQLLTLVEPIKPRHYSIASAQAAVGESIHLLIVTVDWKTPSGSPRYGQCTRYLSQLKPGAKVTVSLKPSVMKLPPIDSQPIIMAGLGTGAAPFRAFIQARAHKKAQGIDVGPLVYYFGSRYRSAEYLYGEELEAYTQDGVIQHMGLAFSRDTSKKVYIQHKILEDGDLLTQYLGPEIEKLEAAGGKAEVVLQDGLINDEDVEEGKKGYFFVCGPTWPVPDIHEALVGAFVKKGLTKDQAEKKMEALKEDERYVLEVY

SEQ ID NO: 25610 - protein, 482 aa, Ustilago maydis 521
MTVGVASKLLDAPFSHVINGKSVDTQGFKTLDVIDPATEKAIAQVPIATKETVDQAVDAAHAAFPSWSKTTWDERAKLLEQYGEEYKAMLPELVKLLTAEQGKSIQFAQHECETILPWFTELAKVRLDEKVVHENDTHKAIERYVPLGVCAGIVPWNFPVLLMLWKVTQAIVTGNCIIIKPSPFTPLCDIRIIEAAQKVFPPGVVQIVVGDDNLGPWITEHPRIQKISFTGSTATGKLVAKSCSATLKRFTLELGGNDPLVVLPQQKDLAATAQNVLLAAFFNSGQVCIAAKRIYIHEDIYDEFKATLAQVVQHFKVGPGNEEGVMFGPINNKMQYNKVGEFFEEAKKNNFNLVAGGQVEEKPGFFYPLTIVDNPPENSRLVQEEPFGPIVPLLKWKDEADLVKRINDSQWGLGASVWSSDIQAAERIGRQIESGTIWINCLVHHHPAVPFGGFKSSGIGAEHGKNGLGAYCQVQALWIPKA

SEQ ID NO: 25611 - protein, 315 aa, Ustilago maydis 521
MYIEDPAEIAAIATEFISNLDNLPQEVSHMVKEIEHIGCTDPKSYSPSLPEADRIKAEKLTDKIRSDYGRADEWSSQKEALSLRLWRAIHAHQKHLKEEMNKISPAVLSNYASTASIGTPVVPSLSALPAALAGLKSPAVEMESPLAGLKRKGSLLSPGVGTLIPGTPMSAAARARAGGRTTPLDSGSPAPPERGLGGAIRGGGASRKARGGSLSASGPGRSGLSQSTELGGLGGLEGFEGEGGEGEEGEEKDDTPYCFCQRVSFGEMIGCDNAENDPDCKEWFHIGCVGVTKPLPQKWYCSECLAKLKNKRRRQ

SEQ ID NO: 25612 - protein, 208 aa, Ustilago maydis 521
MAGLSADYDYLFKLLLIGDSGVGKSCLLLRFADDTYTESYISTIGVDFKIRTIELEGKTVKLQIWDTAGQERFRTITSSYYRGAHGIIVVYDVTDNDTFSNVKQWLQEIDRYACEGVNKLLVGNKSDLTNKKVVEYATAKDFADQLQIPFLETSAKSATNVEQAFLTMAKQIKDRMGSSTVNNQAGGKSTLKVGQGQNVSQQSNGGCC

SEQ ID NO: 25613 - protein, 302 aa, Ustilago maydis 521
MAFGDRGGRGGGARGGGRGGFGGGRGGAGGGRGGFGAGRGGAAGGRGGFGAGRGAPGGRGGGRGGGRGAPRGRGAPGGRGGRGGARGGGKPGARGGSNVIVKPHRHAGIFVAEGKEMLLVTKNIAPGESVYGEKRISVETPGAGADGTTAKTEYRVWNPFRSKLAAGVLGGLDNIHIAPGKKVLYLGAASGTSVSHVADLVGPEGIVYAVEFSHRSGRDLINMAKKRTNVIPIVEDARHPHKYRMLVGTVDVIFADVAQPDQARQLYRLDSTRRGRVCCRSQQVERHEVQATRAAYARAIRA

SEQ ID NO: 25614 - protein, 2168 aa, Ustilago maydis 521
MAPVATSHENTRQVRFVDKLNVAEQVAVHEEAISSDSLEASGFDEVERSTHFWAGSLPAAQGLYDPDNEKDACGVGFICQIKGKPAHKIVSEARFLLCNMTHRGAVGADARDGDGAGVMTGIPDTFFRRESERDLGVKLPAQGQYAVGNLFFNPKDDNARAEHVHTFTTIADKLGLRVLGWRDVPVDNSILGPASKSKEPKIMQPFVVLKDHYGSGSTPLETSKPFDEQYFGRQLYVLRKHATHTIGLQNWFYICSLSPTNIIYKGQLSPVQVYNYYYDLNNVHYASHFALVHSRFSTNTFPSWDRAQPMRWAAHNGEINTIRGNKNWMRAREGLLKSETFGDELDLLYPIIEGGGSDSAAFDNVLELLVINKVLTLPQAVMMMIPEAWQGSADHMEPEKVAFYQWAACLMEPWDGPALFTFADGRYCGANLDRNGLRPCRYYITDDDIMICASEVGTVTIDPKTVIAKGRLQPGKMLLVDTVEGRVVEDRELKLSTAQRADFAAWLENQLLRLPEIVDTVRRNTANAIAPVLDDERLSTDPKLLAFGYTAEQINLLMLPMVADGKEALGSMGNDAPLACISSAPRVIYDYFRQLFAQVTNPPIDPIRESVVMSLEQYVGPEGNLLEMKPEQCHRLLLPSPILSIDQLNAIKQIDTVHSDWSAKTIDITYDKGEGIIGYERTLDRICSETSQAIRDGYRVVVLSDRAVGADRVAISSLVACGGVHHHLIRNKERSRIALMIESAEAREVHHMCVLLGYGADAICPWLAMEAILKVSREGLVKGDLSPNQLIDNWTHAVDNGILKVMSKMGISTLASYKGAQIFEALGLASDVVDRCFAGTASRVSGSDFTLLAMDALEFHDRGYPSRDTISVPGLPESGEYHYRDGGEAHINDPMAIAHLQDAARERNQASWDAYSKASHNAVKATSLRGLLDFDYTKSRAIPIDQVEPWTEIVQRFCTGAMSYGSISMEAHSALAIAMNRLGGKSNTGEGGEDAERSIPLPNGDSLRSKIKQIASGRFGVTSNYLADSDELQIKMAQGAKPGEGGELPGHKVSPSIARTRHSTAGVGLISPPPHHDIYSIEDLKQLIYDLKCANPRARVSVKLVSEVGVGIVASGVAKAKADHILISGHDGGTGASRWTGIKYAGLPWELGLAETHQTLVLNDLRGRVTVQTDGQIRTGRDVAIACLLGAEEFGFATTPLIALGCIMLRKCHLNTCAAGIATQDPELREKFAGQPESVINFFYYLAEELRSYMAKLGLRTINEMVGRSDLLKVDDSLRTPKTANLDLSAILKPAHEMRPGAATYKVRQQDHKLYVRLDNKFIDEAEPALTQGLPVQIDCDVVNTDRALGTTLSYRVSKLYGEEGLPTDTIHINAKGSAGQSFGAFLAPGITIELEGDANDYSGKGLSGGRLIVYPPKVSPFKAEENVIVGNTTLMGATSGFAYFRGLAAERFAVRNSGAHAVVEGVGDHGCEYQTGGRVVVLGPTGRNFAAGMSGGIAYVLDMNRDFRSKCNTEMVELGPVKDPKEIAELRNLIENHRHYTGSTVADHVLHDFHHILPRFVRVMPLDYKRVLEEEAAKAAVEKKRSSHVDLLGTLSRHGSQVEILPQEDNAKDNAADGVREIPAAKPVEPAVVDVEDSMVDDETAKARLNKLDKTRGFMKYKRLGEHYRNPTKRVKDYKELSTRLSEAELKYQTARCMDCGVPFCQGDTGCPISNIIPKWNDLVFKGQWEDALNRLLMTNNFPEFTGRVCPAPCEGACVLGIIEQPVGIKSIECAIIDKGFEEGWMVPRPPKVRTGKTVAVIGSGPAGLATADQLNKAGHSVTVYERADRIGGLLMYGIPNMKLDKGVVQRRVDLMAAEGINFVTSTHVGRDVDPKQLHAQNDAIVYAVGATWPRDLKVPGREADGVHFAMDFLAPNTKSLLDSGLQDGHYLSAKGKDVIVIGGGDTGCDAQATALRHGAKSIVNFELLPQPPNERAKGNPWPQFPRVFKVDYGHAEVAAQWGSDPREYCISTTSFEKDADGKLIALNTIKVNWELDASGKWQMNKIPGSEKRWPCDLCLLSLGFLGPENDAVTALGLEQDGRSNIKADDQKGKSPYKTNVERVYTAGDCRRGQSLIVWGIQEGRACAAQVDRDLMGNTRLPWAGSIKKREFLPITGAEKTQVAATA

SEQ ID NO: 25615 - protein, 350 aa, Ustilago maydis 521
MSGPLVLITGITGFLSAHVLDAVLASPANYKVRGTLRSISKKDEILARLSAQDRERVEFVQVADIATSDLLAAVRGVEIIHHVASPYQLNVQDAERDLLIPAVEGTLNLLRFAKHEKSVKKIVITSSFAAVTNFKDGGPYRPGFVYTADCWNPSSYEDAIKAGGAGAFSYSVSKKLAEKAAWDYLANEKPHFEIACINPPMIYGATLQPVAKLSSLNTSSKTIYGLINSADSMPEDRLPLFCHARDVGDAHVATTEKPDGMGQRWLLCGGKFTWAHAVKFIAEQYPDLQDRLPKGWKEASANPRDLNTIVDLDTKPAQTKLGMQFRDWQITLKESLDSLLELEKRPGWKN

SEQ ID NO: 25616 - protein, 357 aa, Ustilago maydis 521
MAVPKILVCRTMPSSVLKRAEAAGQVQLITRPDAEGEQAPSREWVLSNLRNHSVCGAVICLSEKVDAEFLDAAGASLKVISTMSVGYDHIDLALCKERGVRVGNTPRVLDDAVAEVCLLLALMVTRQVPLAIRTVRQGEWPQNPWTPTCFTGPQIRGKTIGFLGFGNISQSLCKLLVAFKPARIVYTTSKPRPFDEHDAYFASLMQDRFPVQTIQVENVEDKFEMANQADLVFVMVDLNPSTKHIVSKQFLDAMKPSAYMINASRGGTVDTAALVDALRNDKIAGAGLDVIEGEPVVHADHPLLAPDCRDKVALLPHIGSGTTETRRAMADMTMNNLLGALGLRQESGQESSMEAEL

SEQ ID NO: 25617 - protein, 1239 aa, Ustilago maydis 521
MSSSQRPVVQPIPPFKGAPLQATDVQNRRPTAAEAYVALANRKAGANVVSTRATGCENHRPSQHQPTSHHASQRQQPAPAADRRVQQSQPSERPKPASRLEREKKRHHNDPKNIGHWRLDKLIGQGASGRVRLAIHDQTGQKAAVKIIPRTLINASRMSLRDADVKANKMILGIEREIVIMKLIEHPNLLGLWDVYETSKDLFLIMEYVAGGELFDHLVAQGKLSPRDARGYFRQIIFGMDYCHRFNICHRDLKPENLLLDETKKIVKVADFGMAALQPTEKMLETSCGSPHYASPEIVSGKRYKGTASDIWSCGIILFALLCGRLPFDDPNIQQLLGKVRAGKFIMPEWLEPASKDLIWRMLEVDPEKRIKMADIMRHPWFTNNGTESSVNPVSTSLDSLQMEELTLDTIDIDILGNLKTLWFELSEQDIIKELLAPGPSWQKTFYTLLVAHRENHSADDEDDMNDDILDEQIVTASAVPAHALLSTTSAAKTLEKPRPRRTSDAAGATSAPASPRLESVEMDRRHSTPEKGSVYHTTSRRPDNVTPPKVASPHVRPANPSPRLRPSPLDSPASTLDSAFVSASKLKVASPTKPRALGSSHGADKSGYVLPQISLQTASPQRNERPAVDLQRRNTSPTKPNTVGVTAPLSARIALANMYDAPTLSHTATASCGSTSSTASSTVSVSAARNRANRGSGSEMMPPLALPGRASSRPVSPTKSTFGAQATLPPQTAPQPAPPRPSTSRAYTTQPTPCIQVPQVGDATMQRFFQEIADELASIRATGEKPDALQSKLDQLKNSMAWQQQQQQQQLQSQPMAVTASAPSARTRNSEMNQFEDAEDDVSEGESMRSVSQASSHQQTYTPSTPMTPLSPVELIAPLALTDKSGAGARSSVASSSASASARNSVRSARSGTEASSSGTTSRPTSVFSNISTGSTGLGRKRSLLGLRRADKHAQQQHATATEANTIRSIAYESTPTPTALASVFAAPASGRFVPNGGATTASSVRMQRLNPGLGLDIGASSAAGIISPPSTPQSPNTATLSPAPAASASAIASASAPGKKDSWFAGLFNWKPATFTLMSSENFSETLTECIRRLQSYGVRVAMDDSSDVHHTTLKCSINEYRESNGVVTAAKPLRFRVDVHILAVGSPATNSAYMGGGLGLSLHGGAVGTNVNATSIMTHGLPSPALSTYSRASTPGGVTFATSVLVVQEKGALSTFKLIHARLRREWMLDLGSAII

SEQ ID NO: 25618 - protein, 297 aa, Ustilago maydis 521
MHLAAGVAKSRGKYQTLVVECISYRCAHHAWYRVILKVGMVGDSQIGKTSLMVRYVEGSFNEDYIQTLGVNFMEKTISIRNTEITFSIWDLGGQREFVNMLPLVCNDAVAILFMFDLTRKSTLNSIKEWYRQARGFNKTAIPFLVGTKYDHYATLPREEQDEITKQARRFSKAMKAPLIFCSTSHAINVQKIFKVLLAKAFDLKCTIPEIKGPGEPLLFYVTALRHSFARAHRHSPVFCIYMSLPKIQIFAFKVRRVTNPPDSQPAPDAGHGNSDRDDVKHVGGRAELLDVDSYPCA

SEQ ID NO: 25619 - protein, 1110 aa, Ustilago maydis 521
MKFARYLDENTVPEWRKVYIQYRGLKKLIKRVAEHREARLRLEAELGINSSHSSSTTIAATASSADPYIRRRNVAGHFSGLDQEAQSTLASSSGFKRRIDYGGTTAPAPSLSTLPPVSLQGTGLRLSSDSPTYDGSAPPPNLDSDLEAQALPSTSVQVSGNYARSGAYPSIDLELTANADTPSPRTTGATNVRYQDDAPPSSGSARKHASHQSKSSSASSKHHLLSKSGSSGRFSNPNRSLKDEAPESLQELIVANFDDQEAKLFLACDAELERIVDFYEAQEHSAAKKYMQLARQLEELAEHRREYRAKYNISDQDRTGAGSRRHRMSQLLMNLPGSKLIVADPVASGVKSNAGLSSVKLRDAQQQGQQSANRAPRFSLDKSINKQHSGSSGEDDQDAGGRRRAQALAQMQASLRGWDDETDRAIRQANKAAAMSHDPEAYAAARKKLKAAVLEYYKFLDTLTNYKILNRTGFAKVMKKFSKTVGVACTDLYYKDRVAPTILVSSDRVEKLRKATEDIYTAYFEHGNRKQALNRLRAREDHTTHHYSVFRSGFYLGISVCAIVAGLVEAMKPNTQRDIPQWQALLRVYGAELIPTLFGLLFGLNLAWWHAVRINTVFIFEWDVRTTMDHRQFFEIPALLMLLLSCCFWVSFVNPFPEAIAPTTWPTVWLVIVALVMLNPLPIWMAASRAWFVKSLLRVFTAGCKRVEFRDFFLGDELNSVAWSLSNLWYIGCEWHHDWTDPDQCFPNSTYWTAVLLSVPAWLRLGQCIRRWVDSDYRTHLHLVNAGKYLSAVLNNFMYIHYRRNGSQNARDRALWILFAVIYSVWHIVWDLLMDWSLLKPRAKFWLLRNEIWFPQPIYYVFITVDIIGRSIWLIYLLPGSASLTLRSFLAALVEMIRRVCWNNLRVENEQIGNTDSFKIMRDLPLPYRQKLIDQAEADVRANDSDGVHKTGIFSSVKLASLRKKSRATTAAAAEHRYAADDQEYARYSQTVQGESVVESSVPDTLAQERRRSLMEGLRSKLVPDAKGEHYGKQLDERAVTKGDTGRDYEPRRQESMPGYVDMDSDDDDDEETADEQHTIPSSPQSGSDQFAHETSSKLPRWPPKARSRE

SEQ ID NO: 25620 - protein, 412 aa, Ustilago maydis 521
MYQPQGDYPSRSPPPLQHPIPTHPPFKVPDPPISPNPVPQASVTDPHVSAANRRGGPAANLQASAGGGYQRFASPPIQSPPTQPYAAASSSSYGQPGAAPTQNYFTSAAGGNVAGQQQGWGGFGGFSGAGGVPIMNDATAQMGVQFGQHMAAVGGEYVQKNFNALLPMPVLKHYFNVSNSYVLHKLRIVLFPWRHKPWSRAHRHSAAVGGVGSAYAETPSGIKTASSGAEGFLPPRDDVNSPDLYIPTMAFVTYIIVTSVILGLESRFHPEVLGLRASRALAIILVELAAIKFGTYILNIQGDHTMMDLLAYSGYKFVGTLITLLVGLLKVRGLVYWSVFLYCFAANAFFLLRSLRYVVLPDPSSPSSQTITHAQRSRRIQFLFCIAVVQIVFGWALIIGIFKDAPVSKKVV

SEQ ID NO: 25621 - protein, 1568 aa, Ustilago maydis 521
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSTVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGDGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 25622 - protein, 294 aa, Ustilago maydis 521
MSRPPELDRNQDATCYIGNIDDRANDAIVWELMIQAGPLVNLHLPKDRITQSHQGYAFAEFQTEQDADYACKVMNGLKLYGKPIRVNKASNDRKPIDIGANLFVGSLDPAVDERLLYETFSAFGGIIGLPKIARDPTSGEPKGFAFVSFDSFEAADAAIEALNGQFLLNKNITVDYAIKKDSKNGERHGTAAERLLAAQARKNNALPTQPYPQRPVGAPYAQPPGAASVAPPNGNSQGAWSAYAQHQQQPQAAYPLAAAPQPPQQASHLAPAYPQNPPIHMSPGGPLAYPPYQY

SEQ ID NO: 25623 - protein, 352 aa, Ustilago maydis 521
MCMNVIEASLVLQNWTNIQTFVSKAEGVLESFLPSASVGEKKLSSLGTSNIVPPTKGASTAGADAIGALFRAGGSAAVPTAISSSSNAQAGSSTEDPTHAASRKRVDEISAKLRAVNAVAELGRRSYEKAAKILLSIDPALSSSFSDIISPSDVSLYVALCSLATMDRAALKTQVIENTSFRGFLEYDPYVRELLEAFSLAQFKKVGEILDQHQARHLLDPYLAPHVETLRTRLTRRALRQFFTPFDRVSIPRMATAFGWSVEQMIEELVACIERGEFKNLPGKAAEEGDARIDAITHTLEYKTKDPRRAVFDAAVELGDKRCRETRRLLLRMKLVENGVVAKAQRAYHTEP

SEQ ID NO: 25624 - protein, 402 aa, Ustilago maydis 521
MGKDYYQVLGVAKDADDETLKKAYKKAALKWHPDRNKDNIETANKKFKEVGEAFEVLSDKNKRAIYDQFGEEGLKAGGPPPPGADGAAGGFSGFPGGAAGFSGGFPGGGGRTFTFTTGGAGGAGGAGGMGGMGGFSPSDPNDIFASIFGGASPFGGGMGGMPMGGMGGMSGMEDMFGGAGGGGARRKAGGGMPGAFNFGASPNTGAGAAADEKPSDVEKQLPLSLQDLYTGTTKRLKVGRKLASGGSEEKILTVEVKPGWKKGTKIRFGGAGHEVSPGSFQDVVFIVDEKPHAHFRRDGDDLRLTIPLKLIDALDPPKPGTPGSRKQVETLDGRKIDVPIPQPVAGTSCITPGKTTRLANEGMPISKTGGKRKGDLVVEWSVQLPEHLTPAQKEGLRKVLAP

SEQ ID NO: 25625 - protein, 338 aa, Ustilago maydis 521
MSSLPKTYKAAVFEKTGQPLTFKDIELKHPEDGQILVKVEACGVCHSDAHVQAGAFGPLPRVPGHEIVGKVVEVGPHVTRWKSGDRVGGAWHGGHDGTCRQCNQGLFQMCDNGQINGVTRDGGYAEYCLLQAEAAVRLPSDGDAVQMAPLMCAGVTVHNGIRKMNITPGEVVAIQGLGGLGHLAVQYARKMGYRTVALSRGTDKKDFAMKLGATDYIDTSSQDAAEALQKMSGAALIVATAPNPEHISPLVGGCKPMGKLLILAPVGDVRVNSIAMITKGISVHGWPSGHALDSEDAVEFSQRFGVECMCETFPLAKANEAFEHMMANKARFRAVLTM

SEQ ID NO: 25626 - protein, 363 aa, Ustilago maydis 521
MSGESVPTKMRAATIKDFKKGYEIKDIDVPTDLGPNDILIKIAAAGYCHTDLQVMEGVYESQGAKPGLVGSHEPAGTVVKTGSDAGKSGIKVGDRVGSINTYGYCGKCDSCKQGKQLCDNMPGMLGLTLNGGFSQYMKADARVVSKIPDSIPFDQAAPLFCAGATVYGALLAVEPQKRQWLAMVGIGGLGHLGVQYAKAMGCNVIAIDNRKEGLELTNKAPDHLKPDKTFLIDSEEAQKKCIDELSSSFYETNPGVDRVVINCEDRGLIKFSQQFLRKGGQLVDVGLPADGPFELDSFAMNFKEQTIRGRLICTPEQCQDMINLHADNGCTTFIEKTYTIDQANDMAEHYNSKKLQGRLCIVF

SEQ ID NO: 25627 - protein, 484 aa, Ustilago maydis 521
MGQTLSEPVVKKTTSSGGNDSVLYAISEMQGWRISMEDSHTTILDIKNEDGDIVGNFFGVFDGHGGATVAQYCGRNLHNTLLSEDKFKQGDYTEALQQTFLDVDEELKKDPNYTSDPSGCTAVTAFIKTTAKDPKRVEKIFVANAGDSRCVLSQAGNCIEMSNDHKPTLDSERERIEYAGGYVSWGRVNGNLALSRAIGDFEFKRTFDLPVERQIVTAFPEVLDREVLEAEDEFLVLACDGIWDCLSSVKVVDIVRRSIANGKELADICEDLMDRCLAPDSDTGGIGCDNMTVCIVALLNGRSKDEWYSWIKDNIEVPKFGRTTPKEVPPVFSNTQTSTRGQETGMEGAVSIQSLLSGGLARGENGEQGAAGALQLPGGLAGALSGAGIVFRPGGRSDEGEVVYEAHVVDEEDSGDEQPDQSSSESAPKASTTEKATDGDAAEPRLVESPHTDAKPASSNQESDKMEVDDDTNTSAKSQDASNA

SEQ ID NO: 25628 - protein, 192 aa, Ustilago maydis 521
MQSWVPDADRDDRSGCERDARWACTLTLSRSHQLGLVRTTIQLGHVVSISMKFCTGVVVCTLLASAVRADTRLSDKLQVGVKYRPEVCDDKSQAGDLLAMHYTGTLADGKKFDSSLDRGQPFEFTLGIGQVIKGWDKGLRDMCVGEKRKLKIPPSEGYGSAGAGGVIPPNAHLIFEGKSAPCEPCVAQPHTY

SEQ ID NO: 25629 - protein, 161 aa, Ustilago maydis 521
MDPTNLFDTQFVVSQIDPDGKKFDRVSRIIATSPSLDMTLSIDIATDIWPVTEGQQLTFQLASTLKKETSSAKPDGVDGETQDAAAQAAERDAWRLDQPGNGGIADDFDYVMYGKIYRYDEKVADEVTVYGSFGGLMMALTGNFRHMSNITIGSNVYLLMR

SEQ ID NO: 25630 - protein, 322 aa, Ustilago maydis 521
MTKTLHERFLQEKTVAIVGCPFSGGQRRKGVDTGPVSLVQAGICQQLESLGWKVDFTDHHSFDHINQGIDSDTDIGNMKLPRTVSAVTKEVAEVVESHAKQGKLPLTLGGDHSLALGTVSGSLRAHPDAALIWIDAHADINTPETTESGNLHGCPVSFLLGLQGTDVEPFNSWVPSKPLLRADSLVYIGLRDIDAGERKILKQNNIKAFSMHHVDKFGIGKVVEMALDHVNGAPGKRDRPIHLSFDVDALDPSVAPSTGTPVRGGLTFREGHYICEALYETGCLVALDLMEVNPSLLQDREAQQTIAVGCSLIRSAMGETLL

SEQ ID NO: 25631 - protein, 1114 aa, Ustilago maydis 521
MPPPPSSTHNPSANGGIRNAAPSSSAMASSAPQSVNEPSPSSSVKLDNQKHAAYKLPSRPTHLQAPSGANQPQRRQWPQPSSAAQNGNSFNSVAPSSRHDYDDEDEDEEGAIDDSATSKPAANLLSSFRPAPPKTPPYPSNSQPAHEEHRGNDRFQPSDARKDQNHSSSYQLRSPSPPRRSQQSTTTSRAHVAHLRSPSPPESSSRRPGRDHDNGMTRISTNDRYHRGDPHLYHPSASELRSKDDRHDAAGSHMWDRAKQDLKRASNDDWRREDRGWNHDRRAGAGARGGGGGGGGGGGGGGGGGGGGGGARSWDREYDRRYDRNERDRDRPRTHSRYHDPRDELPREKPSNRNGRDKELSPHTAGTEQQYAGWSPTPPQGQPADPLSNGNNGEPFANRPPSRMGRAAPPPLLSNIDHPPTFNANRDLDSSLAKRARSRSPPAGLLKRKANFNAVMPPALAPVNPDASAPAESENVTPGAPLPPKVETLQSPSMPASRLGSESVAATAALGSLPGSAIATAASSGAATATFPTAASGGSVAVPADANFNATCQALDDFTLPSVRLSCLPRKLPDRPSTSGRERRKARGPPVPLNQRKFVGCSSLDDYEISIKLGQGTFGEVLKGRQILTGTQVALKKVTIHDAKDGLPITALREIKLLKKLRHPSVVPVIDMAFRPSGERGKLGDVYMVEPYMDHDLNGMLENPSIRLEHSQIKLYMKQLLEGTLYLHKNRILHRDMKAANLLIDNQGQLQIADFGLARPYRDPGQSWTGKGWTAGTHRYTNMVVTRWYRPPELLAGEKKYGPPIDMWGIGCILAEMITGRPLFKGTSEINQLELIAKLCGSPNETNFPGWSSLPGVKDADPTGRPDPHPEIPGQHAFGDYPRKVKDHFRSVYDAGPGCADLIDKLLVLDPRKRLTAQQALEHEWFWTKPYPADPKSLPKYEHSKEIDRARRDWKPAPAAAAAAPGGGGMAAATMARPRPAMQQLPYIAGAPQQRAYNRPAGFAQSAGYAMPATGMPTPDATDTWDARAAPPPMAGGGARHAFPHPQGGARFTHPNTRPAHHAHPQQPQQPQQAQQAHAYYPNHREPAQQRQQHSLPQRPVGPPRASGGNPYSM

SEQ ID NO: 25632 - protein, 1362 aa, Ustilago maydis 521
MNPSYTERRASAHPTMSSSAHHASSTPSAASIDPTTSHAISSGIPITSPAALSYFAAHPRRQQVHFGNYLLLQTLGEGEFGKVKLGVHKEWGEEVAVKLIKRDKVANDAAPLHLDDSAQKDPAKMSKVEREIQVLKDVRHPNIVRLYEVIESDRYIGIVLEYASGGELFDHILAHKYLKEEHACRLFAQLISGVSYLHHKKIVHRDLKLENLLLDRNRNVIITDFGFANNFEHKRNDLMATSCGSPCYAAPELVVQDGLYAGSAVDVWSCGVILYAMLAGYLPFDDDPANPDGDNINLLYKYILATPLSFPEYITAQPRDLLSKMLVPDPTRRATLEQVMQHSWLRHYRELFKFSVDDLERAAMEQQTKKRQMYRQQMMYQQQLQEQQRRQQMERSQSVRHNVSHLPVGTAYTANTAVSAVSAANVAHRQTLPISATVPDRLYEPIGSASRGADHSVTPQRAPTASSHQPPVAPTASADAAIAPLPRASTHNNVAAAADAAAAVAAAPSPVDPVTALGNARGEPRTRLDDAVPTIAAAYETEPRQLAAQKVQRHTIQLEYGGDERPRKESAPGSRQASQTQRNASASSTSSKLAEIERTKTAADKPAANANAIVPPSVLQSTSVQVPATSVVVPESEKANISKAGAPDMMRSVSASAASRVSVPPPIMEQTQPSVSAHRSTQPTSSSRVRAPSSASRNNADSGSTGHATRIPTSASQRVVSTSSAASEPVGFPSSATERTIPSADADAAAGRISASRRASNGAEITEPSHRSPSATRHATADNAPVTSASASARHRKGMSTDKFFLSRLLGSNSANQPNGAGVAGDKVSANGSDAAGDKTKRDSMNRPAPERAPSSSSTGKNGRRKAMSLVVGHASGEASSAAADRNRALKAGMPHSATRATFGTQVSGKADDSVSSAQKQRKGSASLASQTTSTSRAAQSSTRPQPLQPSLQQQQQQQDKAFNDGSTIASSSTAGPSSNAAKKVMDWFRKKSLSRGTFNEQPPLGLFERSPTSSYMHGSASQTPSVIVTSAPNGTSRHAEAPSGGSSVPSSRSTSGTHSENSEATEMTQLTNLSDASHQEGDGLKSSASTVQQQATPKASLSAVSNVSDASAAGSLVSTRSQQQQRPQPRVATATSASTTPARFNEARLRYHLGAVDQSALTSRSPIEVLKEVQRVLYEMGIDVRTEKDEDFKLECVRRKRAKTLMSATHGFGMSIRSSVFPPTQADVERSSRMSHRDSLTPSASSPGGGSLRSFLKRSSLQPGATSPKMGSSTLPSSATVTSNLGGAVHDENQPPPLYGDASVDGGQEIRFSVEVTRIKNLTGLYSLDIRRMKGNLWAYKFVYQALLDRCQLGSSTAAVG

SEQ ID NO: 25633 - protein, 1117 aa, Ustilago maydis 521
MAGGNRYRKNVWLVFAFLIVVQIVCFRGSQRLRIDLAPQSRATPAHHDWYKRQEPSLLDLLKHTSTSATPAPTKTPSSTNHKQHHSTSIISTITPQPTTPSKHPHDKPGEPACQPIPFEASPRHVCRHVIQHCSASGHFDYLRFYYCAGVSNDELEHGKPSVPPSKQRWQPGIAALRFLRLLLILMWMLFLFSWVGVVASDFFCPNLSTIASRLGLNESTAGVTFLAFGNGSPDVFSTFGAMKTDSGSLAIGELLGAASFIVSVISGSMMLIAPFKVNAWPFCRDVGFFTVAVALTLTFLFDGKLRRIETIALICLYLLYATTVIIGSWWQERRRKQKRRLEVAREEYDRHADDRSILSRGSIQFGRDGAQNEEHSRLRAPSSLSASQRLASPSEYDPDFDPFEDWANQRGDQSRASTPDNSCNGSRAPSIHTPGSAKSLANRKATLNVRPNLVPRHSLLSAIEFRDVVQSLRRDAIADRSQEIFQSWDPERFLPHHHHGTTQINVARSVSGDARTPSSPVQYRRTRHSRVLSLGPSAATGIGLPRSTSTSSGTRRKSIGAHETAGVNAGSVDDPWREHIAGDACEPLISPALPIGNSVERDTPNETALRKSLPRLEIPQWDTKASRGQETRRSLQERKAVAQNEASSSTPVSKDRFDKFASQRRIRPARTPSELLAWKMRVIFNSLFPSLRHLHAKSLLGAAVSIATSPAILLLNLTLPVVDDEAEQAEREADIAEADWIGAVRLEGDETQLRAEVDDSLDPEPVADLRASSSTDMHGWSAQERVEAMEDAERDANALRDQEIASALRRLPSMAGSPLSLGNSPSARAGHVRLPSAGSALLASDQQTSLDAASFMSHESCEAEEQEMRRSIRRFLILCQSVCAPTFVTWAIVSSSGAPYLGLKVAAAALVGATTALASFWAMRRKDAGRARYSDRTLSTLAMVRCSMGFTVSVMWIMTIVDEVVSILQTVGIIVGLSDAILGLTVFAVGNSLGDLVANITIAKLGHPVMAISACFAGPMLNLLLGIGISGTWLLSDGNAHWDHTGAADIYPIDFNPTLLVSGLGLLLILIGTLIAVPMNNFELTRPIGISLIAAYMLIMTVNLLTEIFWVRSHTVF

SEQ ID NO: 25634 - protein, 418 aa, Ustilago maydis 521
MKLNLSLTFVTALATAFAGVEAGVHKAKLQKVTPSRELTLEGLAAQAEILQLKYGGGSSKKQVPFSSNPEHDFSIQPIADSSQAAAWYAEAKKGHGVPLTDFLNAQYFCDISLGTPAQDFKVILDTGSSNLWVPSTKCSSIACFLHKKYDSSASSSYKKNGTEFKIQYGSGSMEGIVSNDVLKIGDLTIKGQDFAEATSEPGLAFAFGKFDGILGLAYDTISVNGIVPPMYQMINQGLLDAPQVSFYLGSSEEDGGEAVFGGIDDSHYTGKIHWSPVKRKGYWEVALDKLALGDEELELDNGSAAIDTGTSLIAMATDTAEILNAEIGATKSWNGQYSVDCEKVKDLPPLTFYIDGQPFKLEGKDYVLEVQGSCISSFSGINLPGPLADMLIVGDVFLRKYYSVYDLGKNAVGLATAK

SEQ ID NO: 25635 - protein, 194 aa, Ustilago maydis 521
MSELRRKLVIVGDGACGKTCLLIVFSKGTFPEVYVPTVFENYVADVEVDGRHVELALWDTAGQEDYDRLRPLSYPDSHVILICFAVDSPDSLDNVQEKWISEVLHFCHSLPIILVGCKKDLRHDPKIVDELRKTSQRPVSAEEGMAVAQKIGAVRYLECSAKTGEGVREVFEHATRAALVQRSRGSRKKGCTVL

SEQ ID NO: 25636 - protein, 1647 aa, Ustilago maydis 521
MSQPGARRAYHHGSQRGGSTINQKAALASAYQELGKELSSSKLKIVGNYTLQRPIGEGTFGKVRLGLHRLTNTRVAIKQIPKAHSASLTREIHHHRRLHHPNVMQLYEVIATEQYIWMVSELCAGGELYDYLVENQVLAEPEARRIFGQLCLAVAYVHSKGIVHRDLKLENILLDERCNVKLGDFGFTREFERNRLMDTFCGTTGYASPEMLAGKKYTGEQVDIWSLGVILYALLCGALPFDDDDEAVMKQKILQGDFEIPDCLSEEAHDLVVSILQHDPAKRPSIQSILAHPWFTKMMVNSPMSTLEEDQIATDYFASKPSASTSQSKQHDRFPPTLHKALAELDTATELDTADATSAAPPTNPADAFDFEDHDSSNSCHRHHLSASSEQSYHSARSDSESSGRRSTNTDLTDPTTADSLSGTDEVEGLDQAIVQLNASSRPSALANATAAASHPDKNAIGLHRNERLGSNGSDASLSGVPRPSTKTNTASLPTHHELPPVPDGTGQDDHLSIYQSVPLTKRGSQSSSRGHHRTPSRTKRRSLSSGGLSDHHPPMLGRKPVDYVSQLADLQPATFSTSIEQNLLHQLSALGLDVGQMVHSVVTDACDASGATWWMLLRKSKDRHSEQPDITSPIVQVIPAPGDHPAPINASAFSKAGQTVTPSSPAQFSPPPVPVKDPARRSEDKFRTQERPTTLEASSSENAGLAEQSIRRLQTVVSHEELDVSAAPALHTSTSELMMATKPATDRQSSVPASGPMPLAGLPASTVSLPNDRSLTSTPDSVSSRPKSQHRHTTAVASPAKLQHVALTTLEGSPTSEGSKARGNSQNDRPRSNSLSVRQFAQSVLGTKDRGSATSSPVRPPPEQVVVAGEALPLERAKSPTLFGRRNTVSNVKDSMVGRLSGPSTPKKTPVDMLDKPRKSTGKKSCETDLDRVKALERSADSASSSPSRSTTGQAVGVVSNAKVDSSVPSASQDSFSTMSVTPQGSEKSGHRGKAGSFFMSTVRTWLGGNEKPTRKSKTGKQASASHRGLGIDDGPMAAKSPTNSLSTSGSVSTLTYGTPSRSASVRRRSAHYQQTSATRRGGPRSPHLGTSSRRSSNGSSYQAHLELPPNSFQQSMNRPANMRRMSAGSITPTATLHGDYLNDVGGVSGASRHSRPSSSHSLAHSGAASRPGLHGKAGSTGSTSSAYRPGQASSVYSTGSGRRHPRPSQDGGTTVRRHRTYASSSGSPSRRNSFRHDSRPSSIKSRASSPGRAMSGLGELWAADAEADGDGGGTGARRSTRSTPRHSLEMRKTGEAFDSAAPHHQHHQHVVAQSIFVAHKSRSPYRPPSANPNLHGSLVRGSSQLSGRSNVSANSEDAGYVAPNSTLGLPATGTGAWRHSWGRPPPCWAGPVDPPPTSSYSKRSGAAGVEDDGRPKLRDVFANRDDDDWTDEEEEQTYSGGLGQMGTLSSAMSSSVGRVGSGIGASSSPYATRNLAALGSSGYSTQRAVNLDTANAPEIGLREAPFSSRYAGVRNMFQTATAGTPAFGSRSHHSVSLSLGNEFAPRLLSTTIHSPTVSAASLGGGLGCIGESADAHSVTVSSKPKPESSGTQTQAQQQQSSASASASASASQQQQSGGGSSGSGSRITASFHKPVQIIEEEEEDE

SEQ ID NO: 25637 - protein, 487 aa, Ustilago maydis 521
MPMIPPALRRTQAAATPTTSSPAASSSTTATLDSQSLCALPRIRVSASTLNSIVTPVKKITSETDVEAWKASAAYSIYTLFLQRVCEACVGKPTRLPTRSTDAPVTPVDKLVSLLWELDSWTQEIEPHEKPQRFGNLAFRDWGARLEERIDSLLSDLLPSRLHAFAVELRVYLLDSFGSFTRIDYGSGHELAFFAWLCFLYRLGFFDASEEQEQDETLADIQVEERIGLDIFPLYLMVVWKLQDRYGLEPAGSHGVWGLDDFQFLPYVIGAAQLRRQSGLRPNQVIGASSHASILQTQLATRTDPASLISTTLVLPASSLVGTQVEVPLPNLYLSSLLRIHVLKRGPFHEHSPLLNDIASSVPNWLKVYFGMLKMYAAECLAKKVVVQHFAFGGVGWVWTHQAHSELPRLATPSAPVAARRHLPLGGIQGNMTSMGVPTPRITRPPATPDSFDHPLRLPPRSTPSRPSTTPSVPPLAASTRPAPKPE

SEQ ID NO: 25638 - protein, 416 aa, Ustilago maydis 521
MSLSSKLGITDVDLKDKKVLIRVDFNVPMDGDKITNNQRIVAALPTVKYAIEQNAKAVVLMSHMGRPDGKPVPKYSLKPVAAEVSKLLNKDVEFLADCVGAETEKAVESATGGKIFLLENLRYHVEEEGKGTNEAGEKVKADPKKVEEFRASLTKLGDVYINDAFGTAHRAHSSMVGVQLPQRAAGFLMKKELEFFAKALESPERPFLAILGGAKVSDKIQLIDNMLDKVNSLIICGGMAFTFKKTLDNVKIGTSLFDEAGSHKVAELVEKAKKNNVELVFPVDYITADKFDKNAKTGSATDADGIPDEWMGLDAGEESRKKFRETILKAKTILWNGPAGVFEFDNFAGGSKAMLDACLEAEKNGSTVIVGGGDTATVVAKYGAEDGISHCSTGGGASLELLEGKTLPGVKELSEK

SEQ ID NO: 25639 - protein, 311 aa, Ustilago maydis 521
MPATKIAPSVLASDLGNLNCECQRMMDSGADWLHMDIMDGHFVPNIVMGAPVIASVSKAVPNIFMDCHMMVSDPGKWVKDISEAGGASYTFHLEATDDPMDVVRQIKATKMRAAVAINPGTPASEISDELGNAVDMILVMTVWPGAGGQKFMKECMPKVAELRARFPDLDVEVDGGVGPKTIDRCADAGANIIVAGTAIFNHSSPKDVIKFLRTRCDEAQERIKRERERIARGEPVDHEIKHYEDGRKSGWQSGAITPLSYPRVYMSASKREKLRRESQGALERGERPTLSSLQGMSGLSITPAASAVEGK

SEQ ID NO: 25640 - protein, 364 aa, Ustilago maydis 521
MASSNPQTVPCAYKTGRTLGQGTYAVVKEAVHIKTGQYYACKVISKKLMEGREHMVRNEIQALKRVSQGHRSIVTLVDYFETMNNLYLVTDLCVGGELFDRICERGNYYEKDAAHIVRTIVDAVVYLHDQGIVHRDLKPENLLFRDKTEESDLLIADFGLSRVVDDEKITVLSTTCGTPGYMAPEIFKKTGHGKPVDMWAIGVITYFLLCGYTPFDRDTTMEEMQAIINADYRFEPTQYWEDVSEDAKDFINKLLTIDPAKRLSAKEALQHRWLQEAAPTEGGAQPVASAEQKDLLPDIKSAFNAKRTFRKAVNGIRLINRLRTNEQQPNKEEIEKLRQTIREAEDESSNLDQVLLAQETRAAN

SEQ ID NO: 25641 - protein, 500 aa, Ustilago maydis 521
MVPPPPPPQAGSRVARPAARYRPGKAPVGAGATLDEYSDSDASDGGHAQDTKYEGTSQEGITDLSFGASAFTSAAGQQRRTAGIIVKDAIGLSSKTLDLRLRSTSTTAAAGEEENSSEYETDTDQEEAAAKPVFRKPEAAASAQQQTAQASDSSEYETDSEGESEESETKTEPLLKPIFVPKQARTTISTDAAADQHQLELDAEAKAEAEAAVRRKEAHDLAAAAIKRQLAEKEYQDTHQTDVDDTDGLDPEAEFQAWRERELARLRRDHEAILAKQRAQQEIDAFKSLPEAEKERLGRERAAQLRAEKKEQRGNPAFLQKYYHKGSFFQDMDILKRDYTEKTSKDVDISKLPKMMQVRGYGEKGRSKWTHLANEDTSKGAMRLDVLQGGSKGCFRCGGPHLRKDCPEAGGKAEGGSGANSSKVVSEASRNWGDKQANDDVNDYDQKDMRRGTSRSPHQQGSRRHDQDTSGPSSHNSQHRYDDDDDDDNARSKSKGFALS

SEQ ID NO: 25642 - protein, 368 aa, Ustilago maydis 521
MSTSADRTYEQQNDSALDALYSKVSSLRSVTIDIHNDSENQRAGLLSQTSDQFDQFGAQLQRTSNHFSRTIVNGARQHRLTLYIIGGFQAKVASQNDQRWCKWSLANARDCRYHTHRSDRDRSCAFPGLRCTAFDRQRRQQTCLLSLFSLGGCNAANKARHSSKHATHPQPLESLCCPECNTLQPLPSDIDFYKAMDLDLASVPSGGWQVDVSALKRAWRLKMAVTHPDRMVGRSDKEQQIGAQQSALINRAYETLLHPLSRAFYLLERHGACEPSESDSLEDPELLMEVMELRERLEEAGSEQEAAEVRADNAKLLEATVKKLNEAFGQTPPDLETAREASVQLRYWTNIEKAAREWSPGKRVELQH

SEQ ID NO: 25643 - protein, 1032 aa, Ustilago maydis 521
MSEQIQIDTGAFQRRVNKLLSCWKDSSADFEQLNQVDSLLVVMGGQNDDLIYSKTTAIHSWLLGYEFPSTVILFTKDSVTFVTSASKAVHLEPLKRSSTGFNLEILKRSKDEASNRALWDDLVSRIDAQGSKVGCLPKDKPIGKFADEWQSVFEKAQSSKDFKMIDVSASLSAVWATKDDDEIKAIRYASKMSSAVMSGYFENEMSTILDEGKKVTHEQLSERIEGKLDDTKLWKRVKGLEGADLSLADWCYTPIVQSGGEYDLKTSAVSSTKRLQGADGNGGVVIASMGIKYRNYCSNIGRTYLIDPHNSQQKMYAFLHEIQTQLADKHLRAGATCKEIYSKAVEIVRAKDEKLVASFVKNVGFGIGLEFRDSAYVLSAKNNRALQRDMVVNLSVGFQDLDDPNHKGEVYSLLLIDTLRINDNAPATFLTDRVRGTNDMSFFFKDDEEEEEEEERRSPAKPDGKVTPGGKVLRNKNRGAAHDDTAAEKMKLHQKELAKQKQEDGLARFAGEDGEGNASNEKVFKKFESYKRENLLPTKVADLKIMVDHRAQSIILPIYGYAVPFHINTLKNVSKSDEGEYTYLRLNFVTPGQIAGKKEDVPFDDPDATFVRSMSYRSSDSSRFTELFREITELRKSATKREAEEKELADVVEQDKLILTKSRAYTLPEVFPRPAMEGKRVPGDLTIHQNGLRFSSPLRPDQKIDLLFSNMKHLFFQPCDKELIVIVHIHLKSPIMIGKRKAKDIQFYREASDVQFDETGNRKRKYRSGDEDEIELEQEERRRRSQLNKEFKVFAERIAEASEGRVSVDVPYRELGFNGVPFRTNVLLQPTTDCLVHLTDPPFLVITLTDVEIVHLERVQFGLQSFDMVFVFSDFSRAPMHVTSIPTTSLDDVKQWLDSVDICVTEGAVNLNWGAIMKTVNEDPYDFFAEGGWGFLQSGSDDGGSSESESGSEFGSEMDDGQEETDEDSDSGSDFGDSAEDESGSEGFEDESEEGEDWDELERKAARADEKKRRQQGGSDDDEDSGKKGKRR

SEQ ID NO: 25644 - protein, 451 aa, Ustilago maydis 521
MASNFASNFDTLQLHAGQEVDPATNALAVPIYANSSFAFNDSAHGADLFGLRKFGNIYSRLMNPTNDVFEKRIAALEGGAAALATSSGQAAQGMVVMGLCGSGDNIVSSSYLYGGTYNAWANLFPRLGITTKFVKSESPEAYAAAIDAKTKAIYIESIANPKYIVHDIAALAKVAHDHGIPLIVDNTFGAGGYLVRPIEHGADVVVHSATKWIGGHGTTIGGVIIDSGKFDWSKSGKFPQFTEPSAGYHGLKFWDTFGPITFAIYLRVVILRDLGPCQNPFGSFLLLQGLETLSLRVGRIVENALALAQWLEAHPQVSWVSYPGLKSHPSHEIAKKYLQRGFGGVLSFGIKGDAATGSAFVDSLKLATNLANVGDAKTLIIHPASTTHQQLSDEDQLSSGVTKDLIRVSVGYEWIEDIKADFAQAFEKTSGVKGNVASGQTGPAPGLSGSV

SEQ ID NO: 25645 - protein, 493 aa, Ustilago maydis 521
MMNTKLKDLSLLEASDFLKAPDSLDTSDNESFDVMDPGSGRPICRLTASNLKDVDYAIQAASQAFPSYSAIPARERAMLLLNFDKLIRDNLDDLAWILVYETGKPLEEARAEVQYALTFSWWYVGETERVQGQVVKSATNPSLRYLTVWQPVGPVAILTPWNFPVALFVRKAVSALAAGCTIVAKPSPETPLSTLAVANLLHRAGFPSGSVNIVLASYRNTPAIGQALCTDLRIKKLSFTGSTRVGRLLMQQCAPTLKKLTLELGGLGAYLIFDDADIEAAATALVANKLRHAGQTCISAQRTFVHESIVDRVLKCIIELLDRVTLGHGAQPSTTLGPLQTERSQQKVREHIEDARAKGATVYTSKAAVPSSGYFVAPTLIVGCTAEMLVFQEESFGPLISLTSFATEQEAVALANKTDMGLTSYVFTKDSARLWRMFEQLKAGNVGLNVGGSTTAAEIPFGGVDQSGFGKEAGIGAGLKEYMVEKSATMSIA

SEQ ID NO: 25646 - protein, 501 aa, Ustilago maydis 521
MPHMPQGIVKGGKEDVKLNNQSLWQTKAYINGVWTDADNKSTLKVFNKATGAEIGQVPDMGANETAAAISAADEAFKSWSKTTAKHRHDLLMKLYYAHQENAEDLAKIIVAENGKALPEAKGEISYSNGFLEWFAEEATRTYGHTVPSPLPGVRNVVQMQPVGVAGLITPWNFPAAMITRKAAPALAAGCTVVVKAPAETPFSALAFAHLAEKVGFPKGTINVVTCAKGDNEIAVGKQLCENPAVRKISFTGSTRVGKILMSQSASTLKKLSMELGGNAPFIVFEDADLDKAVEGAIACKFRGSGQTCICANRIYVHASIKDEFLQKLAAKVNDFKVGYGMDKGTTHGPLVSEAGLSKVEEHVNDSVKKGAKVIVGGKRGEGLFFEPTIITDLPEDVPTDREETFGPLAAVYTFTSEQEVVRKANNVDVGLAGYFFSKDTARCWRVAEELQVGMVGINTGLISQHAVPFGGVHESGFGREGGRTGIDEYLVQKLMVFGGVN

SEQ ID NO: 25647 - protein, 328 aa, Ustilago maydis 521
MPQSHSFKYDPEFLQAAGPVLATFAQRPKPSLHDVETHRVNLDTALRAAGEAGPKYPVETTTHAITTRDGATINVIQVAPKQRRDNGPAVLHAHGGGMMSGTADAWVASGILPGLAAASGVDIFSVEYRPAPEHQLDGLVNDCYDALEWLSSNAASLGIDSNRIGVFGESAGGGIVAGVALQARDKALSPPLRKQILIYPMLDDRNLTPDERLSPTAIWSYENNLTGWSALLGKDIAGTDKVNELVKYAVPARVQDLSGLPDTYIDIGQLDIFIEETLEYVGRLHKAGVQVELNVYKGFPHAWELVGAQNTSVGKRIISERILALQSF

SEQ ID NO: 25648 - protein, 473 aa, Ustilago maydis 521
MSYQIPQKLWSQLHHFASFPQTGISLRQMVQFGRNPNPGTILQAGSFLAEELPIRLAHRVKELDELPHDLSKMPSIVKVKNWYAQSFEELVNFPKPRLSESVQKLLQNASKNAEPLPESKPNPSLLESATITDSDAGLAKALVPRNGNGSRSRALLEHRYYANLPDHQWPSEIEQYNEDFTKALEKIKKRHDAVVTTIAQGVLEYKRSRKRNTLQADVQSFLDRFYLSRIGIRILIGQHIALSRSSQRPSSKLIGSGSSSSSGDYSLSDQVARVKVDGNQEHEQYVGIICTNTNVGAMAHEAIENARFVCEEHYGLFKGPPVQLVCPPDLTFMYVPSHLNHMLFELLKNSLRAVVERYGVDQEDNFPPIKVIVVEGKEDITIKISDEGGGIPRSEMPLVWTYMYTTAQSEDLDPEFNASDFKAPMAGFGYGLPLARLYARYFGGDLKLISMEGYGTDVYVHLNRLSSSSEPLP

SEQ ID NO: 25649 - protein, 206 aa, Ustilago maydis 521
MVGTLVLTRHGQSEWNKLNLFTGWKDPALTELGREEALTGAKRVAATGIKFDVAFTSALQRAQTTLGIQLKEIGQEDIPIHKDQALNERDYGELSGLNKDDARKKWGEDQVHIWRRSYDIPPPGGESLKLTAERVWPYYHKEILPLVKQGKNVIVAAHGNSLRAMIKDIENISDDDIVGLELATGVPILYKLDSDGKVVSKEILQG

SEQ ID NO: 25650 - protein, 469 aa, Ustilago maydis 521
MEKEGDPSGGWRFAQCFGDKGEVEEITEADIISTVEFDHTGDYLATGDKGGRVVLFERNDSKKGCEYKFHTEFQSHEPEFDYLKSLEIEEKINKIKWCRRQNAAHFLLSTNDKTIKLWKVFEKTLKLVAENNHNDMGYGQTRDPDVHPSLLPVPTPVPGSGAGLRLPRLTPVDTIIAAVPRKIYANAHAYHINSISVNSDGETYISADDLRINLWNLNISDQSFNIVDIKPVNMEELTEVITAAEFHPIHCNQFVYSSSKGTIKLADMRDSALCDAHAKQFEEEEDPSTKSFFSEIISSISDVKFSRDGRYILSRDYLTLKIWDVNMENKPVKTIPIHDHLRSKLCDLYENDCIFDKFEALWGPDGKKVLTGSYNNYFHIFDKDDSSDVVLQADKSAFKAKRMAGAGKKGNKGGNSTLGAPGQINLDNPDFNKKILHASYHPRENTIAIAATNNLFIFSANNPAGIPMA

SEQ ID NO: 25651 - protein, 480 aa, Ustilago maydis 521
MSQTKIKYSDLEELLKNDNKVKVAGVDVDGIVRGKYVSKKKFLSAAKPDSDFGFCSVIFGWDMHDQVYPTELLVSNKANGYRDLSAKIDLDTYRRIPWEDNLPFFLIRYFNADGSALAVCPRNLLRSVTSKVEAQLGLLCMAGAEFEYFQFAETAQTLDDKRFVKLNALTPGNHGYSMLRTSLNKDYFLQLFDAAEAFGIDVEGHHTETGPGVYETALAYTEVTRMADMAVLYKLLAKSIGMQHGITPTFMAKPWANLAGCSGHIHVSLRDASTGKNVFGLSAEQIAAGGRADAEYDDVKYLSEIGEQFLAGLMTGLPDIMPLLCPTINSYKRLTTGEAYWAPNICSYGYDSRLASVRILGPPDVPDYGTRFEVRVPGADLNAPYAFAAVFALGLYGIQNKLKLPFAPMDASRSVKEQKLVYLPTSLEAATHRFMHAHSLARKVLGDTLVDHFGGTRLHEVSLFNQTVTNWEMERYMELI

SEQ ID NO: 25652 - protein, 288 aa, Ustilago maydis 521
MASTITARILRTASAPVSVSGLSLPRGSIRRFSLSQARGNSAADTQMRMLIVGSPGSGKGTQSSRLLKHYSFSVLSAGDVLRSHIQQKTEIGLKADAVIKSGSLMPDSVMMDLIGSEVCSLSSRDWLLDGFPRTLGQAQMLDSLLGSQAKPLSLVVNLDVPETVILDRILQRWTHLPSGRVYNLSYNPPKTPGKDDITGEPLSKRQDDNVETFGKRLKSFHKQTEPMLQHYREKSRSVLDIDCRVQQVGDTLQDGGELFVNLRGDESNQIWPHLLNIVQLRFPQLQKA

SEQ ID NO: 25653 - protein, 2761 aa, Ustilago maydis 521
MHPRQPSGPGSTDAMEIYDHLHTPKHEIDVADAFAAAMPSAIDPNQPSLRSVPEDAQLDTQQLSSLNASPLASSLQPSSQVAQQESPTSRRSDKLATSSYGLVQPGGRPDLASRRSSDVLKSLPGLPLALTNAEQTFLPATLNGGTSSAIPHPSAAIGSLVDHRAPPADTLPPQHIPRPLPGSATPSASASPSAMQTPPKKTPYDAIAAGVQTLAMPNSISVGPLSPPESDPHRSMMDSNRKSIDDIRRNHAARAAQRQSNNSSPIETRPGNGLVPDSAYTPTRAHAQYQSEFASSPDPTQRQRRAMASEPPRPASVLDTRAAQMQAVQRRQHDSRLGQGSSDTFDATDTLGSSRDTQLDRASQQHLQLRAAREQELERERLQHQQLQEQQREKEQQRQREKLKEREREKEREREREKERGERDRDRDRERRSRRLLGDYALGKTLGAGSMGKVKLGVKMGNGEKVAIKIIPRHTSMAAAQSPRAAVDENGKPQPPPPPPTASFLAKAAAKDQSKEIRTIREGSLQILLHHPYVCGMREMIIHTNHYYMVFEYVNGGQMLDYIISHGRLRERSARKFARQIGSALEYCHRNSIVHRDLKIENILISKTGNIKIIDFGLSNLFSPHSHLSTFCGSLYFAAPELLNAKVYTGPEVDVWSFGIVLYVLVCGKVPFDDQSMPALHAKIKRGQVEYPAWLSGECKHLLSRMLVTNPANRATLAEVLAHPWMVKGYEGVPDPHLPDRTPLRPHNIDQEVIKGMTGFEFGSPEAITAKLIEVLNSEAYQTSLYHWELKNLPASLTGLSTVSNSGSSIDSPGLNRPSTRGSFTATSGSDTVKSKAGSRRFSGIDFYKKKLTTNPLAAAFGSKDDSAVGSANGSSNGLGSGTGLLPFGKEPLDPTRGFHPLISIYFLVKEKMERERLYGHSFFASSNLSLNGPPVPSTGAVAGAGTGARAAAAGAMPTAADIPQEALRVPEVPHVSHRAYDPSRQQEAALASPAPPRPAAAMIPVPASPTPVFESREKSRPSGLMAGPPRARANADEMEAALREKCLPSPKDAGFAPGIGGMAPVPAASTPGMRQSFSVVPPGPEVAIGHNHRHSMMAPDISMAITNNHKRSVSLTARRPPGAAAAGRTPVGAMVEPSTPDAFSMDTRRMSTMSPARLPARASYIATPSKSEAGSAEPSSSPAATAHNTSSTLGYGATLARRFSSFMGRSPSQPLDTEARERKKQSRMSMPLGGLPQQQQQQHQQRRGSAHMPLSEVDEADTGTDVDAYDYDEVEEHLVTHDEDMPLGSGTTVRRSGTMGDMPASHANTRVSEASMGALSVGRAAGLSMSPKSTAAAKSGRRPSTGISPSTSMPLNVLDAGGAARQKEDALQQVSPSNARTGWMGPSTPGQAEVLPALVTRRRFGGGSNATGGQQNGSSASEGGSKPIFLKGLFSVQTTSTKPRTVIHASLVKVLDRIGIQYRELRGGYECVHLPSLDFSGSDSLGRGNARIPLETMAAAAAADAEASERSPTSEENNRQPKRKPSRLSFVSGRSKDKDRANRKEGSVAESIGALTGAGGTVRSRTPSLTSNAAFANADSTTLPPLPPKTPSKPSLLIRSPRQRADSMGAASMLGPSGSRDSNLMLDTTVAAGSGGDACALSPASAAGTVTARTMNAAQATELAVRFEIFVVKVPLLLGVNGLQFRRVGGNPWQYQMLAKRILQELKLPVLWNDRGSWIRMVAFHVWKHSRFTIHDSRFGVSKEAGEIHREWSRSRVGRIVCETRHAAVEPVLGTTFYHTFILTIKNAADDHKQVWQRYISPARIRNETCSISKMHKDYTTLHSVAPDKARIDNLCCDIERCCFTDTIHTQGSFHSSSSAHKTLLSDIPSISPRSLVKYLDSYVVGQTRAKKVLAVGVWNHYLRVASNQRMKHEAEARLEAQQQQQQQQQQQQQLSEEETETQLQRNCTIPDHGVSEAASRSLRLGKYKARSEEAAGPISNPTAMQEKDEAMASLQDSWRSQHQIEQERNAERARDPHGEATRSLMFGRSEREWLVNAGGPSAIIEDDSKVAIQNGSGYAGRIAPKFGDDLKPPEKPEKPEKPMKRVSAQTPAEEASWKLEQRKWSSTTAAQENALAEAASRMHNAVLSDYTRDFHQKDHVVEGTSRIGVFGADEPLYFSSNTMRGSQHAGVRGPGSQSQMSRTDETENKWESSQERAAYAAGIAQERTKRALRLARERLSTSRNSDHPSERASTVDVCHVSDCTPRTHDAGKETASTSNPGIAFLSTQPGSLPFFEKSNILLLGPSGSGKTLLLRTLAQALDVPFVHVDATPLTMAGYVGEDVESIIQRLLVEAGWDVDRAQRGIVCIDEIDKLRKTGLGGGGGGAGGAGGGGGKDVGGEGVQQALLRILEGTTIQIANKAGANAGASAAGTATAASKVPKSYPRQAATGDVNGVETAGGLGPWYNHRRAQADSADAKWNSNSLSSSQTQAASLSVDTSSILFVLSGAFVGIDHVIRNRLDRLSGDPTTLNVSSEDQNEKPHAATLSQCDLLSRLEPSDLEQYGMIPEFIGRVPVSVVLNPLSHQDLIRVMTEPRNSLVDQYTSLFKLNGIELHISRGAIEEVVHRAMGTCSAANSKALVRNSADRGGGGGGARSLRRIMEDVLLDAFYESYGSSSVKYILVDRQSVRDTSEVKLFSRGQKLDFEARVKTEAQDWCTRQQQQKQTRHQGANPAKAIRKDGGALGDMDAARTAMARHKARALIRSRLRRTNRLVDPVIYV

SEQ ID NO: 25654 - protein, 350 aa, Ustilago maydis 521
MSTSAAPGKLATTLGANVSSLASKVRSTSSTQQSLMQSVKRIIPPLSSAKHKGQAGRIGIVGGSRDYTGAPFFASMSSMRFGCDMSYTICTPEAGNVIKTYSPDLIVNRLLDASVEWSQVERSVDELFARFHAVVIGPGLGRDEFMQKCAKLCIGLARKHDMYLVVDADGLWLLQNEPDLIKGYKKAILTPNVAEFGRLCDTLGIDCKQEPDSAAKKLAQALEGPTVLEKGPVDRITNGKEVLYVDLQGGLKRCGGQGDVLAGCLGTLAGWAKIYQDENPTLPARSTTTDGDLIAEDRLLLLAGYAASVTARTCSRLAFAKSKRAMLADDLLPEVGRAYEELWGDVQALL

SEQ ID NO: 25655 - protein, 313 aa, Ustilago maydis 521
MEFVSQQFNSTVGSILNPTTTHLAADLYKNTDFASLNVLERAWANWYLYWGNPVLATGIMSFVLHELVYFGRAIPWIIIDSMPSMRKYKLQDEKIPTPEQQWKCTKYVLLSHFTVELPQIWSFHPICEYFGLATHDVPFPHWTKIAWQIGVFFLFEDAFHYWAHRALHWGPLYKHIHKKHHEYSAPFGLAAEYAHPLEVLILGMGTIGGPFALCAFTKDLHILTVYIWIVLRLFQAIDAHSGYDFPISLHNWVPFWAGADHHDYHHQAFVGCYSTSFRWWDHMLGTDLSYKRARARQAEKKREALQAAKAKAQ

SEQ ID NO: 25656 - protein, 429 aa, Ustilago maydis 521
MATQVHQLSLGPLTAHSFNADRTKVAVSPNSNVVHIYAQSSTGWTLEHTLAEHDKLVTGIDWAPSSNRIVTCSQDRNAYVWQLQPDSQTGAQVWKPTLVLLRLNRAATYVRWSPKEDKFAVASGARIISVCSFEEDNDWWVAKHIKRPLRSTVLSLDWHENNVLLAAGCADMKARVFSAYIKGVDAKPPASVWGERLPFGTVCGEFSTPSGGWVHGVSFSPSGDVLGFVGHDSSLTVVYPSGPEQPPAAVHVIRSPTLPYVTLTFINENQLIAAGHDCQPVLFQGDAETGWSIVKSLDAAGAAASKGAPPPPPPKAAGLAGPGRLNNEAFNRFKSADSRGGASSPAVAAGAGASIAGALGAVAGASVGADGELHTTHQNTITSVRPFSGAKNAIDHISSSGVDGRLCIFAVAHGTPVAGIQKGLSSLQL

SEQ ID NO: 25657 - protein, 425 aa, Ustilago maydis 521
MPFHNPLAKQPDSYVKKKEYDFKKTLGEGTFGIVRQATWKAADPPINVAVKVISKRILRGHDEIVKDEMNVLKGLDQPHVVKFLDWFESKDKYYLVFEEATGGELFERILSRGRFTELDACRTIRAVLSAIQYLHHHNIVHRDIKPENILYRTKAEDANVVLVDFGIAAHMKDDNEVLTSVCGSFGYAAPEILAKKGHGKAVDMWSLGVITYTMLCGYTPFRSDDAAALAAETQRGKVEFHDRYWKNVSNEAKDFVKACLTVDPKKRLTADQGMSHPWLTEHSEETQGVHDISAGLRENYRKRWKSAIAAVRASTKFRTFAQLASESRSGSQASLQTSDSSTAFADDPGKISPPTKRELYSESEDEQDGEDNQWFDTEDGSAARGNDATLADAASSQSENEPGWVEKLENKLDDLHLHSSSKSSE

SEQ ID NO: 25658 - protein, 493 aa, Ustilago maydis 521
MLRARSGAQMLRRRFGSVRNPNVRTLASTSHRSEKRYYPPPEPFVSSVGDSISIESSPFSTFGASPDLLTHYLSLQPAPLTLRQLMAQGGKPGQALTPERLVLSAQHTHRELPIRLARRVGGFRALPFIVGSNPFISRIARLYASSFETLVKFGQIQTQEDNQRFTDVIEDLVSAHAQNIPTLARGFQESRKYMDARQISAFLDAAIHSRIAIRMIAEQHLALSATSNDSGHLAPRSTNHASHHDSYHESAHYRLDPDLPAEGTSKQGHHEYGSPTAVGIIETQLSPARMTRMCAAFVRDLCEGTLGAAPELILEGDLDVTYTGVPVHLEYVMTELLKNSYRATTENYFRSQASGSMPPVIVTIAQSANHVSLRIRDQGAGISPLNLPHVFSYAFTTAGSGSKLEDAEETGGGPYAMQAVGGTGGDALAEMGKMGLASGLGTLAGLGYGLPMARIYAEYWKNGSALDLVSLYGHGCDTFVKLPRHIELSNTVI

SEQ ID NO: 25659 - protein, 402 aa, Ustilago maydis 521
MMDDLTEASSDYAANSWVTWFLSTKGNEYFCEVDEDYILDRFNLTGLNAEVQHYPHALDLITDSLEGDLSESIRDSVEAQAKLLYGLVHARYIITTRGLAKMLEKYKRADFGRCPRVLCYQQPLLPVGLSDNPFQKAVKLFCPRCEDIYSPKSSRHGTIDGAFFGSTFPHMLFMVYPNVLPSKSPTAQSPFLLTSSLHHRLDARSHAEHADVDDSIMSVPSGAGGTGGVANGSSLSGVASSSSAVAGASASAAAGAPGSNAAPANSTAAAAAKVERYRPRIFGFPVHETSKLQKWQDKMRDQQIERLEKVEAAGGIATPGAAAFFRRAAPVPTTASAEPTSAPAPAPAAAPAPPTSALAPAPVVPTSTSTASSPQTAASKSMSASAVTTSTPLQSVPTSARS

SEQ ID NO: 25660 - protein, 313 aa, Ustilago maydis 521
MTKGETIKCKAAVAWEAGKPMSIEEVEVEPPRAGEVRVQVTHTGLCHTDAYTLSGSDPEGAFPAILGHEGAGIVESVGEGVDHVKEGDSVILLYTAECRQCKFCKSGKTNLCQAVRATQGQGVMPDKTKRFSCRGKQLFHFMGCSTFSQYTVVSQYSLVAIDPKAPRDKTCLLGCGVTTGWGAATHTAKVEKGSTVAVFGIGCVGLAVITGAVDAGAGRIIAIDTNDQKESWAKKFGATEFINPTKLGDKDIVSHLVDITDGGLDYTFDCTGNVKVMRSALEACHKGWGNRYAPLPTGYRSQVARLRFRRCQG

SEQ ID NO: 25661 - protein, 300 aa, Ustilago maydis 521
MAGTSRNVRVLVTGANGFVGSHIVSLLLSRGYVVNATVRRQTASEKLIATFACDRLHVFVIPDLTSEQALDEAIRGCKYVVHVASTVPSKEQASGIDIDSAISSIESVMNSAVAHASEKVVLTSSMSTHLDVKAPILNESTWYTPDRSSTKLMVQYMSSKTLVERRAWELSSTLKLPLTTVAPVYIGGPTIIHEQDPKSSVSNQDLLRCIEDESRSRIPGWIDVRTVAHLHLHAIEDHSLNGRRILACTHNRGVVPMDCSLMNSLLAKDSAALIDFDRTKRDLLEQIDAFNSGQTRRVVA

SEQ ID NO: 25662 - protein, 364 aa, Ustilago maydis 521
MPAIQPKSHVLVTGGSGFIAIWTIYQLLERGHNVRATVRSDDKGNYLKHVFEKYGDKLSYTIAEDLEKEGAFDDAVQGVDAVLHTASPFHYNIEGDPKRTLINPAVNGTRNVLSSIQKHGSNVKRVVITSSYAAILDSTRRGTIVYTEEDWNISSVENVEKKGKDQDASDAYRASKTMAERAAWQFVEENKPSWDLVTINPPLVFGPIIHQVNSPEKLNTSVGFVWGLLHGSKTEDDLLTPSGSCVDVRDVAYAHVESLVRDDAGGNRFAVSLNSFVWQDVVDIIHNDSSVPVEWKKQVPTGKQGTGSSVKQNRLDGSKATRQLGLNYIQLKDLVQDMVASLADAEKRRWSGVPSANILSRTKH

SEQ ID NO: 25663 - protein, 320 aa, Ustilago maydis 521
MPQSHSFKYDPEFLQAAGPVLATFAQRPKPSLHDVETHRVNLDTALRAAGEAGPKYPVETTTHAITTRDGATINRRDNGPAVIHAHGGGMMSGTADAWVASGILPGLAAASGVDIFSVEYRPAPEHQLDGLVNDCYDALEWLSSNSASLGIDSNRIGVFGESAGGGIVAGVALQARDKALSPPLRKQILIYPMLDDRNLTPDERLSPTAIWSYENNLTGWSALLGKDIAGTDKVNELVKYAVPARVQDLSGLPDTYIDIGQLDIFIEETLEYVNRLHKAGVQVDLNVYKGFPHAWELVGAQNTSVGKRIMSERILALQSF

SEQ ID NO: 25664 - protein, 486 aa, Kineococcus radiotolerans SRS30216
MSQENGRGPDRADAEERQRTTTKVVLISVVAAIGGFLFGFDTAVVNGAVDAVAEEFRLAAGLKGFAVSCALLGAAVGAWFAGRLADRFGRKAVMVIAGALFAVSAVGSAFAFGVWDLILWRVVGGVGVGIASVIAPTYIAEVAPAHIRGRLASLQQLAITVGIFAALLSDAFIANTAGGASETTWFGWDAWRWMFVVGVIPSLVWALLALQIPESPRYLIAQGKTQRAGEVLREVLGTRSLEAVQRKVADIKNSMRREDEPSLRDLRGPRFGLLPIVWVGILLSVLQQGIGINVIFYYSTTLWKAVGFDESDAFTTSVITSVTNVVVTFIAIATVDRIGRKPLLTVGSAGMFLSLTVMAIAFSQASGSGQDVSLPQPWGTIGVIAANVYVISFGATWGPVVWVLLGEMFPNRIRAAGLAVAAAAQWLANFAISTSFPSLAKLGLQYAYGLYAVIALLSFVFVRRAVQETKGRELEEIGAETTSTAP

SEQ ID NO: 25665 - protein, 337 aa, Rubrobacter xylanophilus DSM 9941
MGREGLPLEDEGWYRENGVRLLLSTRAAALDPARRTVRVAGGEEIPYESCVLATGAEPARLSVPGADDPGIALMRRVPDADRLRGWTSPGSRVAVVGSGFIGCEAAASLALRGRRVTVVSMEELPQARRLGEEVGRRILSWLEGYGVEVLPGREVEEISRRSGGPYALRTGEGEEIPADAVLFGAGIQPSSGLAEEAGLRTEGGRIVTDSSMRASAPGVLAAGDVALAYNEAVGRPLAVEHWGDALEQGRIAGAAAAGRQVRWDSVPGFWSTIGEKTLKYWAWGDGWDALAFEEGDDGSFVARYGREGALVGVLAHGRDEVYEEASDRIRAGAPFPG

SEQ ID NO: 25666 - protein, 286 aa, Rubrobacter xylanophilus DSM 9941
DLYSPELAGAPGGVGQVRECAARLMRLAKAEGIAVVLVGHVTKEGSIAGPRVLEHMVDTVLQFEGDRFQAFRILRALKNRFGSTNEVGVFEMTSRGMEEVEDPSAFFLSRREAEVPPGVATVCLLEGTRPMLVEIESLVAPSPLAVPRRVARGLDGGRVNMLCAVLSRRAGLALGSQDVYVNVTGGVRVEEPAADLGAALAIASALRDRPLERGTACFGEVGLTGDVRFVPGAGRRLRELIKLGFDRIIIPEGSSGGAPGGGAASGRGVNVVEVRTLEEAVAVALL

SEQ ID NO: 25667 - protein, 438 aa, Rubrobacter xylanophilus DSM 9941
MLRAARIRTEIPGPRSRALTERRRRAISAGLGTALPIWVAEAHGALVTDVDGNTFIDFGGGIGVLNAGHTHPRVVEAVREQVGRLTHACYYVSQYEPYLELAEKLNELVPGNFEKRSIFVNSGAEAVENAIKISRSYTRRPAILAFENAFHGRTMLGMSLTGKADPYRRGFGPFVPEVYRVPAPYAYRMPKEESWFDAFRRSLVSVDVSSVAAVIVEPVLGEGGFIPFPPEDLRRLREWCTENGAVMVVDEVQTGFGRTGKMFAIEHSGVEPDIVTTAKSLGGGMPIAGVTGRAEIMDSVHAGGLGTTYGGNPAACAAALAVIRAFEEENLLERSVRVGERVMEELRAIQRRHPDFVGDVRGLGAMAAMELVTDARSKTPDPARTKGVVEHALQEGLMLLTAGAYGNVIRTLMPLVITDSELEEGLSILSRAVDAAAA

SEQ ID NO: 25668 - protein, 494 aa, Rubrobacter xylanophilus DSM 9941
MNVEREGRVETRMIERLFVGGEWVGEASTGRTFEVENPASGRVIAVLPDGGGGEMRRAVEAAVAAQPGWEEATAYERASVLWRAAGLMRERAEHLARVMTLEQGKPLAESRGEISYAASFVEWFAEEGKRVYGESVPSSFRDKRILVLKRPVGVAAAITPWNFPAAMITRKLAPALAAGCAMVVKPSELTPLSALELAKIFEEAGLPRGLLSVVVGTDPGDITAPLMEDGRVRKLSFTGSTEVGKHLMRQAAKTMKRLSLELGGHAPFIVFEDADLEAAVEGALVSKMRNMGQTCVCANRIFVQKSVLEPFAERLVERMGRMKVGDGLQEGVSVGPLIEERALRKVERHVEDARQKGARVLLGGSRLSSGGGYFFAPTVLCGADESMLVFREETFGPVAALASFESEQEVVERANATPYGLAGYYYTRDVGRVMRLAEKLRYGILGANDGLPSTAQAPFGGLKESGFGREGGHWGIEEYLDVKYLSLGGLGSSS

SEQ ID NO: 25669 - protein, 321 aa, Rubrobacter xylanophilus DSM 9941
MDVLQGSRHRGLSESVLEAIGDTPLIEVEEGIYAKLEYLNPSGSIKARIAKYIVEKAEREGLLLPGHTIVEATSGNTGNAFSMVAAIKGYRMVVLMPEGLSTERVAISRAFGAHIEHVGEFYVTEALKRARELGKKEGYFCPAQFDSEWNVEENREWLGKEILGQLEEGGVGAPDALVMGVGTGGTLIGVGQAFREKNAEAKLIAVEPEESCTLLCGESGVHKIEGISDGFVPGIYERHAERLGVDEVYAVGSEEALGAMRWLARRRGLFVGPSSGANLVAARRLKEAHPELKSIVTLFCDEGEKYISEHFPAGRRGDATK

SEQ ID NO: 25670 - protein, 512 aa, Rubrobacter xylanophilus DSM 9941
MHENLPPARLVEASVRRREGMLAENGALVCLTGKRTGRSPKDRFIVENGLTRGPVDWGPVNKPFPGERFERLLAKASAYLENLEEVYVVDAYAGADPRYRLNVQVVCEYAWQALFTRQLFRRPSREELDAFEPDWTVISVPGLLTDPEEDGTESETFVGIDFGRRVVLICGTRYAGEIKKSIFSVLNFVLPTEHGVFPMHCSANVGPGGDVALFFGLSGTGKTTLSSDPERYLIGDDEHGWSDEGIFNFEGGCYAKCIDLSREKEPQIYDAIRFGAVLENVVVDRITRRVDYSDASLTENTRAAYPLEYIEGAVDSGRAGHPAAVLFLTADAFGVLPPISVLSPEQAAYYFLSGYTAKLAGTEADMEADVEATFSACFGAPFLPLPATTYAAMLSEKLREHGSRCYLINTGWSGGPYGVGERVDIAATRQMVRAVIAGNIDESKTYTDPFFGLQVPLEVPGVPSGILNPRETWADRAAYDDQAAKLADLFRENFKKFEDGVPEGVRKAGPNV

SEQ ID NO: 25671 - protein, 247 aa, Rubrobacter xylanophilus DSM 9941
MESYIAEFIGTMVLILFGDGVVAAVLLRASKAENSGWIVITFGWGMAVAMAVYAVGWVSGAHINPAVTVALAVVGQFDWAQVPGYIIAQFLGAFVGAVLVWLAYLNHWEGTADPVLKRGVFCTIPQIRNTPANFVTEVIGTAALLFGILAILGSGAQIQGGQSELFTAGLFPLLVGLLVFAIGLSLGGPTGYAINPARDLGPRVAHAVLPIPGKGDSDWSYSWIPVVAPLVGGIIGAVLYTVLGFGD

SEQ ID NO: 25672 - protein, 436 aa, Rubrobacter xylanophilus DSM 9941
MQEARLRLARDRSARLMERAVRRMPGGVNSPVRAFRSVGGDPLFMERGEGPRIFDADGNAYIDYVMSYGPLLLGHAPPEVVGAVERAARRGTTFGAPTRLEVELAELVCEAVPSVEVVRMVNSGTEATMSAVRLARGYTGREKILKFDGNYHGHGDALLVSAGSGVATLGLPDSPGVTPGAARDTAVLPYNDLEAVRELFEERGEEFAAVILEPVAGNMGCIPPEEGFLEGLREITAACGALLIFDEVMTGFRVSRGGAQERYGVVPDLTCLGKVIGGGLPVGAYGGRREIMERVAPAGPVYQAGTLSGNPLAMSAGLATLRRTGEPGFYERLEELGARWERGMREAASGSAVPVTVNRVGSMVSLFFASGPVRDFASAAASDAELFKDFFWHMLSRGVYLAPSQYEAGFISLAHSEEEIDRTVEAAAEWFAGRRA

SEQ ID NO: 25673 - protein, 501 aa, Rubrobacter xylanophilus DSM 9941
MGIMRTKSIEQSIRDTDHPDFRLRKALGALDLTLFGIGVIIGTGIFVLTGVAAATNAGPAIALSFVVAGVACALAALCYAEFASTVPVAGSAYTFSYAALGEFLAWIIGWDLVLEFIVGASAVSVGWSGYFNSVLQSFFGITLPESLLAAPGDGGVVNLPAVGIVVLLVIVLVLGITLSSRVNQVITTIKLLVVLFFIVYGIWFVNPENWSPFLPPREPAPAGEGFSFSQTTLWELLFGSAGSFGFTGMITGASIVFFAYIGFDIVATTAEETRNPQRDLPIGILGSLAICTVLYVLVSLIMTGLVPYQQLNTASPMATALSRLGLDWAAGLVSIGAICGLTTVTMILMLGQSRVAFAMSRDRLLPPWFAKVHPRFRTPYRITITTGVVVALLAGFVPLGTLAELVNIGTLFAFVLVSIGVIVLRRTRPDLHRAFRTPLVPVVPILAALVCIYLMLNLAVGTWIRFLVWMAIGLVLYFVYSMHHSRLAVGEDIEEVAEEAR

SEQ ID NO: 25674 - protein, 477 aa, Rubrobacter xylanophilus DSM 9941
MRKTFVLAAASALLTLALPALGLAQEEAPPGNRELSLALDTVWVLVAAVLVLFMQAGFAMLEVGFSRMKNVGSVVAKILANLAIAAVLFWAVGFAVAFGTGNALFGTQGWFLAVPEGAVDEVYAGLAWTQVPLSAKFLFQVAFCAVSLAIVWGTMLERTKFAVYLVFAVVFAGIIYPMVGHWVWGGGWLTELGMQDFAGSTVVHLSGAMAALAGTLLLGPRLGKYDDEGRPVTIPGHNMPLAVLGVLILWIGWYGFNPGSTMAATPQIADIALTTTLAAACGVLGAMAMSYLYRRHVDVGMAGNGAIAALVAITAPCAFVAPWASAIIGFVAGVIMYATLLFVDRIGVDDPLGAIAAHGMGGVWGTLSAGLFTTPELAAVGRPGLLYGGGLYQLGVQALGILAAGGFVFLASLLVFAALKATIGLRVKPEQELNGLDVSEHGVYGYAGFPEHLIATDHPVNGNGGGAPRNAPAEGAA

SEQ ID NO: 25675 - protein, 473 aa, Rubrobacter xylanophilus DSM 9941
MRVADKFDLVIIGGGNAGYIPAIRASQLGMSVALVERREGGHLGGTCLNLGCIPTKALLQTAAMLHDARNGEEFGVKVGDVRFDYRQAAKRRDQVVNQLRRGVAGLMKKNKVSVYNGTGSFIQPRRIKVELNDGGTEELEAENVLIATGSAVNTLPGLEFDGEKVISSDDVVTENDGYPESVIILGSGAVGVEFASMYNDFGTEVTIVEILDRLVPLEDPEVSAELEKQFEGRGIRCLTGTKADPGSLDKSGDGVKIKVAGEGGEETLEAEKLLVAVGRKTVTEELNLEATSVKTDDRGIIQVDEFYRTDEPGVYAAGDVIGGYWLAHAAGHEGIVAVEHMAGKDPMPLDQNLIPRVTFCRPEIASFGLSEEQAREEGYEIKVGKFPFRAIGKALIEGEPNGFLKVVADAETDLILGMHAIGPHVTELIAEGVFAKLVEGTPEEIGMAVHAHPSLAEIVGEAAMAVDGHAIHF

SEQ ID NO: 25676 - protein, 479 aa, Rubrobacter xylanophilus DSM 9941
METGVKSLKNFIGGRFVEPASGELYDVVNPSTGEVFARAPMSGEEDVDRAFGAAAKAFEEWRESTPSERQRALLRIADRIEERAEELVRAECENTGKPYALTLEDEIPPMADQIRFFAGAARCLEGKSAGEYMRGMTSYIRREPVGVCAQVTPWNYPMMMAVWKFAPAVAAGNTVVLKPSDTTPVSTLLLAEIAAEFLPEGVFNVVCGDRDTGRLLVRHEVPQMVAITGSVRAGMEVAEAAAKDLKRVHLELGGKAPVIVFDDADPEAAAEAIAEAGYFNAGQDCTAATRVLAAPGVHDDFVAALTERARSTRTGPPDDEEAYYGPLNNENQLRRVSGIIERLPDHAEVVAGGGRVGERGYFYAPTVVSGLRQDDEASQTEIFGPVITVQPFSDEDEAVRWANGVRYGLASSVWTRDHGRAMRVSRRLDFGCVWINTHIPLVAEMPHGGFKHSGYGKDLSMYGLEDYTRIKHVMSNIEA

SEQ ID NO: 25677 - protein, 378 aa, Rubrobacter xylanophilus DSM 9941
MMERQNTAERRQGAREEGRPVAVRLQNVTKRFGDFTAVEDLSLDIHEGEFFSLLGPSGCGKTTTLRMIAGFEEPTEGEVVVAGRSMRGVPPYRRPVNTVFQSYALFPHLDVFENVAFGLRRAGVPKGEISRRVGEACALVKLSGFERRKPSRLSGGQQQRVALARALVNRPKVLLLDEPLGALDLKLRKQMQLELKNLQHEVGITFIYVTHDQEEALTMSDRIAVMNEGRVQQVADPATLYELPANRFVADFIGQTNILEGTVEAVEGERAVIRTAGGLRLEAVAPNGFRPAVGEAVEAAVRPEKLRVGEAGDNVVAAEVAEVVYLGSSTQYILRAPDGGRLVAHRQNDREAAALRPGEAVSVAWDARHCLILGGKRG

SEQ ID NO: 25678 - protein, 436 aa, Rubrobacter xylanophilus DSM 9941
MENLMLHFTPFSEDWGRLPVIVSGEGCYVTDAEGNRYIDGLAGLFTTQVGHGRSELAEAASRQMRELGFFPNWSFQHPRSLELAARLAELAPGDLSTSFFVSSGSEAVETVIKLARQYHKANGEPTRYKIISRKIAYHGTTLGALSVTGLPSFKAPFEPLLQGFMHVPNTQQDPEGAAEAIEEAIEFGPPETVAAVVLEPVQNAGGCLVPPEGYWRRVREICDRHGVLLVSDAVICAFGRLGEWFGIERFGVVPDMTSFAKGITSGYLPMGGVVVSEKVRDTLRENAPMFFHGSTFGGHPVSAAVALENINIIERERLLENVHDLEGHFQSELRRMAEGHPIVKDVRGMGFFWAVEVRPERADGTPLAGDEYERYFKGVVSRKLLEGGLICRFDDKDEPVIQYSPALVADREVISRIAEITDEALTELERELGYRS

SEQ ID NO: 25679 - protein, 317 aa, Rubrobacter xylanophilus DSM 9941
MTRYEPEDSFVTPRFSGVRTFMRLPHNRDLDNADAAVVGAPFDTGATFRVGARFGPEAIRSVSHLLRRHNPSLGVTLFDHLSVIDYGDVPVVPGYIEESYARIEEGLAPLHEAGVFPVVLGGDHSIALPELRAAARAHGPLALVQFDSHPDTWDAYFGMRHTHGTPFRRAVEEGLLDPSRSVQVGMRGSIYDERDWDDAREMGFDLVPTDEVRELGIPAVIERIRERVGEAKAYVSFDVDFVDPAYAPGTGTPEIGGFTSREAQELVRGLAGLEIVGCDVVEVAPAYDSPGQITALLAANIAHELLSLHALRKKSLG

SEQ ID NO: 25680 - protein, 297 aa, Rubrobacter xylanophilus DSM 9941
MAEKVGFIGLGIMGRPMAENLIRAGYSLTVHNRTHQKAEEFAQQTGARTAKSPKEVAGQSDIIITMLPDSPDVESVVAGEGGVLEGMREGSLLIDMSTISPVVARQLAAKARERGASMLDAPVSGGDVGAREGTLSIMVGGSEEDFGRARPLFEVMGKTVTHVGPSGAGQIVKAANQIVVGLTIEAVCEALVLGLRGGVEPQKIFEVLCGGLAANRVMEVKREKFLSRDFRPGFRAELHHKDLGIALAAGREYGVALPVTAVVDQLLLAMRRKGWGGEDHSALLRIIEDLSGDGAGE

SEQ ID NO: 25681 - protein, 394 aa, Rubrobacter xylanophilus DSM 9941
MMETYKRLGIAPVEGRGSWLIDERGDRYLDFIAGIATNSLGHGHPALVEAIKEQAEKLIHCSNLYRVPLQEEVARMLTEATDFDRVFFCNSGTESVEAAIKLARRHAHNTSGPHKHEVLTFTGSFHGRTYGGLTATAQPALHEGFAPMVGGFAYAPYGDLEAASSRIGPQTAAVLVEPIQGESGVNEPPEGFLEGLRELCDRHGALLIFDEVQTGVGRTGHLYAYQGIGVVPDAITSAKGLGGGVPVGAVLAKEEHAAALTPGSHGSTFGGNPLAMAAARAVLRVVREPSFLEEVRTKGAILKNGLRELAARVPGAQVRGRGLLLGLELGPELAPEVFRRCLQEKVLVNLVGGKTLRMAPPLTVSRTEVRYALCTFRGGVEALMEAAPAEAVVA

SEQ ID NO: 25682 - protein, 326 aa, Rubrobacter xylanophilus DSM 9941
MVWMQGQSLLHRGLSESVLEAIGDTPLIEVEEGIYAKLEYLNPSGSIKARIAKYIVEKAEREGLLLPGHTIVEATSGNTGNAFSMVAAIKGYRMVVLMPEGLSTERVAISRAFGAHIEHVGEFYVTEALKRARELGKKEGYFCPAQFDSEWNVEENREWLGKEILGQLEEGGVGAPDALVMGVGTGGTLIGVGQAFREKNAEAKLIAVEPEESCTLLCGESGVHKIEGISDGFVPGIYERHAERLGVDEVYAVGSEEALGAMRWLARRRGLFVGPSSGANLVAARRLKEAHPELKSIVTLFCDEGEKYISEHFAGEGRTLETGERA

SEQ ID NO: 25683 - protein, 430 aa, Rubrobacter xylanophilus DSM 9941
MDAAVDRAKRAFPGWRDVPPAERARLLGRLAEALDAEREDLARTESLNVGKPLSAARAEMKMVVDTFAYYAGAPERLLGETIPVAGGVDMTFREPLGVVGLIVPWNFPLQITSWKVAPALAAGNTVVLKPAELTPLTALKLERIAGEAGIPEGVLNVVVGPGEIVGKRLVEHPEVAKIAFTGSTEVGRKIMAGAAGTVKRVTLELGGKSASIVFADADLEKAAAAAPLAVFDNAGQDCCARSRILVERGAFERFMSLLEPAVKELRVGDPQDETTQMGPLISASHREKVASYVTEEAPVAIRGEAPDGKGFWYPPTVLAPVSNKDRVAREEIFGPVAAVIPFEDEEEAVRLANDTIYGLSGSVWTRDVARALRVARRVETGTLSINSNTSVRVSTPFGGFKQSGVGRELGPHALEHYTEVKNVFVATEEG

SEQ ID NO: 25684 - protein, 469 aa, Rubrobacter xylanophilus DSM 9941
MEYEHVGAEYLERRQLKKGAAGWVLLAGLGVAYVISGDFAGWNFGLAQGGWGGLLIATLLMATMYTTMVLALAELSSAIPVAGAGYGFARRAMGPWGGFLTGTAILIEYAIAPAAIATFIGAYVESLVGFGGPLVYLFFYALFVGIHLYGVGEALKLMFAITAVAALALVVFVIGMIPQFDAANLFDIAPADAAGASEFLPFGYLGIWAALPYAIWFFLAIEGVPLAAEETRDPATDMPKGLIGGMLVLLVFAALILIFGPGGAGSAAIQDSGNPLVEAVQAAYGGPNLLSGFINVVGLAGLVASFFSIIFAYSRQIFALSRAGYLPRWLSVTNRRRVPWVALVVPGVIGFLLSLSGQGDLLILIAVFGATISYVLMMLSHIILRYKEPEMERPYRTPGGVLTSGVALMLACAAVIAGFLVDPRVLVGTAIIYAILIAYFAFYSRHHLVAEAPEEEFEAVQRAEAELSG

SEQ ID NO: 25685 - protein, 371 aa, Rubrobacter xylanophilus DSM 9941
MYSTDQPAGAGERGISELRAGIDEIDAEIVRLLDRRARLARKIGEFKRRNGLEAYVPARERAVLDRVLRISEGDFPRRGLETVFREIISSSISLEERMKVAYLGPETTFTHEAALRAFGASVELEPQATVSDVFARVERGEAQHGVVPLENSMEGAVTHTLDELMNSPLKICGEVYLPIMQNLLSREDSLEKVRVVCSHPMALAQSAPWLRKNLPAARLQEVESTGEAARMAASRPGFAAVGSALAAESYGLKVLARGIQDARTNTTRFIVLGRKWAGRTGRDKTSVVFSVKDRPGVLRDALSAFAEEGINLTRIESRPSRKRAWTYVFFADFQGHPEEERVGRALEALEEHCPYVVLIGAYPEARDPEGL

SEQ ID NO: 25686 - protein, 316 aa, Rubrobacter xylanophilus DSM 9941
MAAPGLSESVLEAIGDTPLIEVEEGIYAKLEYLNPSGSIKARIARYIVEKAEREGLLLPGHTIVEATSGNTGNAFSMVAAIKGYRMVVLMPEGLSTERVAISRAFGAHIEHVGEFYVTEALKRARELGKKEGYFCPAQFDSEWNVEENREWLGKEILGQLEEGGVGAPDALVMGVGTGGTLIGVGQAFREKNAEAKLIAVEPEESCTLLCGESGVHKIEGISDGFVPGIYERHAERLGVDEVYAVGSEEALGAMRWLARRRGLFVGPSSGANLVAARRLKEAHPELKSIVTLFCDEGEKYISEHFPATREVEAEAR

SEQ ID NO: 25687 - protein, 225 aa, Rubrobacter xylanophilus DSM 9941
MAFFGKLGDRVVGAPSILSADFAHLADEVERARRGGAELVHFDVMDNHFVPNLTVGPAVAASLVEATELPVDAHLQVENPDSLIPAFIEAGVASISVQVEAATHLHRTLKLIKSGGCEAGVALNPTTPPELLGWALPYLDYVLVMSVNPGFGGQRFIPEMVQKVRRIREMAPVPVEVDGGITAETAPLMVKAGAQVLVAGSAVYRGDPAAEMRRIIEAGRAARGR

SEQ ID NO: 25688 - protein, 493 aa, Rubrobacter xylanophilus DSM 9941
MAGFARRLRDLGFEIISTGGTARALREAGIPVVPVSEVTGEPEILGGRVKTLHPRIHGGILADREREEHLRQLEERGIDPLDLVCIDLYPFERAVAGGAGEEEAIEQIDIGGPAMLRAAAKNFRSVVVVPGPEFYGEVLSGLESGGVPEETRRRLAAAAFRRTALYDAAIARWMAGEGELPEALVRGYRRKIPLRYGENPHQRAAYYAEEGAPAHLLSGARRLQGKQLSFNNLYDVDAARSLLATLGEEPAAVIVKHANPCGAAVGKSAGEAYLKALDSDRISAFGGIVALNREVDGELAREISGVFTEVLVAPGFAAEAREVFAEREAMILLEAGPLEPPSLSAKYVTGGMLLQETDAVAGEDASSYKTVAGEPPSGEALRNLLLAWRVAARVKSNAIVLVRDGATVGIGAGQMSRVDAARIAVEKAGGRSRGAVAASDAFFPFADGVEALADAGVSAVIQPGGSRRDAEVIAAAERRGMTMVFTGRRHFLH

SEQ ID NO: 25689 - protein, 448 aa, Rubrobacter xylanophilus DSM 9941
MAERFDAVVLGMGPGGEVAASRLISGGKRVAVVEKELIGGECAYWACIPSKTLLRPPEVRGEARRAFGTGVPELEMEAIFDYRDYMIRNLDDAAQVEGYERQGATVVKGAGKIVGPGKVEADGETIEAGHIVVATGSAPNVPPVEGLDEITVWTNREVTTSREVPRRALIVGGGPNGIEAAQWLSRFGSEVTIVQSADRLIDREDPRVGELIRGALEGEGIRVLTGRKAARARRDGEGAVVELDDGAEVGTDVVVIAAGRRPRTEGLGLETVGIEPDGGAIPVDDRCRAAEGVWAIGDATGVALFTHVAKYQGRVAADNILGRERRADYRGIPRVVFSDPEIAACGLTEEQARREGMATATATLDLSRAIARPYTYEEDPRGTLSLVADRKRGVLVGAWAVAPLAGEWIHEAALAIRAEVPIEKLLDSVAQFPTYSEAYLYCLERLDL

SEQ ID NO: 25690 - protein, 507 aa, Rubrobacter xylanophilus DSM 9941
MRLYTAEEMGRADRAAQEMGISGRVLMERAGVGMASLALERFSPRRAVAVCGGGNNGGDGFVVARELHRAGVEVEVLATREEYRGDPEANLRALKGLGVRMIRPEELGVSLGRADLVVDALLGTGFSGEVREREAALIRRINASPARVLAVDVPSGVDGSTGEVRGEAVRADLTVCAHALKVGCVISPGREHAGEVAAVDIGLPSEAEVEPSVVLNDAASLAGLIPRTAEPAHKYSAGALLVVAGSRAMTGAAVMTVAGAQRAGCGIVFLVTAAGAAPLLDARLTEAIVEGAPEDAEGHMGEGALEAVLGRAGRASAVVVGPGIGVGEGGRRLVEGIVREVEAPVLLDADAITNLSGSDALAAREAPAVITPHAGELGRLMGAGAREISASRLRHAREAAARHGCCVLLKGSDTIIAEGEKAAVNPTGHVALATAGTGDVLSGVIGALLSRGMGAYDAARAGAWAHGRAARLWLRETGWPAESLIATDLLPHLPRAFAELLEGRPPR

SEQ ID NO: 25691 - protein, 465 aa, Rubrobacter xylanophilus DSM 9941
MREGENTLRAESTAAFRARKGLSEGLLERQAARESNARTYPRSIPIAVSRARGPYVWDADGRRYLDCLSGAGTLALGHNHPVVVEAIREVLDRGGPLHTLDLATPVKDRFVEELFGSLPRRFAERARIHFCGPAGADAVEAAVKLAKTATGRETVLSFSGGYHGMTHGALSLTGKLAPKEPLAGLMPGVHFLPYPYGYRCPFGVGGEDGWRVGARYVERLLDDPESGVKRPAAMVLEVVQGEGGSIPAPDGWVREMRRITRERGIPLIVDEIQTGLGRTGTVWAFERPGIEPDAVVMSKAIGGSLPLAAVVYDAALDVWEPGAHTGTFRGNQLAMAAGAATVRHVLKNRLHEHAARMGELLLERLREVQREAGCVGEVRGRGLMVGVEVVDPEAGPDPLGSRPARPDLARRVQAEALRRGLILETGGRHGAVVRLLPPLIIAEEEAEEICALFGEAVLAASRGAR

SEQ ID NO: 25692 - protein, 269 aa, Rubrobacter xylanophilus DSM 9941
MSGAHDAREGQERGYSPDEMMSIAAARELRDGVVCFVGIGLPSEAANLARRTHAPNCMLVYESGTLGAKPDVLPLSIGDGVLAEKADSVVSVPEIFNYWLQAGRIDVGFLGAAQIDRYGNLNTTVIGDYRRPRVRLPGAGGAPEIAASAGEVIVILRHRRRAFVERLDFITSVGHYRGGESRKELGYTGAGPVAVITDLGILRPDPETRELTLSALHPGVSVEQVREQTGWELRVSGELEVSEPPTGRELEVLRALRAATREAMKEAAG

SEQ ID NO: 25693 - protein, 394 aa, Rubrobacter xylanophilus DSM 9941
MSGAAHRALGLATLAFALCFSVWGLIAPLAPRFQELYGLSDTQISLVIATPVLLGSLFRIPAGILADRFGGRRVFTGMLLFLVLPVVLIGFFGGSFYGLLFWGFLLGVAGSSFAVGVPFVSKWFPPERQGVALGVYGVGNIGSALAAYAAPAIAGAWGWRWAFWVFAVPLLAMAAVFWAVGRDAPGGGPPPSLAEGLRLFREELGPWVLSLFYFLTFGGFVALGIYLPKLLVDLFGLGQTDAGLRAAGFVVLATLARPVGGWLSDRVGGGPLLAVVFALLPLMALLLAFGGGMVSFTVGALSSAALLGVGNGAVFKLVAALYPGRTGVVTGLVGAAGGLGGFFPPLVMGVVRDLTGSYAPGFVLLALFAAGCFAVNAACMRRWKAQGQGRTEGV

SEQ ID NO: 25694 - protein, 327 aa, Rubrobacter xylanophilus DSM 9941
MPRRVVVTRRIPRAGLEALGDLRASVLGEGPPAREELLSAARGASGILSTVTERIDAEVMDAAGPSLRVVANMAVGYDNVDVAAASARGVVVTNTPGVLDETTADTAFMLLMAAARRLGEAERLVRSGRWEGWGPEQLTGPDVWGKTLGIVGFGRIGRAVARRATGFGMRILYASRSRKEEAERELGARRVSLEELLRESDFVSLHTPLTPETRHLIGERELSLMKPAAVLVNTARGPVVDEAALAAALARRRIFAAGLDVYEREPEVHPALLGLENAVLAPHIGSASIETRARMAALAAENLRAVLSGRRPPSPVNPEVLERLPLD

SEQ ID NO: 25695 - protein, 318 aa, Rubrobacter xylanophilus DSM 9941
MEASGALEVVTLGEALIVMDPVERGPLRHVPGFRKRVGGAELNVAVALARLGHRAGWAGSVGDDEFGREVLGFLRAEGVDVSGAVLDPGAPTGLYFKEWRAGGLRAHYYRAGSAASRMAPGRLDEGFLLSGRVLHLTGITPALSGGCEELVRRLAGEAGRRGVLLSFDANIRWRLFGERDPRKAIEPLLPLADLLFLSDEEAELLLGGSDPRSVERARGRLGAGVVVVHSASGSFAAGGEGVVRREGYRVEAVDTVGAGDAFVGGFLAGFLRGWETGACLELANACGACAVAVPGDAASMPAEEEALALLRGRRERER

SEQ ID NO: 25696 - protein, 261 aa, Rubrobacter xylanophilus DSM 9941
MGKAPAELLRGLREDPGASAILTDIDGTLAPIAPTPDAARVPEEVRELLERLSRRYLLVAGISGRKTEEARKLIGLGGVVYFGNHGFEKLEGDRVEIIPEALPYLERVRELERRAREELGPLGAFVEEKGITASVHYRNVPGEVGERCVELVRREGERLGLRVTVGRGVVEARPPVRADKGTAVRALVEEYRPRRALFMGDDTTDLDAFRELERLRGEGLLEEALRVGVASEEGPREIVAEADLVVEGVEGVAEVLRELAR

SEQ ID NO: 25697 - protein, 452 aa, Rubrobacter xylanophilus DSM 9941
MDAFFRFSERGTNLRTEVVAGLTTFMTMAYIIFVNPSILSTEGTGLPISGVFFATCVAAAAASIAMGLFANYPLALASGLGLNAVVAFTLILGLGLSWQQAMAVIVLEGLLVTVLVLTNLREAVMNAIPMSLKFAIAVGIGLFIAFIGLKNGGIVVQDPATYLTLGDFTQGPVLLAAFGLAVTLVLVALGLRGGILGGILITGIVGMVFGIIPLPERVVDFRFDTSTVGGGLLAIPEVLQITLVPVIFALFMTDFFDTMGTVIAVGQEGHLLDEEGRPPHLKRILLVDSLAAAGGGALGASSVTSYIESGSGVAEGGRTGLTSVVVGLLFLLALPFSPIIGVFGGSVPIPGPEQGQEIFVSPVTAPALVVVGFLMMTSVRYIPWDRFDEAIPAFLTILTLPLTFNISYGIGFGFISYVLIKLARGKPGEVHPLLYGVAVLFALVFAAEPFLS

SEQ ID NO: 25698 - protein, 452 aa, Rubrobacter xylanophilus DSM 9941
MRLVVVGGVAAGTKAAARARRVNPRLEITVYQEEPEPSISECGLPYLLSGTVSGRRRLVARTPEEFARDGIRVLVRHRVEEVRPEEGRLLVRDLAAGSVFEDRYDRLVLATGARAVPLGVPGSGLEGVFNLRFLTDADRILDHIRRHRPRRALVVGGGYVGLEVAENLRLLGMEVVLAQRPRRVATAYDPEISRRIEEHLRERGVELRTGAEVEELRGDGRVREARISGEAVEAGLVVAGVGIEPEVDLARRAGARIGTTGAVWTDRHQRTSLPEVWAAGDCAQTRNRITGGPAWVPLGDTANQTGRVAGTNAALGEDAEEFPGVLGTGIFKVFDLAAGKTGLSEAEAAGAGLEAVAATIESRSRAGYYPGAGRVLLKLVAERGSGRLLGAQALGPGADKLTDVCATALWGGLSCSDLINVDLAYAPPYGPVLSPVIQAATVLQRRLSQPPK

SEQ ID NO: 25699 - protein, 477 aa, Rubrobacter xylanophilus DSM 9941
MRVRRTKIVATLGPATSSEESIGALVRAGVDVMRLNFSHGTHDMHLDNARTVREAAAEAGRNVAIMQDLQGPKIRTGEVEGGTELVEGSRVVIAPGDFVGDASRLSTSYDRLAQDVKPGHRLLIDDGLIGLRVESIKENGEIVCEVLEGGPVSSHKGLNFPDSSLSISGLTEKDLEDLRFGLEELRPDWVAISFVRTGEEVLDVKERIRELGGDVPVISKIEKHEAIDNIEEVIEASDGVMVARGDLAVELSAERVPIEQKRIVARCRRRGRPVIVATQMLDSMMRNPRPTRAEVSDVANAIFDRTDAVMLSGETAVGRYPTQSVMEMDRICRAAEGAIDYGRDIAASTAWGRGDRYDAVTHAACELAEVLEAQAILTSTQTGLSCIRVARFRPPNRILAVSPIEATVRRLALVWGVTAVRGEQAGSIEERFRESVEAAEARGHLKKGDRLVFTGGTAGSLPGSTNLLQVHTVGENG

SEQ ID NO: 25700 - protein, 430 aa, Rubrobacter xylanophilus DSM 9941
MTEIVAVRGREILDSRGNPTLEVEVVTAAGFVGRAAVPSGASTGQNEAVELRDGEGGRYGGKGVLRAVANVEGELAEAVVGMDVTDQRALDLAMIEADGTENKGRLGANAMLGVSLAAARAAAEYAGLPLYRYLGGPGAHVLPVPCANILNGGAHAANNVDFQEFMVVPVGFESYREALRAVAEIYAALKKLLAERGLAGGIGDEGGFAPDLSSNGEALGLLSEAVERSGYSLGEQVCFALDPAASEFYEGGRYELSGEGRSLERGEMVDYYVRLCGEYPIISIEDGLAEDDWEGWEMISARLGGRVQLVGDDLFVTNPKILRKGIERGIANSILVKVNQIGTLTETFETMDLAHKSGYTAMVSHRSGETDDTTIADLAVAVNAGQIKTGAPARGERVAKYNQLLRIEESLGEAAVYPGLGAFNPRMREG

SEQ ID NO: 25701 - protein, 257 aa, Rubrobacter xylanophilus DSM 9941
MDATVFTKCERCKQPVYEKDLRARFNVCPNCEFHYPLPAPERVRLLTDAGSFEERDGELAAGDPLGFEGYPDRLRSARKKTGLGDAILSGVGEIGGRRVALAVMDFRFIGGSMGSVVGERVARTVELARAEGLPLVTVSASGGARMFEGIYSLMQMAKTSVALSRFMEGSKPYISILTDPTFGGVTASFATAADIIIAEPGARVGFAGARVIEQTTKERLPEGFQTAEFQREHGMVDRIVHRLALKGDLERLLGFVG

SEQ ID NO: 25702 - protein, 263 aa, Rubrobacter xylanophilus DSM 9941
MGGRERLLGAFSKGRPALIPYLTAGYPSLEGAREVARAYLEAGADVLEIGVPFSDPLADGPTIQDTTARALENGADMDYCLGLAGEFSGRAPVVLLVYYNLIFARGVERFVREAAGAGVSGVVVPDLPVDEAGEPARAVEKGGMAFCPLAAPTSTDERLEKIGSLASGFVYCVSVAGVTGVREKLPPGAVELLRRVRARVSAPVALGFGIGSAEAAREAAGEADGIIIGSRLMQLVGEGGPERAGEWLRGVREALSRTAGRSH

SEQ ID NO: 25703 - protein, 213 aa, Rubrobacter xylanophilus DSM 9941
MGVTERVRFDEKGLVPVVAQDAEDGAVLMVAYADREAVERTLATGEAHYYSRSRGELWRKGQTSGNTQRVVEVRVDCDGDTLLYLVEPRGPACHTGERTCFFATLAGEGVGVSAGRGEDGVGLGAMLERLAGTIAARRRERPEGSYTASLMERGTGYVAQKVGEEAVEVVVAALRGERLAEEAADLVYHLLVLLEERGVGTGEVARVLRDRHR

SEQ ID NO: 25704 - protein, 127 aa, Rubrobacter xylanophilus DSM 9941
MSEEMNSAGQGPPSVKVDKPWGKFEQYTHNLPCTVKIITVAPGGTLSRQYHHKRDELWVVLDPGARVELDDQILHPEPEEKVFIPRQTVHRLSCEGERPVRILEISFGEFDEEDIVRLEDVYGRVGP

SEQ ID NO: 25705 - protein, 334 aa, Rubrobacter xylanophilus DSM 9941
MERSDALAERFAAEAAACERLFLVGIGTSHHAARVGEHLFRAYGGGLDARAVHSFDFALYGPEVTARDCVVAVSHRGSKRYTAAALRRAREAGSRTALVTGEGATVSVETDAVFETVPQERSSAHTVSYTSAVAVLALLAALAGRLRTGSETLEMGFLREEIPAALREALGTEDEARALAGEHVGRRRIWLAGGGPSAVTAEETALKIKETSYLQAEGMPTETMLHGPFQCVEAEDLFVLVAPSGAAQGRTLEVADLAGEVGAPSLVVSDGTAGIPGGASSLAVREVPEPFSALACLVPLQLFAYHLALARGTNPDSFRAEDPRFARADVSGRL

SEQ ID NO: 25706 - protein, 175 aa, Rubrobacter xylanophilus DSM 9941
MMPEIGPVLVPAGEIQRKVRELGERITRDYAGQNLLLVGILRGAFVVLSDLIRQIEIPCEVDFMEVSSYGAGTTSSGVVRILKDLEEDISGRHVLIVEDIIDTGLTLSYLRRSLLARKPASLEICALLSKPARRQVDIQVRYQGFEVPDVFVVGYGIDYAGFYRNLRDIYALKQP

SEQ ID NO: 25707 - protein, 412 aa, Rubrobacter xylanophilus DSM 9941
MPQTLAIVGAGPAGGSAAAALRREGFEGRVILIGAEPHPPYERPPLSKEYLRGETSFEQALLQPSGFYRENGIEAWFGVRATRVDAARREVELENGERLAYDGLLIATGARNRRPAIPGLGLGGVHQLRTVADCDRIRQEIAPGRRAVVVGMGFIGSEVAASLRQSGVEVTVVDRNEVPLRRALGREVGRVIEELHRDHGAELILEDAVAAFEGRERVERVTTRGGRRIGCDFVVVGLGAEPVTDLLAETGAKIQNGIVVDEHCRTSVEGVYAAGDVANHYHPTFGRHIRTEHWQNALRQGSVAARSMLGKKSAPYEEIPWFWSDQYGHNLQYAGLHTEWDELVVRGSMRERDFLAFYRKDGRVLAAVAIGRGRELRRSIPLIKARERVEAAKLRDPDVDLRALAGAAGSRR

SEQ ID NO: 25708 - protein, 389 aa, Rubrobacter xylanophilus DSM 9941
MQGMENFLELDTLLSEEERAVRDRVRSFVEERVRPNIKGWYEEARFPRELVPEMGALGLLGMHLEGYGCAGRSAVEYGLACMELEAGDSGIRTFVSVQGSLAMSAIHRFGSEEQKQEWLPRMARGEAVGCFGLTEPTAGSDPASMKTFARRDGDGWVIEGAKRWIGMASIAEVAVIWARTDEEGNPVRGFLVPTAAQGFSATNIEPKLSMRASIQCDIELGGVRVPAGAMLPGAAGLRAPFSCLNEARYGIIWGSMGAARDCYECALEYSLRREQFGRPVASFQLTQKKLADMVVEIQKGMLLALHLGRMKDAGALKHQQISLGKLNNVREAIKIAREARAILGGNGVTLDYPPLRHANNLESVRTYEGTDEVHTLILGQAITGIEAFR

SEQ ID NO: 25709 - protein, 303 aa, Rubrobacter xylanophilus DSM 9941
MSAPRVIVVGDVLYDMVARVEGGLPVGADSFVRIQDSPGGSGANVAAWLASLGVEAHLVGRVGEDPLGDHLEAGLREAGVRTHLPRDPSLPTGRVFVLVDGSGERTMITDRGAGEALGPRDIPARLFAPGAHLHLTGYLFSGGGRREAALEALRLARSAAMSFSVDPSSVTLLRAVGVERFAGWTSGADLLFPNLSEAALLSGRAEPEEAARRLLERYRAVVLKLGPEGALYADREGRRARLPAPRVRRADATGAGDALCAAFLASWVRGEPPARALREGVRLAARVVGRTGARGFRRTRGPC

SEQ ID NO: 25710 - protein, 214 aa, Rubrobacter xylanophilus DSM 9941
MGFCLINNAAVAAAHARALGARRVAVLDWDVHHGNGTQEIFYAAGDVLYLSVHRGGLFYPGTGHPEEVGAGPGKGFTVNVPLPAGSGEGGYAAAFGGVLLPVLEEFAPELVVVSAGYDAHASDPLGGMRLEAGSFGRFAAAVASLARRASGTPPAFVLEGGYEAGALTACVAATIRGAGEGETGGEPWPAEGRGDLLGPPRRALAPYWESLRGG

SEQ ID NO: 25711 - protein, 488 aa, Exiguobacterium sp. 255-15
MWENKFAKEGLTFDDVLLVPRRSSVLPRDVDLSVTLCEGITLNIPLISAGMDTVTEAPMAIAMARQGGLGVIHKNMSMEDQAEHVDRVKRSENGVITNPFYLTPERQVYDAEYLMSKYRISGVPIVNNETERKLVGILTNRDLRFVKDYSTVIETVMTTEELVTAKVGTSLEEAEQILHKHRIEKLPLVDENGVLKGLITTKDIEKVEQYPHAAKDSFGRLLVAAAVGVTKDASVRAKFLVDAGVDALVVDTAHGHSEGVLVKVRELRDEYPNLPIIAGNVATAEATRDLIEAGASVIKVGIGPGSICTTRVVAGVGVPQITAVFDCATEARKHGVSIIADGGIKYSGDIVKALAAGGHAVMLGSLLAGVEESPGEMEIYQGRQFKTYRGMGSEASMKRGSQDRYFQEADKKFVPEGIEGRVAYRGKLGDSVYQLVGGIRSGMGYCGSASLEELREETQFIRMTGAGLQESHPHDIQITKEASNYTRQ

SEQ ID NO: 25712 - protein, 483 aa, Exiguobacterium sp. 255-15
MLQRNLALHTDLYLPRWMYIYWKEGRHNERAVFDVYYRSNPFEGGYVVFAGLENIIEYVQTLRFTEEDITYLQKMIDFPDEFKDELRNFKFSGSISSVKEGEIVFPNEPLVRIEARIFEAKLLQTAILNIANHESLIATKYARIRQSAPGAKFLEAGARRAQGIDAAYFGTRASYLAGFDVTSLASAGRDFGIPCGGTMEHADIQFHDDELTAFRTFAAYYPDQATLLVDTYDTLKSGLPNAITVAKELEAKGHKLRGIRIDSGDLSYLSKRARTMLDEAGFPDVDIVLSGDLDEYVIQDLRIQGAQANTFLVGTRGITAYEQPALGMVYKLVAREVDGELIPVIKVSSSKAKTTTPHIKEVYRIVDRVTNKFKGDYVTLLDEDPTDLEAIDLIDVRDPSFRNRIENFNVERLLTPIFVEGELVYTVPTIEESRHFHEQQIGRLWEEYKRLRLPEVYAITFSDRLWKLKLDMIRDTRTASGLK

SEQ ID NO: 25713 - protein, 307 aa, Exiguobacterium sp. 255-15
MIAKSVRDLVGNTPLYEITSFDLPAGTRILAKLEWMNPGGSVKDRLGIQLVDAAIEQGYVTRGGTIIEPTAGNTGIGLALAAKKYDLQVICVVPEKFSQEKQTLMRALGATVVNTPTELDMQGAIDKAKELGQTIPNSYVPLQFENEENPVTYQRTLGPELMAELDQIDWFVAGCGSGGTFAGTAAYLKERLGTKGAIVEPEGSVLNGGPAGPHKTEGIGTAKWPSLVSRDLVDEIHTISDHDAFTKVHELAAREGLLVGSSAGAALVAALDLAHRFPGSTIVTVFADSAERYLSQQIFEKVDETHA

SEQ ID NO: 25714 - protein, 462 aa, Exiguobacterium sp. 255-15
MSLLRKKDVSVMMDQKSHSKLARHLSGFDLVLLGIGAIIGTGIFVLTGTGALYAGPALPVAFIISAIVCALAALCYAEFSSMIPVSGSVYTYTYATIGELVAWIIGWCLILEYGLASSAVATGWSGYFQSLLSGFGISLPTALTAAPGAVPGSETFFNLPAFLILMVITLLLSMGIKETKRVNNIMVLVKVAVVVLFIVVGIWYVEPGNYTPFAPFGISGVLQASAIAFFAYLGFDAVTSAAEEVKDPGRNLPIGILGSLAIVTVLYVVVSAIMVGIVPFKQFEGVDSPVSLALKVAGQDWVAGFVDLGAIVGMTTVILVMTFGLVRLLFAMSRDGLLPKIFSDVNEKSHTPVKATWILGTTAGLIAGFVPLGTLAELINIGTLAAFALISIAVVILRKTRPDLKRAFKVPWVPFLPILSVLACIMLMLNLQTFTWIAFFIWTAIGLLVYFGYGRSRSKLQQ

SEQ ID NO: 25715 - protein, 464 aa, Exiguobacterium sp. 255-15
MNQQKIGFFALAAMVIGSMVGGGAFNLPGAMAQKASAGPILIGWGITGLGMIMLALVFQHLANSKPELEGGIYAYAREGFGRFVGFNSAWGYWVSAWIGTVANITLVFNALSYFFPIFSSENRVFLLVMSIVVVWGLFFIVSSGIKEATLVNLITTIAKLVPILIFILLVAIAFNVKTFNLNFWGEGTELGSIFTQVKGTMLVTLWAFVGIEGAVVLSTRANKRSDVGKATVVGLVGVLVIYILISVLSLGVLNQEQLAGLQEPTMAYVLEAAIGPFGATLIMVGLIISLSGALLGWTILASEISYLVAKDGAFPKFFAKTNRKGAPVGALLITQIATQFVAGIALFSAQTYLVLSSIAGICALLPYLLSAVYSVRFSRAERNTKMLIFSTIAAAYSLWLVYASGIWYIVIAALVYAPGIIAYLMAEREQKRGGMSRYEMIASGILIILAAVAVYGMIGGQIQL

SEQ ID NO: 25716 - protein, 279 aa, Exiguobacterium sp. 255-15
MEQKLKLWFTEHQTEDYGITFRVNHVYESEQTEFQRLEMVETDEFGTMLLLDGMVMTTDRDEFVYHEMVAHVPLFTHPNPKSVLVVGGGDGGVIREVLKHPSVEKAVLVEIDGKVIEYSKKYLPNIAGGLDDARVEVIVGDGFMHIAEAVNEYDVIMVDSTEPVGPAVNLFTKGFYSGISKALKEDGIFVAQSDNPWFTPELIRDVQRDVKEIFPITKLYIANVPTYPSGLWTFTIGSKKHDPLAVAPERFHEIETKYYTPELHTAAFALPKFVKDLTI

SEQ ID NO: 25717 - protein, 134 aa, Exiguobacterium sp. 255-15
MKNYKQLNALALAYMGDVVYEMHVRERLLEKGFVKPGELHQAAIRYVRAQAQAFVVTHWLNENTLTEEEQAVVRRGKNAKSGSVPKSTDVHTYRYATAFEALLGYIYLAEGGDRLEELIGQAFELLEAEATDGK

SEQ ID NO: 25718 - protein, 438 aa, Exiguobacterium sp. 255-15
MGRCSGCGEWNTMVEEVVEEKKARRGSAFVHTTTKQLKPERLSNILSQEESRVFTGSGEFDRVLGGGIVPGSMVLVGGDPGIGKSTILLQTSARLAARGEKVLYISGEESLKQTKLRAERLGLPTQDLFVLSETDMNMIERVVDEENPAFLIIDSIQTVYIDEIQSAPGSVTQVRECTAMLMKIAKSRGIAIFIVGHVTKQGSIAGPRLLEHMVDAVLYFEGERHHTFRILRAVKNRFGSTNEIGIFEMRESGLEEVLNPSEIFLEERTSGVSGSTIVASMEGTRTVLVELQALISPTSFGNPRRMATGIDQNKVALLMAVLEKRSGLLLQTQDAYLKAAGGVKLDEPAIDLAICVAVASSFRDKPTRPTDVVIGEVGLTGEVRRVSRIEQRVAEAAKLGFTRAIIPKNNLGGWTYPPGITVIGVESVDEALRETIPF

SEQ ID NO: 25719 - protein, 428 aa, Exiguobacterium sp. 255-15
MITEIYAREILDSRGNPTVEVEVYTEDGGFGRALVPSGASTGEHEAVELRDGDKSRYLGKGVLKAVDNVNEKLAPEIIGYDVFDQAGIDKKMIDLDGTKNKGNFGANAILGISMAAARAAADELGLPLYTYLGGFNAKTLPTPMMNIINGGSHADNNVDFQEFMIMPVGAPTFKEALRMGAEIFHALKSVLSGMGLNTAVGDEGGFAPNLKSNEEAITVILEAIEKAGYKAGEDVYLAMDVASSEFYDKAAGKYNLAGEGKVLSTEELVEFYAQLVDKYPIISIEDGCDENDWDGHKLLTDRIGHKVQLVGDDLFVTNTEKLAEGIEKGIANSILIKVNQIGTLTETFDAIEMAKKAGYTAVVSHRSGETEDSTIADIAVATNAGQIKTGSLSRTDRIAKYNQLLRIEDMLSDVAVYDGIKSFYNLKK

SEQ ID NO: 25720 - protein, 250 aa, Exiguobacterium sp. 255-15
MRKPIIAGNWKMNLTLKDAVAFAEEVKGTVPASSKVDAAVCAPSVFLAHLTEATAGTDLKIGAQNMYDQESGAFTGEISPVMLKELGVTYVVLGHSERREYFGETDAFINSKTKKAFEHGLVPIVCVGETLEEREGGKFESVIREQTTNSLKGLTVDQVKNLVVAYEPVWAIGTGKSATEQDAQDSCKFVRDVIAAEFGTEAAEAVRIQYGGSVKPDNIKEYMAQPDIDGALVGGASLETGSFLKLLEAI

SEQ ID NO: 25721 - protein, 394 aa, Exiguobacterium sp. 255-15
MNKKSIRDIDVKGKRVFTRVDFNVPLEDGKITDDTRIRAALPTIKHLVDGGAKVILASHMGRPKGEKNPEFSLAPVVARLSELLGKDIKLVEEAYGPVAEEAVSKLEEGDVIVLENVRFYPGETKNDPELAEGFAKLADVFVNDAFGAAHRAHASTEGIAHHVETAVAGLLIEKELQVLGKALSNPDRPFTAIIGGSKVADKIGVIDHLLDIVDTLIIGGGLSYTFLKAQGYEVGTSLLEVDKIEQAKEFMKKAEDKGVKFLMPVDCVITKEFGEETYVGSRDIDSIPADHMSLDIGPKTVELYAEAIKASKLVVWNGPMGVFELDKYANGTKGVAQALADSDAYSIIGGGDSAAAAEKFGLADKMSHISTGGGASLEFMEGKALPGVEALNDK

SEQ ID NO: 25722 - protein, 492 aa, Exiguobacterium sp. 255-15
MNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 25723 - protein, 506 aa, Exiguobacterium sp. 255-15
MRALISVSDKTGIVELGQAMHDAGIELISTGGTHQALEAAGLPVIGISEVTQFPEMLDGRVKTLHPMVHGGLLGRRDLESHREQMAEQQIKPIDFVVVNLYPFKETVMNEDVSYADAIENIDIGGPSMIRSAAKNHAAVTVVVDPADYQAVIQEIHLGGTTFETRQKLAAKAFRHTAAYDALIADYFLTQTGEKFPDQLTITLEKVQDLRYGENPHQEAAFYKTPIYRGASLASAKQLHGKELSYNNIQDANAALEILDEFREAAAVVVKHMNPCGVAVGPTIDEAFRRAHAADPVSIFGGIVALNREVDLATAEQLSGIFLEIIIAPSFTEEAFTLLAAKKNLRLLELDVKRVQSIRYTAVAGGMLVQDSDDETLDDASARVVTDRKPTAGEWEDLKLAWRAVKHVKSNAIVIAKDEVTVGVGAGQMNRVGSANIAITQAGAKAVGAAMGSDAFFPMGDTVEAAATAGITAIIQPGGSIRDQESIDACNKHGITMIFTNVRHFKH

SEQ ID NO: 25724 - protein, 210 aa, Exiguobacterium sp. 255-15
MGLPGAGKGTQAAKIIEDYAIPHISTGDMFRAAIKDQTPLGQEAKSYMDKGELVPDEVTIGIVRERLAKEDCANGFLLDGFPRTVKQADALEVLLADLNKQIDHVVHIGVNPEKLVPRLTGRRICPTCGATYHVIYNPPKVEGVCDIDGSALVQREDDQEETVRRRLEVNVAQAQPLIDFYAEKGYLRNLDGDRPINEVYSDVQALLGGQ

SEQ ID NO: 25725 - protein, 310 aa, Exiguobacterium sp. 255-15
MNVTQQQLEELIAECRPYTVLGQVASYIPELAKSEPTQLGIAVCNADGSFVSAGDAETMFTLQSVSKIITLAFVLETFGEDYVFSKVGMEPTGDAFNSIAKLEETIPTKPLNPMINAGALAVTSMLPGEDAADKLNRLRQFIADLLDIELDMVKYDAEVAKSEFETTDLNRALLYFMRYHGVIEGNVEEIIDVYTKQCAILTNCKGLAMMGKILSQSGKTPSGNQVISRRNARIIRAIMTTCGMYDASGEFSVQVGLPGKSGVSGAIVACGRSDFDMADLGIGIFGPALDLKGNSIAGTKMLELLVQRHP

SEQ ID NO: 25726 - protein, 451 aa, Exiguobacterium sp. 255-15
MLETTTLSGKIQQFMKIFFPILVTQVAFYLISFFDTVMAGRYGSADLAGVGVGASLWAPVYTGLTGILLAVAPLVSQAMGARKEREVKRIVIQALYVSVVIIVLTVLLGLVLVNPILNQMELSDQARHVARIYLVMLGFGIIPMFVFFVLRTLIDSLGKSNITMTLLLFSLPINVAFNYLFIFGKFGFPELGGIGAGVATAITYWILCIAVIGVVLKGELFQRLGILRRFYKPDVTRIKELVLLGAPIGLAIFSEVSIFSAVTLLLGAYGDVVIGAYQAAINFASFVYMIPLSAASALTITVGFEMGAKRVKDAVQYVWIGLLLCLVVSLFSGGLLYVQNERIAALYSNDPAVIKMAAHFMILAIFFQLSDAVAAPTQGALRGFKDVNVTFILTITAYWVIGLPLGFYFERFTELGPDGYWWGLIIGLAVGASLLLLRLMHLVRKSKEVVK

SEQ ID NO: 25727 - protein, 365 aa, Exiguobacterium sp. 255-15
MADNNTIIQFTDVTKRFDDQTVLERVSFEIERGKFYTLLGPSGCGKTTVLRLIAGFTEATEGDILFNGKRINDVPANKRQVNTVFQDYALFPHLNVFENIAFGLRIKKMKDAEIKTRVLDALKFVNLSGYENREITEMSGGQRQRVAIARAIVNEPEVILLDEPLSALDLKLRTEMQYELRDLQRRLGITFIFVTHDQEEALAMSDEIFVLNHGLIQQSGTPTDIYDEPINRFVADFIGESNIIPGRMLMDYRVSFAEKEFECVDRGLELNEPVEIVIRPEDLEITSVAQGKLRVTVDSQLFRGVHYEIACMDEVGNEWLVHSTKKATVGEQIGLTFDPEAIHVMRLNETEEEFDKRLESYDGVL

SEQ ID NO: 25728 - protein, 475 aa, Exiguobacterium sp. 255-15
MKRIAVGAVIAVYMTVFSFSLWTYQHPVLTSSDQSKLLPTRVKQIRSATSTNDLKSWVAQAKQRQETVSVAGMQHSQGGQTYLPDTTVLDMTDYDRILAYTPDKHRITVQSGITWAEIQERIQPDGLAVQVMQSQNIFTVGGALSVNVHGRDIRYGSLLDTVDSFRLLKADGTVVHVSRNENADLFRLVPGGYGLFGIILDVTLKLTDDEWYTEQTVALDYHDYPAYFRQHVLGDADVRMHIGRISVAPDGFFKEMYVTNYHKAERTVPIEEEPLKQETIIALPKALLGLSRYSDFGKNKLWSFQKSYFLKQSGTYESRNNVMRSDSAFMEYISPGRTELLQEYFVPVDSFVSYIDQLRTILTTDELNVLNITIRYVEQDRTAALSYAKQDMFALVWLINTETDPASINETKRIVQKLIDATLEHQGSYYLPYYPFATRDQFTAAYPNAAAFKAAKQRQDPKGLFMNQFYLDYLK

SEQ ID NO: 25729 - protein, 436 aa, Exiguobacterium sp. 255-15
MSLTNQNSKSKAAFERALPLMPGGVNSPVRAYKSVGMTPIFAERAQGSRLYDIDGKEYIDYVLSWGPMILGHADPIVTAAIQEQATRGWSYGTPTEIESAMAEVVISRVPSVEVVRMVNSGTEATMAALRLARGYTGKTKILKFEGCYHGHGDSLLIKAGSGVATLGLPDSPGVPAQIASMTLTVPYNDMDAVRIAFEKHGDDIAGVIVEPAAGNMGFVPPQPGFLEGLREITEQHGTLLIFDEVMTGFRVGFNCAQGHFGVTPDITCLGKVIGGGMPVGAYGGRRDIMEQIAPQGPIYQAGTLSGNPLAMAAGLATLTQLKPEHYEEFDRKANRLSEGYLAAAAKYNIPLTTNRAGAMFGVFFTDQPVTNFEQAKSSNLDMFRSYYQKMAARGVFLPPSQFEGLFLSTVHTDDDIEQTLAAVELTFKELQLEFNR

SEQ ID NO: 25730 - protein, 470 aa, Exiguobacterium sp. 255-15
MVVGEFAQETDLLVIGAGPGGYVAAIRGAQLGLKVTIVERENVGGVCLNVGCIPSKALITAGHNFQHAKGSDSMGITSENVAVDFSKVQSWKQSVVNKLTGGVGGLLKGNNVETVVGEAYFQSEDTVRIINEDSSTPYKFKKCIIATGSTPIELPAFKWSKRVLSSTGALNLPELPKKLIVIGGGYIGMELGTAYANFDTEVVILEGTKDILSGFEPAMTQVVKKKLKQKGNITIHNEALAQSVEETEEGVKVTFEVKGETQTVEADYVLVTVGRRPNTSDLGLEMAEVKVSERGLVEIDDQCRTSNENIYAIGDIVPGPPLAHKASFEAKIAAEAAAGHPAYLDYSAIPAVVFTDPELATVGYTEAQAKEEGLDYIASKFPYAANGRALALNEPDGFLKMITRKADGLLIGAQIAGTGASDMIAEMGLAIESGMTAEDIALTIHAHPSLGEIAMETAEVAIGSPIHIMK

SEQ ID NO: 25731 - protein, 352 aa, Exiguobacterium sp. 255-15
DQTTPVHILDALKEAINDASNLQYPPFRGHDFLKQAVADFYQSEFGVNIDPASEVAILLGSKAGIVALPQTIVNPGEGVIVPDPGYPDYLSGAALAGAYPITLPLLAENAFLPDYTLLDTTDVERARMLFLNYPSNPTGATATAEAFEQTVSFADANDICVVHDLAYGGISFDGPTRSFLQTEGAKDVGIELFSLSKRFNMSGFRIAFAIGNPSVIASIETYQEHLYVSAFTPIQQAATVALSSDQTCVRELSALYEARRDALFGKLQEIGWDGPIPGGSFFVWLPVPSGYTSQSFTDHLLDEAHVAVTPGHFFGEYGEGYVRISLIADAERLVEAAERIGQLNLFRQTVAE

SEQ ID NO: 25732 - protein, 259 aa, Exiguobacterium sp. 255-15
MRLEQAIRTVNARGEKAFIPYVMGGDGGIDRLPDILAFLERSGATAIEVGVPFSDPVADGPVIQEAGLRALADNISLKDVLEAIRIARQSTGVPIVVMTYLNPIFRFGIDTFLSTCREVGVDGLIIPDLPLEQSDQFFAGRNKQDIALVQLVSLTSPMERIEKLAAHSEGFLYAVTVNGTTGGQTNFGDSLEQHLAKVAQLSPVPVMAGFGISTPEHVRQLSTSVAGVIVGSKIVELLQQGDEATIEQLMAARLPDVTV

SEQ ID NO: 25733 - protein, 473 aa, Exiguobacterium sp. 255-15
MAREFDVVVLGGGPGGYVAAIRAAQAGKTVAIVEQGKLGGTCLHRGCIPSKAFLKSAAVYQTVKHAATYGVDVPESFLRFEQVKQRKQDIIDGLESGIQHLMKKGKIEVFHGRGSILGPSIFSPMPGTISVEPEEGDGELILPRQLIVATGSRPRPLNGLAFDSEYVLSSDEALDMNALPKSIVIIGGGVIGIEWASMLTDFDVEVTVVEFSDRILPTEDQAVSREVARQLKKRGVKIMTSAAAQSDSFQLTESGVTIDVDRNGDKTTLAADKLLVAIGRMANVEGIGLENTNIIVENGFIQVDDEFRTKDNHIFAIGDVIGRLQLAHVASAEGAKAVETIVNGSTTPLNYAFVPRCIYSVPEAASVGLTEAEAKAAGLDVKTGMFSFNGLGKARIEGEAAGFIKLVSDAKTDDLVGVHIVGPKATELISEGGLALVLNATAWEVGQLVHPHPALSEAFGEAALAVDGLAVHA

SEQ ID NO: 25734 - protein, 440 aa, Exiguobacterium sp. 255-15
MRTYDCIVIGTGSAGNQAAYKFAEKGLNVAIIENFTPGGTCAQRGCDAKKILLTGSEAKDAVERLLGYGLKGLVSIDWRQLMERKNEYTRAIPEQTRNRYDEVGIDYYHGEPRFLSNKKLLVDDIELEADQFLIATGLRPRELSVPGSERFLNSNEFLELRDVPRRLVCIGGGYISFEFAHLARIAGSEVTILLRSGALKQFEQDLVSVLLEATQALGIKILHETEAVSYSDTTLTLSDGTRLEADVVLNATGRVASIEHLQLEKAGVIYEEKGIHVNDYLQSSASNIYAAGDVAVSGNPALTPFAGTEGRLAACNMLEGNTRRLELLPVPSIVFTTPNLAKVGQTEASLKQNNTRYRGKLIDTSSWQTNVRIKDPFARAKVLIGEDDQILGAHFIGVHAAELANYFSFAMQHRIPSSALQKTSFAYPTPASDIASLLED

SEQ ID NO: 25735 - protein, 438 aa, Exiguobacterium sp. 255-15
MIGGIIMSTHTKRPTSESLYEVAQKCIVGGVNSPSRSYKAVGGGAPVYMERGEGAYFYDVDGNRYIDYLAAYGPIITGHGHPHITEAITNASRNGLLYGTPHRLEIDFAHKLQQAIPSLEKVRFTNSGTEAVMTTIRVARAYTGRELVVKFSGCYHGHSDLMLIAAGSGPATLGSPDSAGVTKATAKEVITTPFNDIESYRQIMAEWGDQVACVLVEPIVGNFGIVEPQPGFLEAINEITHEHGALVIYDEVITAFRFTYGSAQELLNIRPDMTALGKIIGGGLPIGAYGGRQDIMEHVAPLGPAYQAGTMAGNPASMAAGIACLELLEQPGVYEEFDRLGAKLEQGILEAADTHGVTITINRLKGALTVYFTDETVVDYLGAERADSEMFGRFFKLMLEQGVNLAPSKYEAWFLTTAHTETDIDETIAAVNRAFAQL

SEQ ID NO: 25736 - protein, 466 aa, Exiguobacterium sp. 255-15
MVVGELTQERDLVILGGGPAGYTAAIRASQLGRTVTLIEQAQIGGLCLNKGCIPSKVVAHAAEVKLQTKHMTALGFSFHPTHDFSQLVEYRERTIRQLRTGVEALCQANAIEVVHGTASFLADDRIGVELGHQFDTYRFNDVVIATGSHSIKQDAPSVLNAEQLYQLTELPERLVIIGQDYIAIEAAMSFQALGTSVTLIADAFDFDPSLDKELRRLFKKQKIQLVTGTVTAIEAQEDVTVTVVKQGQETTWSAPFLFHSLPRVPHTLELGLERIGVTLAEDGTIPVDPFGQTNRPHIYAIGDVTPGPAIATRAIHEAKRTAEHLSGQSADTTVPYYPTIIRSLPPIVSIGLTEQTATDAGHSFRTAQFALNANGATTIEGGSGFIKVISDATTSLILGIHMIGEGAIELAGVFAQTLELHAKEEDVRFPVMPHPSRNEAFTEAIEALLGQAIHLPPRQQDVLAKS

SEQ ID NO: 25737 - protein, 300 aa, Exiguobacterium sp. 255-15
MSLLKKHRKKLIAGLVILIVLVLIAIVGISAYVGSSLTEPPREPLTTNPKKAEGLAYENVSFRSYKDRTRLSGWWIPSEDAKLTIVFAHGYGKNREQNDVPILPLFKKFHQAGYNVLTFDFRGSGQSEGKRVTVGAKEQDDLLTAVRYAKSRASEPVVLYGISMGAATSLVTAPKAEVAGVIADSPFSDLKNYLETNLPVWSGLPNFPFTPVILQVTPPLTGLNPERVQPIEAIRRIDYPILMIHGKDDDAIPVTESMRLQKAAPRSELYVTENGGHVQSYKHDRKAYENKILSYLEDIR

SEQ ID NO: 25738 - protein, 430 aa, Exiguobacterium sp. 255-15
MFKLSAHDTTVKREIQAGFITFITMAYILFVNPTILSEAGIPQDQAFSATIVATLIGTLLMGFYANLPIAVAPGMGLNAYFTYTLVIGEKIPYQTALSVVFVAGIIFLLLSLSPLRTKLIEVIPTTIKLAITGGIGLFIASLGLKMSGILVADPATLITIGSLTSPEALITLVGLLVAAILTVKRVPGGLLYAMVLSGVLAFLTGELTFSKTLIALPTLPEGILVANPLSAVQDVIQYGLFSGVLSFVLVTMFDTTGTMVAVGEQAGLIEEDGSLKNSERALLSDSTAMIVGSMFGTSPTTAYVESASGVAAGGRTGLTSVTVGILFALSAVFGPIVQSISSVPAITAPALLLVGALMLQNIKQIQWEDFSEAFTAFMIIIIMPLSGSIATGIAFGFIIYPIMKAVQKQRVHFLIYLFAVLFFIQLFFLH

SEQ ID NO: 25739 - protein, 380 aa, Exiguobacterium sp. 255-15
MSALLPTYLRHDIELVAGNGSFVQDKAGKNYLDFVMGIAVCNTGHRHPHVEQALQEQLQKLWHTSNLFMSSKQERVAAMLTENSHLSHVFFCNSGTEANEGAFKLIRKWTQKKEILTFSQSFHGRTFAMMGATGQDKIKAGFGEMVPDFKHLTFNDFDSLEMITNQTAAVWLEVIQGEGGVIVAENAWLEALMEKARQYDVKVVIDEVQTGIGRTGSRFAFEQTPLKPDIITVAKGLGSGFPVGAIITTPEATAVFTPGTHGSTFGGNPLAMAAAEATLDVLLNEQQMKQVQQKGLYLMQQLKQLPETMVVDVRGRGLMIGIEFHEPVSSLITALQQAGMLVVSAGPNVIRLLPSLCVTEQELDLAVGKIKTVCQQEVMM

SEQ ID NO: 25740 - protein, 450 aa, Exiguobacterium sp. 255-15
MSTQMKPQQPKQKENAIARYFDFNGLGTNMRTEFIAGMTTFFAMAYILFVNPNTLAEAGMDAGAVFGATALVAIIGSVTMGLLANYPIALAPGMGLNAFFAYSVVIGMGIPWQTALSGVLVSGLVFMVLTASGIRETIINAIPEPLKMAVAAGIGLFIAFIGLKTGGIVVANEATLVSLGNLGQGTTLLAVFGLVISAILMTRGIKGAIFFGMIITAIAGMIFGLIPVPSGLGEIVSAPPSIAPTFGQAFLHFDEIFTVQMAVVILTFFFVDFFDTAGTLVAVANQAGLIKENKVPRAGRALIADSTATVAGSILGTSTTVSYIESSAGVAAGGRSGMTAIVTGLFFGLALFFSPLLAIITAPVTAPALIIVGVLMASSLLQIDWKKFEYAVPAFLTVIMMPLTYSIATGIAFGFLFYPITMIAKGRGKEVHPIMYAMSLGFLAYFIWLH

SEQ ID NO: 25741 - protein, 179 aa, Exiguobacterium sp. 255-15
MATVLFQKTNERYTDQNEVSAFLASRGVLYEQWDVSKLPAELVDTYTLTDADKQTILDTFQSEITDVSERRGYQTADIISLSDATPNLDELLVNFQKEHHHTDDEVRFIVSGHGVFAIQDDEVGYYNIELNPGDLISVPVNTRHYFTLQEDRKVVAVRIFVTTDGWVPIYEKDPIETAN

SEQ ID NO: 25742 - protein, 502 aa, Exiguobacterium sp. 255-15
MSTVHEKTIEMKRSVYHLVINGEQVEGTSGETFKTYNPATGEVIAEVAKASKADADRAVQAARDAFDHGKWKMWPVGRRSQVLNKIAGIMRSRFNELVELEILDTGKSLAAAQGQITQAIEDFEFYAGAIVGHRGSVNNVPGQFHNYTEKEPVGVCAQIIPWNYPLMMAAWKVAPAIAVGCSVVVKPATLTPLTAIILGEICLEAGVPAGVVNVIPGSGREIGNHLVEHPNVNKVAFTGSTPVGKDIMGRASESLKRVTLELGGKSPNLVFEDADITAAVDGSLFGIFYNSGQSCEARSRLYIHEDIYDTFMEQFVAKTKQLVLGNPFDKGTHVGAIIDQQQLDVIDGYVQSAKADGATILTGGQVEKVAGFEEGFWYAPTIIADVTHDMKAVQEEIFGPVVVVMKFKDEKEAVRLANDTEFGLGSAIWTKDGARATRIANQIKAGIVMINCPFSAFPGTPFGGYKQSGFGRELCIETLDLYTETKSILSYYGSRPLNPFGL

SEQ ID NO: 25743 - protein, 385 aa, Exiguobacterium sp. 255-15
MHHVQLWNDVSEKGLKRFTDHYVVKQDIEAADAFLVRSKDLHGMKFPPSLKAVARAGVGVNNIPLDQLANRGIPVFSTPGANANAVKELVIASLFLTARKLIPSILWTNNLRGPDIPERIEANKKQFAGTELLGKRIGIVGLGAIGASLANTLHELGMTVSGYDPHMSVESAWRVSNQVHRVTNLEELLTTSDYITLHLPLIDSTQHLLDERLLGKVKQGATLLNFSRGELIDEQALATVLKSGRLSNYVTDFPNAFILSLPRVIPLPHIGASTAEAEENCAIMAVDQLKLFLETGNIRNAVNFPSVELPYAGKRRLTIAHQNIPNMVGQIASVLATEQINIANMINGSKDGIAYTIIDIDNHLDETISLEQLNAIPGVLKTRLL

SEQ ID NO: 25744 - protein, 328 aa, Exiguobacterium sp. 255-15
MMDVVFDYEDIQLIPAKSIVGSRSECDTTVEFGGRRFKLPVVPANMQTIIDEKIATFLAENGYFYIMHRFEPETRLNFVREMQQRGLIASISVGVKTEEYTFIETLAQEGLTPEYITIDIAHGHSEAVIRMIQHIKQILPESFVIAGNVGTPEAVRELEHAGADATKVGIGPGKVCITKIKTGFGTGGWQLAALRWCAKAASKPIIADGGIRTHGDIAKSVRFGATMVMIGSLFAGHEESPGEMQEVDGLQVKEYFGSASEFQKGEKKNVEGKKMFIEFKGSLSDTLTEMEQDLQSAISYAGGNKLQAIRTVDYVVVKNSIFNGDKVY

SEQ ID NO: 25745 - protein, 432 aa, Exiguobacterium sp. 255-15
MAMYLIRNNFKAAQPLMKEELGFSTTDLGYIGFAFSITYGIGKTLLGYFVDGKNTKRIISFLLILSAMIVTAMGLLMSAGGSPIGLLMVLWGLSGFFQSVGGPSSYSTITRWTPFEKRGRYLGFWNVSHNIGGAIAGGLALWGANVFFNGSVVGMFIFPAMIALTIGVIGLFIGKDDPEELGWNRSEEIFEEPIEPENLAAESMTKWEIFKTYVISNPWIWTLCIANVFVYIVRIGIDNWAPLYVTEHLHFSTASAVNTIFFFEIGALCGSLIWGYVSDLLKGRRALVATICLLLTAVAVLGYRYGTSETMIYASLFALGALIYGPQLLIGVSVISFAPKKATTVTNGMVGTFGYLLGDSIAKVGLAKIADPETNGLTIGSMTLHGWNDTFVVFNAALVLGVIALAIVAVVEEKKIRRLGLLEKQTKEKLSS

SEQ ID NO: 25746 - protein, 317 aa, Exiguobacterium sp. 255-15
MVMRIANSVLDLVGRTPIVKLNHLTGPEDADVYLKLEYMNPGSSVKDRIALAMIESAESAGHLKAGDTIIEPTSGNTGIGLAMVAAAKGYRSILVMPETMSMERRTLLRAYGAELILTAGPEGMKGAIARATAEAEEHGYFMPQQFNNESNPVVHEKTTGPEIVEAFEGLTLDAFIAGIGTGGTITGAGKVLREAFPGIEIIAVEPTDSPVLSGGKPGPHKLQGIGAGFVPSILDTQIYDSVEQVTTEEAFDHARRAAKSNGVLGGISSGAAIAAALKTAKRLGKGKTVLAIIPSNGERYLSTPLYQVEEETDSSKL

SEQ ID NO: 25747 - protein, 181 aa, Exiguobacterium sp. 255-15
MTLMNDMEKVLISEEEIQHKVGELAGELTADYGDRFPLLVCVLKGAMPFMSDLVKKMDMHLEMDFMDVSTYHGGTTSTGEVKIEKDLNTSVEGRDILIVEDIIDSGLTLGYLVDLFKYRKAKSVKIVTLLDKPSGRKNDLHADYSGFVIPHEFVVGYGLDYEEKYRNLPYVGVLKPAVYGG

SEQ ID NO: 25748 - protein, 278 aa, Exiguobacterium sp. 255-15
MGMVTIQELLERGDRVIATVRSQKKATLLIQLLREHAVSDANLEVEIVQLDQLDSVRRFADVLFDRIGRIDRLILNAGIMVPPYHVTKDGFESQFQVNYLSHFYLIERLLPLIEQGHDPRVISISSLAGEGGMIRTDIELEAIAHVRKEQYNPMKSYRESKLLQMVHMRELAEQYGTLATFVSVHPGIVNTDLFYRGKYGKVLKTVLKPVAQVGYWTGKLYTPEYGAKTALYLATTDDVIDNGGYYADSAPRLSNPVVEDEAYRQQARALSKRWVGLD

SEQ ID NO: 25749 - protein, 284 aa, Exiguobacterium sp. 255-15
MTLGLGTMTILKRGQEEAAEILRTALDEGIVHFDTADVYANGAVESLIGQTFSPEDRSRIFLASKGGNRMNDTGTGWTWDPSYDYLKKACFESLNRLETPYLDLYYVHGGTMEDDLDASIRAMKDLREEGRIKEYGISSLRPNVINYWLDHSDFSYLMTPYSLLDRRIEELLPRLQERNIKLVARGPLAKGLLTTESMSRLQSVDRFEQYDKEQLEHVLSTLQDYPLPAMALQAVDQQADIVLPGASSVSQLQANLQAMREPLTAEQIAHVLSLLPVHTYTEHR

SEQ ID NO: 25750 - protein, 323 aa, Crocosphaera watsonii WH 8501
MYNPKILCIGEILFDCLADQLGKELNEVTSWIAYPGGAPANVACGLIKLGISAAFIGCVGKDKPGDELVKILDKIGVNSTGIQRHTNAPTRQVYVTRSLTGERQFAGFGQIKTEDFADTRLNSQQLTSSLFTQAKYLVMGTLELAYTQSQQAIFKAIQLAKKYQLHILIDVNWRPVFWQNIETAKPLIIQVLQAADFIKCSEEEAHWLFKTEDPQEIAQQFPKIKGILVTLGEKGCHYYLGKNQGIVAGFSVKVMDTTGAGDSFVAGFLSQCCYYEEEILNNAARAKQTIIYSNAVGALTTTKPGAIAAQPSKEEVEIWLKNH

SEQ ID NO: 25751 - protein, 461 aa, Crocosphaera watsonii WH 8501
MKTIPTPKTPTLVQQLQWVLNPTGYLQTNHHRYPDLFKAKIIGLGNDIILISNPEIMQYILTHDRQEFTAPSSLNTLLKPLLGDYSVVMLDGDGHRQRRQLVMPSFHGERLKVYGDLTCRITREAMEKLPENQPFLAREVMQDISLKVIMEAVFGVTEGERYEELQYRLKELLDLFDSPITSGFLFFPSLQKDLGNWSPWGYFLRQRQALDKLIYAEISDRRANPDPERTDILSLLMFAKDEQGESMKDQELRDELITLLMAGHETTASAMAWALYWLHHIPEIKDKLIEELNTLSPDAEGMDIFRLPYLTAVCNETLRLSPSAMLTFTRLAQQTVEVGGYTFKPGDIVAGCLYLTHLREDIYANPKQFNPQRFLDHKYSAYEFIPFGGGSRRCMGEALAKFEMKLVIAIIISEYCLKLADTQPEKQQRRGLTLSPKRGVKMILEGKRQPQKARELELSTR

SEQ ID NO: 25752 - protein, 269 aa, Crocosphaera watsonii WH 8501
MPMGFPIEGFTSALQYQAQESDIFLVTYPKCGTTWTQYILWLMQHQGEPLSPSEKLETYIPHLEEVGKETVEKLPKPRVIKTHLPYNLTPYNPQAKYIYVARNPFDCLVSFYHHTRGFVQHYDFTDGTFDDFFECFIRGKVDFGDYFDNLVPWYEHKDDPNVLFFTYETMKADLKSIIIKIGNFLGNKYLYTVENESIINKIIVNSSLQKMKKDQQRWSSKRPENMPSFVRKGKVGSWKDYFSPEQKQRLTEKFIMKTAGTGLENLWLD

SEQ ID NO: 25753 - protein, 165 aa, Crocosphaera watsonii WH 8501
MFSLGISRYIFDMINNDRNNLLIIERKSKDIDRIMADTIDPNPTPLTGKALLQEIKSLSDKPRRETARECGYYSVTKEGQVRVNLTDFYDAVLAAKGVPLAPGATKDGRGREPTFRVSVHRNGQIVIGSTYTEQMGLKPGDEFEIKLGYKHIHLKQVGADEEEAA

SEQ ID NO: 25754 - protein, 320 aa, Crocosphaera watsonii WH 8501
MKIAHNITELIGHTPLVQLNRIPQAEGCKAQIVVKLEGMNPAASVKDRIGVNMINAAEKEGFIIPGKTLLVEPTSGNTGIALAMAAAAKGYKLILTMPETMSQERRAMLKAYGAQLELTPGSEGMGGCIRRGQELAETLPNAYMLQQFNNPANPEIHRLTTGEEIWEDTDGRVDFLIAGVGTGGTLTGVAEVIKQKKPSFQAIAVEPTSSPVLSGGSPGGHKIQGIGAGFVPGVLKVELIDEVVTVTDEEAMSYGRRLAKEEGLLSGISTGAALCAAIKVGQRPENIGKLIVMVQPSFGERYLSTPLFQDVEPPQLAMVH

SEQ ID NO: 25755 - protein, 257 aa, Crocosphaera watsonii WH 8501
MMGMGLGLKIVDFKRVLVEPKGVILGLVAQLIVLPLVGFVLASIFPLTPELAVGVIILGACPGGATSNVISYLVRGNVALPITLTAISSLVTIISIPLVINLGMQMFMGADTTLQLPILTTITQIAVITLLPISLGMFINKSQPRLAAKLENIVKWLSLFFLGLIIFGLLLKERANLLPFFLQVGGVTLSLNLITMFLGYAIATFAKLDDKSRKTITVEPEFLTKSAIAKHRSLTGSGFEQSDRRFPQPTVCCQILS

SEQ ID NO: 25756 - protein, 464 aa, Crocosphaera watsonii WH 8501
MLKTDSIDIVIRKQRDFFSSGTTQDINFRKQQLKNLRNLIDDNENEILEALHKDLKKTEFEGCLTAVIGAKIEIDYALKNINKWTKAKKVSVPIDQLPGKAFIQPQAKGVVLIISPWNYPFHLAIVPLVGAIAAGNCAIIKPSELTPNTSKVIAKIINNNFDENYIRVIEGAKETSQKLLEQKFDHIFFTGGSSIGKIVMEAAAKHLTPVTLELGGKSPCIIDTNINVKETAKRIAWGKFLNNGQTCVAPDYLLVNRQIKKELLEAIIEATKNLYGDDPATSPDYGRIVNHHHFNRLCALLEPGKIVLGGQVIPEENYISPTIIDEVSPDFPIMEDEIFGPILPILEYDRLEEAIAFINERPRPLALYLFSNDKKQQKIIVQKTISGGVCINHTIMHLGVLDLPFGGVGNSGMGSYHGKASFDTFSHQKSVLKRSFFLGTDLLFPPYKDKLKWIKLGLCIKNNC

SEQ ID NO: 25757 - protein, 424 aa, Crocosphaera watsonii WH 8501
MRIKRIIASEMLDSRGNPTVEAQVMLEDGTVGSALVPSGASTGEKEAVEMRDGDKSRYKGKGVLKAVENANNHLAPALIGMDVTQQRAIDQTMIDLDGTPNKAKMGANAILAISLAAARTAANYLKMPLYRYLGGTNASLLPVPCMNVINGGSHADNTVDFQEFMIAPHNAPSFAEAIRMGAETFHTLKGLLKDKGLSTGIGDEGGFAPNLKSNEDAIEFIIEAIEAAGYKPGEDISICLDPATSELWKDGKYLFFKSDNSTKTPSEMVALWQDWMNKYPIVSLEDGMGENDWDGWKELTDKIGDKVELVGDDLFCTNPTILAEGIEKGVANSVLIKVNQIGSLTETLDTIELAKKHNYKCFVSHRSGETEDTTIADLVVATSAGQIKTGSGCRGERIAKFNQLLRIERDLGKAARFAGKAAFL

SEQ ID NO: 25758 - protein, 191 aa, Crocosphaera watsonii WH 8501
MDAGKATLCGEESFGTGSNHIREKDGLWAVLFWLNILAVKGESVEKIVRDHWQVYGRNFYSRHDYEEVESGPANELMERLRSQVGEMKGKTYGNYEVDYADDFAYTDPVDGSVSQKQGIRIGFTDGSRIVFRLSGTGTKGATLRVYIESYEPDANKHGVETQEALSPLIQLAEEIAQIKQFTGRDKPTVIT

SEQ ID NO: 25759 - protein, 218 aa, Crocosphaera watsonii WH 8501
MSSLVSDHPSSNAIPLDKIRYNEQGLVPAIAQDYLDGTVLMLAWMNKESLQKTLETGEVWYWSRSRQELWHKGATSGHFQKVKSIRYDCDSDALLITIEQVGDIACHKGERSCFHQLEENEKAAPPADTLSGLYEVICQRRDHPVEGSYTRKLLAGGDNKILKKIGEESAEVVMACKDDEKEAIASEVADLFYHTLVALSYHHVDIKDVFRKLQERKK

SEQ ID NO: 25760 - protein, 262 aa, Crocosphaera watsonii WH 8501
MKVAVFSTRSYDSQFLDLANKEIDSPHEIEYFKTQLNPKTASLAKDFPCVCIFVNDIANAETLKILAAQGTKLIALRCAGYNMIDMHAANELGLKVVRVPAYSPYAVAEHAVGLILMLNRKLNKAYNRVRDDNFTLDGLLGFDLHESTVGVIGTGKIGTIFAQIMKGFGCNLLGYDVYPSEQFKAIPGAKYVDLPELLATSDIISLHCPLLPSTNHIINEKTIEQMKKGMMLINTSRGQLVDTRAVIKGIKSGKIGYVGLDV

SEQ ID NO: 25761 - protein, 346 aa, Crocosphaera watsonii WH 8501
MSRYAEELRTTAKAMVARGKGILAMDESNGTCNKRFDKLGIPTTEEYRQIYRSLILQTPELSNYISGPILYDETIRQTTPDGVPLLKIITDAGMIPGIKVDTGAKDLAGCPNEKVTEGLDGLRDRIAEYYSMGARFAKWRAVITIGNGIPSRGCIKANAHGLARYAALCQEGGLVPIVEPEVLIDGDHTLERCWNVTDETLHEVFNQLYTQNVAFDQMVLKPSMVISGKDCPQQASVEEVAKATISCLLKNVPATVAGIAFLSGGQSKEQSSAHLNAMNQMFGDQCPWPVTFSYARAIQQPALDYWAGDSSRISGAQTRLLKRAQCNGAASLGEYSSEMEKTLATV

SEQ ID NO: 25762 - protein, 1003 aa, Crocosphaera watsonii WH 8501
MNNTQHKVRIYDLSKELNLENKDILEICGQLNIAVKSHSSTITESDAERIKVMVDKYLAQQGTAQAKDEEASKDKKQQILAVKQVRPRPAPKASKNLQPNLMSPRTPVPPKPPVTQTPLQKPAPPTASELPKVTPQVPSQPSNPPEKAPSQPEPAPTSLLEPPQRVKSPVKAVLETPQKPVTKPTKNKPSPEGKNKVKPAKKAGKNSPPKPKDKPQKPTISKPEGSKNKPTTVKNLKKPNTSKPDIKRPVPPQAEEEQKTLTLVAPSVKPTPEIIEEEDDNDDTIETVLKPKPQLKRPAPPRISKRKTWDEEEDEQENKAKANKASNKAKRRFQVIEDDDDDFESELNANPVSLSLSLSTARPPKPKSSSKPTTTTQKPKKPTLKAADNSGESNRTERKERTEVRQKPEKIVLDRNLTVRELSEQLCLAETEIIKHLFSKGIAVNITETLDQDTAKIVTEAFGIEVEIPEIQSAATKSTEMLDEQDLENLQRRPPVVTIMGHVDHGKTTLLDSIRQTKVAQGEAGGITQHIGAYHVDIDHEDKTQQIVFLDTPGHEAFTAMRARGTRVTDMAILVVAADDGVQPQTREAISHARAAEVPIVVAINKIDKPEANPDRIKQELSELSLVPEEWGGDTIMVPVSALKGENLDGLLEMLVLVSEVEELVANPDRLAKGTVIEANLDRTRGPVATLLIQNGTLRVGDAIVAGSVFGKIRAMIDDRGNKVEEASPSFAVEILGLNSVPAAGDEFDVYPSEKEARLVAEENAENQRQTRLQQAMSSRRVTLSTLSAQAQEGELKELNLIIKADVQGSIEAILGSLEQLPQDEVQIRVLLASPGEVTETDVDLAAASGAVIIGFNTTLASGARGAADNEGVDIREYDIIYKLLDDIEGAMEGLLEPEEVESSLGQAQVRAVFPVGRGAVAGCYVQSGKVVRNRYIRVLRGNKVVYEGTLDSLKRIKEDVREVNSGYECGIGIDKFSDWQESDTIEAYEMVMKRRTLAGKSS

SEQ ID NO: 25763 - protein, 322 aa, Crocosphaera watsonii WH 8501
MTIRTVTTTPFEGQKPGTSGLRKAVSVFQEQNYLENFIQSILDSLDGCEGQTLVVGGDGRYYNRQAIQIILKMAAANNIGRILVGTNGIFSTPAASAVIRKNNAFGGIILSASHNPGGPKGDFGVKYNVGNGGPAPEKVTNAIFERTKTIDEYKILEAGDINLDRPGSFKLGTMDVEVMDSVNPYVELMQELFDFDKIKSMVSSDNFKMCMDSLHAVTGPYARALFEQFLGAKEGTVQNGIPLEDFGGGHPDPNLVYAHDLVEIMFGDNAPDFGAASDGDGDRNMVLGKNFFVTPSDSLAVLTARATLVPGYKDGIAGGARS

SEQ ID NO: 25764 - protein, 427 aa, Crocosphaera watsonii WH 8501
MKTTKSEEIFAAAQKLMPGGVSSPVRAFKSVGGQPIVFDHVKGAYIWDVDGNQYIDYVGTWGPAICGHAHPDVIAALHNSLDKGTSFGAPCSLENTLAEMVIDAVPSIEMVRFVNSGTEACMSVLRLMRAFTGRDKIIKFEGCYHGHADMFLVKAGSGVATLGLPDSPGVPKNTTANTLTAPYNDLEAVKALFAENPDQIAGVILEPVVGNSGFVVPDGGFLAGLRELTQENGALLVFDEVMTGFRISYGGAQAKFGVTPDLTTLGKVIGGGLPVGAYGGRQDIMSMVAPAGPMYQAGTLSGNPLAMTAGIKTLELLQKPGTYQQLEQITQQLSEGLIKIGKDAGHSVCGGYVGAMFGLFFTEGPVKSYDDAKKSDTAKFGRFHRGMLEKGIYLAPSQFEAGFTSLAHTSEDIDKTLAAAKEVFADL

SEQ ID NO: 25765 - protein, 149 aa, Crocosphaera watsonii WH 8501
MFQSIKTYAIAIIMGCILSLFSSLWSPAALAVTNIKLLDLSYKDCPPELAEGNVTSGGSSLAAACYLITGKAKNTSGKTVYDADVFGRILDANNEPTLQNRNRVGSIAEVPPGVSDFEVRITVPANQPTPLKLKNFKASGFTTKVTPIF

SEQ ID NO: 25766 - protein, 477 aa, Crocosphaera watsonii WH 8501
MSESGFDYDLIIIGAGVGGHGAALHAVKCGLKTAIIEAKDMGGTCVNRGCIPSKALLAASGKVRELQDTKHLHNLGIEIDGVDFQREAIADHATNLVNKIRGDLTNSLKRLKVDTIHGWGKIVDTQKVSVLGDDGEKIITAKDIMLCPGSVPFVPRGIEVDHKTVFTSDEAVKLEVLPQWIAIIGSGYIGLEFSDIYTALGCEVTMIEALDTLMPGFDPEISKLAERSLIKARDIETYSGVFATKITPGAPVTIELTDAQSKEVIDVLEVDACLVATGRVPATKNLGLENIGVETNRGFIPVNDKMEVLRDGEPVPHLWAVGDANGKMMLAHAASGQGEIAVENMCGREKTIDYRSIPAAAFTHPEISYVGLTEPAARELGEKEGFEVSSVKTYFKGNSKALAEGETDGIAKVVYRKDNGELLGVHIMGIHASDLIQEAANAIAQRQSVKNLSFNIHTHPTLSEVLDEAFKRAEATV

SEQ ID NO: 25767 - protein, 288 aa, Crocosphaera watsonii WH 8501
MVISLAHLGPVGTNAETAALAYAHWLEKTQAKSCLLCPCPSIAQTLHSVAQGDTKKAVVPVENSTEGSVACTLDTLWKLDHLKIQQELVLPIIHALFSRGSSINGIKTVYSHPQALAQCQRWLQEHLPDIALIPTNSTAEALDKISLEPTAGAIAAPRAAKLYNVPILANHINDYPDNCTRFWVMTLDPTPTVSSRISLAFSVSENVPGSLMKPLQVFSERNINLSRIESRPTKRSLGEYLFYLDIEGNHEDPNIINALDALTHHTEIIKIYGSYPVLFLEETDIEQL

SEQ ID NO: 25768 - protein, 473 aa, Crocosphaera watsonii WH 8501
MTKRTFGVIGLAVMGENLALNVESRGFPIAVYNRTASKTEEFMKTRAQGKDVKAAYSLEEFVKTLERPRKILVMVKAGAPVDYVIEDLKPLLEEGDMIIDGGNSLYEDTERRTRDLESTGLGFVGMGVSGGEEGALKGPSLMPGGTKAAYEELEPILTKIAAQVDDGPCVTFVGPGGAGHYVKMVHNGIEYGDMQLIAEAYDIMKNALGLSNEELHEVFKEWNTTDELNSFLIEITADIFKYVDPDSKKHLVDLILDSAGQKGTGRWTVVSSLELGVPIPTMYAAVNARVMSSYKEERESASHQLTGPAIKFDGDKKAFINKVRDALYCSKMCSYAQGMALIAKASAEYYGNQVSLPESARIWKGGCIIRAGFLDKIKKAFVDNPDLPNLLLAPEFKQSILDRQEAWREVLVLANQVGIPVPAFSASLDYFDSYRRADLPQNLTQAQRDYFGAHTYERVDKPKGEAFHTEWAA

SEQ ID NO: 25769 - protein, 406 aa, Crocosphaera watsonii WH 8501
MYSSALGATSGQTTAYGSRMFVYEVVGLSQNTDNDSLDYPIRRSGSVFITVPYGRMNQEMRRISRMGGRIVSIQPVDAETPLKSTSNGSSTAKVAQPQASNQTEKKRKSMTQAKTKIPTNIYRQKSPYVGKCIENYALVAEGGSGIVQHVTFDISGGDLHYLEGQSLAIIPPGTDAKGKPHKSRLYSIASTRHGDKVDDKTISLCVRQLEYEHPETKETVYGVCSTYLCNLEVGADVAMWGPVGKEMLLPDEEDANIIMLATGTGIAPFRSFLWRMFFENNPEYKFKGKSWLIFGVPYSANVLYKDQLEEIQTKYPDNFDLTYAISREQKNSEGGRMYIQHRVAEQAEKLWTMLQDPKTHLYMCGLKGMESGLEEGLRDFASKQGVEWPDFVKQLKKEHRWHVEVY

SEQ ID NO: 25770 - protein, 197 aa, Crocosphaera watsonii WH 8501
MLGEMWSLRGRYKILHMTWFAFFLSFVVWFNLAPLATQVKADFGLEVSQIRTLAICNVALTVPARIIIGMLLDRYGPRITYTLLLMYAAIPCLIFATAQSFTQLVIGRLMLGIVGAGFVIGIRMVAEWFPPKEIGLAEGIYGGWGNFGSAAAAFTLPTIGGWFAFGALSPAGDPLQLEALHRWNGHYRSAVWDFILQ

SEQ ID NO: 25771 - protein, 300 aa, Crocosphaera watsonii WH 8501
MVMNAPLSGILMVLAWRLTKVGFYGVNTMYIVWACLIGLYLFQAYNCWVVNKDLMTGKKQYPAKDRYRFSQVAILELTYIVNFGSELAVVSMLPTFFEGTFTLTPAQAGMIASSYAFMNLMSRPGGGLISDKLGSRKNTMAVLTLCMGIGYLMMGTVSSSWWLPGAIILTMACSFFVQAGEGSTFAIVPLVKRRITGQVAGNVGAYGNVGAVAYLTIFSLLPEWLGGGKDPSAAIIAQANTAFFQIMGIMAVIVAFLCWFILKEPEGSFAEHHEGEEEDLGLSPVAVMESNTSLDSVSRG

SEQ ID NO: 25772 - protein, 443 aa, Crocosphaera watsonii WH 8501
MNLPPTLSQPRLLRLFKLIFYPLDYLEDNYQRYGDIFVAGKSETPFVYISNPQGIQTILTRDKTDFKTGGGSGFLSTLLGDNSLLFLQGERHRRERKLLMPPFHGERLKSYANLIYSISDKVTDKLQINRSFNVRDIMQEITLKVILKAVFGITEGERYQRLQELLKSWLSFFDSPANAILIFFPWLRKNWGNWTPWGRFLQIKAEIQELIYTEIRERREQKKYEGTDILTLLMLAKDEEGKPLSDQELHDELITLLIAGHETTASALTWALYWIHFCPDVEDKLRFHFSNLNNNTDLLDIVKLPYLDAVCKETLRIYPVLLTTFIRVLQTPLELMGYQFKPGTVFAPAIYLVHHREDIYPNSQQFRPERFLERNFSPYEYFPFGGGSRRCIGMELAKMEMKIVLYTILSKHKLKLPSSRPLKAVRRGLTVAPPSNFKMILSN

SEQ ID NO: 25773 - protein, 164 aa, Crocosphaera watsonii WH 8501
MKRLFALILVAALWFSFAPTATAAYDNLTPCSENPAYQQKSKNFLNTTNDPLSGQKRAERYAEALCGPEGYPHLVVDGNFAHAGDFTIPGLMFLYIAGWIGWVGRAYLIAVRDEKNSEMKEIIIDVPLAISKMLTGFIWPVAAFRELVTGKLTAKDSEINVSPR

SEQ ID NO: 25774 - protein, 298 aa, Crocosphaera watsonii WH 8501
MKQLSSLSSAQLSNWLMEASQEAKKGKLADYIPLLQRTDSSLLFICVVTKNNIFLTQGDSKITFSLMSIIKPFLLLYLLSELGDNFIFTKVGSEHSNYPFNSLDQLQLDQGFPRNPMINSGALTLASLLPGKDSHTRLNNLQEWLNKQSNANLFLDKLMLKSVESLPNLRNQSIIDNLTQRKHLKEPEITLDTYNKICCLSATIIDLAKLGLLLVNSPNISSKNVSIVTEIMTTCGLYEASENFAKKIGFPSKSGVSGAILSIVPKEGAIACYSPPLDAQGNSLGGLYMLQKIANYLN

SEQ ID NO: 25775 - protein, 353 aa, Crocosphaera watsonii WH 8501
MLRTLFPIVLTVSLVATPYVGMTQSIEQLFQQGNQAQNEGRYREAESIWRQIISIDSNNAIAYFYIGLALRKQGKLEEATAAYKKAIELDPNYSFAYNNMGNALRKQGKLEEAIAAYKKAIELDPNDAFAYNNMGLALDDQGKLEEAIAAYKKAIELDPNYATAYYNMGNALNRQGKLEEAIAAYKKAIELDPNYSFAYNNMGVALRKQGKYDEAIAAYKKAIEINPNYAFAYNNMGVALRKQGKYDEAIAAYKKAIEINPNDAFGYNNMGLALDDQGKYDEAIAAHKKALEIDPNLVLAQNNLKEAERLLAINNNPPLPNIDDRDYLPTETQEGLVQLGESNPPDFYRNFRD

SEQ ID NO: 25776 - protein, 394 aa, Crocosphaera watsonii WH 8501
MSLSWMPRADRLNALPPYVFARLDELKAKAREQGLDLIDLGMGNPDGMAPQPVIDGAIAALQKPQTHGYPPFEGTASFREAITAWYRRCYRVDLDPSSEALPLIGSKEGLGHLALAYINPGDVVLVPSPSYPAHFRGPLIAGADLYPLILSAEKDWLIDLNSIPENVAKAAKILYFNYPNNPTTATAPRAFFEEIIKWATHYEIMLVHDLCYAELAFDGYQPTSLLEIPGGREIGVEFHTLSKTYNMAGWRVGFVVGNGEIIQGLRTLKTNLDYGIFSAVQAAAETALNLPDSYIKTVQERYQTRRDFLIKGLGELGWNIKPSQATMYLWVPCPTNTNSTDFALDVLEKTGIVFTPGNAFGEGGEGYVRISLIADCDLLGEALNRLKQAGIYYK

SEQ ID NO: 25777 - protein, 496 aa, Crocosphaera watsonii WH 8501
MVSTRTKKDVPIWQPLKVIARSFSPYWIACIPLAAIITIVWNKAVVAESVELITAEGNSEAIAQLQGTLNAIWVLIAAILVIFMNAGFGMLETGFCRQKNAVNILSKNLIVFALATLAYWAIGYSLMFGGPENPFIGFGGWFLSGEPATYGLDPFPAGLPISVAFLFQAAFAGTAATIVSGAVAERIKFTDFIIFSLLLVGISYPITGHWVWTGNGWLGSIGFSDFAGSTVVHSVGGWAALMGAAILGPRMGKYVEGRPQAIPGHNMSIATLGCLILWIGWFGFNPGSQLAADEAVPYIAVTTNLAAAAGGVAATFVAWFKDGKPDLSMIINGILAGLVGITAGCDGVSYFGAVIIGAVAGVIVVYSVSMIDSLLKIDDPVGAVSVHLVNGIWGTLAVGLFNTESGLFYGGGFAQLGSQIVGIVAIGAFTAIFSGIVWTVLKSTMGIRVSPEEELEGLDVGEHGMEAYAGFLKETDTFSGSGSSTADEDVTTGAGI

SEQ ID NO: 25778 - protein, 165 aa, Crocosphaera watsonii WH 8501
MFFIQSPIATLGCLILWFGWFGFNAGSTLELNSPAVAHILVNTLVAGATGGIIGTLSAWFMFDNKPSLTFIINGILAGCVSITASCAYVHLLSAVFIGMVGGWFVVWATDFIDRFGIDDPVGAIPVHLFCGFWGTLAVGFFSAGPGVVDWVISEKAFPIGGNRLD

SEQ ID NO: 25779 - protein, 446 aa, Crocosphaera watsonii WH 8501
MLTFNPSLTPSLQESSLLTDLYQLTMAACYAGEGIAEKKASFELFVRRLPDNFGYLIAMGLAQGLQYLENLRFSAEQIDYLQSTGIFDHVTPYFWSLLQNQGFTGDVWAVPEGIPIFANEPLLRVEAPLWQAQIVETYLLNTINYQTLIATRAARMRDIAGEKAILLEFGTRRAFSPQGAIWAARAALGAGFDATSNVLAAKELNQQPSGTMAHALVMAIKGLSGSEDEAFMAFNRHFPGATLLIDTYDTLAAAQRLAENREIEIKGVRVDSGDLGSLSQKVRSLLPKVNIFASGDIDEWELQRLRSENALFDGYGVGTRLVTGHPVNGVYKLVEIDNVPTMKQSSNKMTYPGRKQIFRRYNNGIIESDRLALIEEEIESGETPLLELVITEGNLLKENESLDTIRQRVQTSLKSLPEDTHKITKPSPIQVNISQPLETLRQSLIV

SEQ ID NO: 25780 - protein, 130 aa, Methylobacillus flagellatus KT
MSDTWLDKVHWTPDGLVPVIAQEAGTNKVLMFAWMNRESLRLTAETGQAVYWSRSRNRLWHKGEESGHVQKVHEIRLDCDEDVILILVEQVGGIACHTGRHNCFFQKLEQDGWVTDQAIIKNPEDIYHHE

SEQ ID NO: 25781 - protein, 268 aa, Methylobacillus flagellatus KT
MSDNIVEIDNLSFGYKTRLLHKGINMKFPRGKVVAIMGGSGSGKTTLLRLIGGQLKPSGGEVRVTGEVVHKQDRKGLQKLRRKMGMLFQQGALFTDLSVYENVAFPIREHTDLPESMIRDLVMMKLNAVGLRGARNLKATELSGGMARRVALARAVALDPSIIMYDEPFAGLDPISMAVICNLIRKLNDALGATSIIVTHDVQEVFAFADYVYFVADGVVAAEGVPDDLRKSEMPFVHQFVHGEVDGPVPFHYAAPDYRQDILRSVNV

SEQ ID NO: 25782 - protein, 359 aa, Methylobacillus flagellatus KT
MSIEIRNIKKEFGSFTALGNVSLDVPSGELVALLGPSGCGKTTLLRIIAGLETPDSGSIHFHGEEATNRDVRERQVGFVFQHYALFRHMTVFENVAFGLRVRPKKTRPSDAEIHRRVHQLLSLVQLDWLADRYPPQLSGGQRQRIALARALAVEPKVLLLDEPFGALDAKVRKDLRRWLRRLHDELHITSVFVTHDQEEALEVADRIVVMNQGKIEQIGSPQEVYDNPASPFVYKFLGNVNQFYSRVDQGQAHIGNIALNLNEHHTVQNSDALAYVRPHDIDIYTEQNGHPALQAVVSYIHAAGPLVRLELQPVNEADIIEAEITRERFRELGIDQGSHVYLRPRSVQVFLEGNTSNAA

SEQ ID NO: 25783 - protein, 212 aa, Methylobacillus flagellatus KT
MSHLEAASLTLVGGTVWEALVVRAALRVGESILIHGGVGGVGHVAIQVAKAMGARVFTTVREANFEFARTLGADVVIDYEKEDYVDAIMRETGGHGVDVVFDTIGGNTLSRSPDTLAQLGRIVTIVDTSLPQNLVQAWGKNASYHFVFTRQNRGKLDELSALIERGQLRPHIGAVYSLADIPLAHALLETPNNGLRGKIAIAVEPSSHTESA

SEQ ID NO: 25784 - protein, 437 aa, Methylobacillus flagellatus KT
MPISLLPLTLLFSLCIVPLPVSAGEGAPQALAVDSVWVAISGALVFMMQAGFAMLESGMTRAKNAVNVMMKNYMDLAVGALLFWLVGYGLMFGSNPSGWIGTDHFALAHGDDWGASMLFFQVMFAATAATIVSGAMAERTNFIAYLLGACGIMALIYPVFGSWAWNEHGWLKQMGFIDFAGSTVVHSVGAWCALAGIMVLGPRLGRFGSKGEVHMIPGHNLSLVAMGGFLLWFGWFGFNGGSTLAAGVEIGPILLNTHMAGAAGAVGALLVALAMRRPILMAYVVNGSLGGLVAITAGCASMDVPFAVLTGFIGGIVTMLGVWALEKLRLDDVVGAVAVHGFSGVWGTVAAGLFLKDNMFDLNQVLVQMIGVAVAFVWVFLSALLMYGLLARTIGLRVSTMHEQRGLDITEHGEVGYPEFNREAAYQPEHVQHLSRL

SEQ ID NO: 25785 - protein, 250 aa, Methylobacillus flagellatus KT
MRRKLVVGNWKMNGNLAQNKRLLEALVRGLQDVEHVDIAVCVPYPYLFQAQKILSGTNIAWGAQNVAKHENGAYTGEVSAAMLKEFGASYVIVGHSERSDAYCESNANIAEKFAIAKHYGITPIFCVGETLQERESGVMEYAIANQLDAVLSVSGGALLDQAVIAYEPVWAIGTNRTATPEQARAAHSFIRERIAAMHPGAAESVRIIYGGSVNPRNAAQLLSMPDIDGGLIGRCSLDADDFERICRAAC

SEQ ID NO: 25786 - protein, 256 aa, Methylobacillus flagellatus KT
MNSQHTRPICEIRKVWTVFGSNVVHQDLDLSINAGEIISLVGGSGSGKTTLLRHIVGLTRPTKGEVLLFGKNLHEMDRVPQQRLMNRLGMLFQQGALFSALTVFDNIAFPLRELKQFDEATIHQLVLHKLSLVEMEPDTGSRLPSQLSGGMIKRVALARALALEPELLLLDEPTAGLDPDRSEKFVELIKSIKHSLGLTVIFVTHDLDTLVSLTDKVAVLADKHIVANCGLRELGNIDHPFVQNFFQGVRVRLERT

SEQ ID NO: 25787 - protein, 185 aa, Methylobacillus flagellatus KT
MVVLEGNPDLILQRSTLVSSEEEVKQAVTRVAQEITATLRQDQPLVLCVMGGGVVFTGQLLPQLVFPLEFGYVQATRYHNRTHGDAQLVWKMKPGEEVRGRTVLLLDDILDEGVTLAEIKAQCLALGASKVVVAVLVEKMLGRVKPIRADFVGLEVPDQYVFGCGMDAYGWWRNLPAIYAMQGEA

SEQ ID NO: 25788 - protein, 217 aa, Methylobacillus flagellatus KT
MERASKVAVVAADFDWSDIGSWSAMAELVQSDERGNRVNGEALLVDANNCYIQSDSRLVAGIGIDNLLVVDTPDALLVAHHSRAQDVKTVVKQLKLESHSAANYHRKVHRPWGTYTVLEEGANFKIKCIKVKPGASLSLQMHHHRSEHWVVVSGIAKVVNGERELLINANESTYIPAGHKHRLENPGLLDLVIIEVQSGEYLGEDDIVRFQDIYGRT

SEQ ID NO: 25789 - protein, 486 aa, Methylobacillus flagellatus KT
MRLLQQALTFDDVLLVPAHSNVLPREVSLATKLTRSITLNIPLISAAMDTVTEAPLAIALAQEGGMGIVHKNMSIKDQAAHVSRVKRFESGVVHDPVTIQPNLTVRDVLALTRQHKISGLPVVDGKKVVGIVTNRDLRFETNLDQAISNIMTPRERLVTVREGASLEEATALLHKHRLERVLVVNDAFELKGLITVKDIQKSSDHPNACKDEKGRLRVGAAVGVGDGTEERVAALAEAGVDVIVVDTAHGHSQGVLDRVNWVKKNFPHIQVIGGNIATANAAKALVDAGADGVKVGIGPGSICTTRIVAGVGVPQISAVSNVEEALRGTGVPFIADGGIRFSGDIAKAIAAGAYSVMLGGMFAGTEEAPGEIELFQGRSYKSYRGMGSIGAMEKGSSDRYFQDNNGNVDKLVPEGIEGRVPYKGSVLAVIHQLMGGLRASMGYVGCSTIEEMRTRAEFVQITAAGMRESHVHDVQITKEAPNYRID

SEQ ID NO: 25790 - protein, 438 aa, Haemophilus influenzae R2846
MPTLEKTFELKQRGSTVRQEIIAGLTTFLAMVYSVIVVPNMLGVAGFPAESVFIATCLVAGLGSILIGLWANAPMAIGCAISLTAFTAFSLVIGQKVAIPVALGAVFLMGVVFTLISTTGIRAWILRNLPSNIAHGAGIGIGLFLLLIAANGVGLVVSNQAGLPVKLGDFTSFPVMMSLIGLALIIGLEKMKIKGGILWVIIAITIVGLIFDPNVKFGGEIFKMPTFGENYLFLQLDFMGALQPAILPVVFALVMTAVFDATGTIRAVAGQADLLDKDGQIINGGKALTSDSISSLFSGLFGTAPAAVYIESAAGTAAGGKTGITAIVVGVLFLLMLFFQPLAFLVPGYATAPALMYVGLLMLSNVSKLDFDDFVGAMSGLICAVFIVLTANIVTGIMLGFAALVIGRIVSGDIKRLNVGTVIIAIVLVAFYAGGWAI

SEQ ID NO: 25791 - protein, 263 aa, Haemophilus influenzae R2846
MARRPLVMGNWKLNGSKAFTKELIEGLKAELHDVTGCDVAIAPPVMYLGTAEAALSGCGCNCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 25792 - protein, 264 aa, Haemophilus influenzae R2846
MDKSLKANCIGEFLGTALLIFFGVGCVAALKVAGASFGLWEISIMWGMGVALAVYATAGLSGAHLNPAVTIALWKFACFDGKKVIPYIISQILGAFFAAALVYALYRNVFIDYETVHNIVRGTQESLSLAGTFSTYPHPSLSIGGAFAVEFVITAILMALIMALTDDGNGVPRGPLAPLLIGILIAVIGGAMGPLTGFAMNPARDFGPKFFAYLAGWGELALTGGREIPYFIVPMVAPVLGALAGAWLYKKAIGGNLPCNCGCE

SEQ ID NO: 25793 - protein, 453 aa, Haemophilus influenzae R2846
MFAGIFFGYAAYYFVRANFDLAQKGLIEAGMYNKAELGIIGTGAGLAYGLSKFFMASISDRSNPKVFLPFGLLLSGLCMTMMGLMPWATSGIAVMFIMIFLNGWFQGMGWPPCGRTMVHWWSKSERGSIVSIWNTAHNLGGMVPGAMVLLASAVYFSIHGVEATAKDVWQQALYYPGIAAMIAAIPIYFMMKDTPQSCGLPPIEKWRNDYPDDYNEKTYEHDLSTKDIFVTYVLKNRLLWYIAIANVFVYLIRYGVLKWSPVYLGEVKHFNIKGTAWAYTIYELAAVPGTLLCGWVSDEVFKGKRGLTGFIFMTLTTAAVVALWLNPATPEAELAKYAGHAWYENPYQLMDFILMTTIGFLIYGPVMLIGLHALELAPKKAAGTSAGFTGLFGYLGGTVSASAVVGWAAEYYGWDGGFYVMIGGGVLAVLLLLIVMVEEGKHKAKLGDTYGTK

SEQ ID NO: 25794 - protein, 179 aa, Haemophilus influenzae R2846
MKKHHVDVLISENDVHARIAELGAQITKFYQEKQIDSLVVVGLLRGSFMFMADIVRQINLPVEIEFMTTSSYGTGMTTNHDVRITKDLDGDIKGKHVLIVEDIIDTGYTLEKVRDILNLREPASLTICTLLDKPSRREVEVPVEWVGFEIPDEFVVGYGIDYAQRHRNLGYIGKVVLEE

SEQ ID NO: 25795 - protein, 385 aa, Haemophilus influenzae R2846
MALELSDIRQQITQIDRSLLKLLSERHRLAFDVVRSKEISQKSLRDVEREQQLLQELVQFAENENYQLEAQYITSIFQKIIEDSVLTQQVYLQNKLNEQRNQNLHIAFLGKRGSYSNLAARSYAARYQKQFVELGCQSFEQVFEKVQTEEADFGVLPLENTTSGAINEVYDLLQHTDLSLVGELAYPIKHCVLVNDKTDLNQIDTLYSHPQVIQQCSQFIHSLDRVHIEYCESSSHAMQLVASLNKPNIAALGNEDGGKLYGLSVLKTNIANQENNITRFIVVAKEPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 25796 - protein, 407 aa, Haemophilus influenzae R2846
MTNKVNSYGWKALIGSAVGYAMDGFDLLILGFMLSAISADLNLTPAQGGSLVTWTLIGAVFGGILFGALSDKYGRVRVLTWTILLFAVFTGLCAIAQGYWDLLIYRTIAGIGLGGEFGIGMALAAEAWPARHRAKAASYVALGWQVGVLGAALLTPLLLPHIGWRGMFLVGIFPAFVAWFLRSHLHEPEIFTQKQTALSTQSSFTDKLRSFQLLIKDKATSKISLGIVVLTSVQNFGYYGIMIWLPNFLSKQLGFSLTKSGLWTAVTVCGMMAGIWIFGQLADRIGRKPSFLLFQLGAVISIVVYSQLTDPDIMLLAGAFLGMFVNGMLGGYGALMAEAYPTEARATAQNVLFNIGRAVGGFGPVVVGAVVLAYSFQTAIALLAIIYVIDMLATIFLIPELKGKALD

SEQ ID NO: 25797 - protein, 316 aa, Haemophilus influenzae R2846
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 25798 - protein, 436 aa, Haemophilus influenzae R2846
MAKIVKVIGREIIDSRGNPTVEAEVHLEGGFVGLAAAPSGASTGSREALELRDGEKSRFLGKGVLKAVAAVNNEIAQAIVGKDATNQAEIDQIMIDLDGTENKSNFGANAILAVSLANAKAAAASKGLPLYAYIAELNGTAGIYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 25799 - protein, 196 aa, Haemophilus influenzae R2846
MIDFDGYRPNVGIVICNRKGQVLWAKRCGQNSWQFPQGGINDNESAEQAMYRELHEEVGLQPKDVRLLYVSKHWLRYKLPKRLLRYDSKPMCIGQKQRWFLLQLVSDEKNINMQTTKSPEFDGWRWVSFWYPVRQVVSFKRDVYRKVMKEFASILFTDNPLIFSASREASLQHYSANKKYSQTKYTKRHFYKSRGQ

SEQ ID NO: 25800 - protein, 472 aa, Haemophilus influenzae R2846
MPNANAIANVFKLIEENNVKFVLLRFTDIKGKEHGVSIPVSLVDEEMFEDGKMFDGSSVEGWKTINKADMLLMPMAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGFEAPVLLAYSASNRSASIRIPAVTNPKAIRIEARFPDPLANPYLAFAALLMAGLDGVVNKIHPGDAMDKNLYDLPPEELKDIPAVASSLEEALNSLEKDYEFLTQGGVFAKDFIDVFISIKRKEVERLNMAPHPVEFEMYYA

SEQ ID NO: 25801 - protein, 446 aa, Synechococcus elongatus PCC 7942
MSFDYDLLVIGAGSGGLAASKRAASYGAKVAIAETDLVGGTCVIRGCVPKKLMVYASSFASQYHYAEAYGWSAVQPQFSWPKLIAAIDAEVNRLSRLHISLLEKAGVDLILGHAQFVDEHRLQVGDRQVTAAKILIAAGGRPIKLPIPGGELAITSREMFHLPEQPQRFAVIGGGYIGCEFAGILRSLGSEVTQIIRRDRILQGFDQELREAVQTGMSQHGVQFRTGVTVERIDQTETGLQLSYSDGSQQIVDQVLMATGREPWLEGLNLDAAGVAIEGRRIAVDAWSRTNQPHIFAVGDCTDRVNLTPVAIAEGRAFADTEFGQKPRQISYENIASAVFSQPEACSVGLSEEAAKAEYGEERIRVYRSRFRPMFYTLPQAEERVLMKLVVETESDRVLGAHMVGKDAAEIIQSVAIAVTMGATKADFDATMALHPTSAEEFVTMP

SEQ ID NO: 25802 - protein, 446 aa, Synechococcus elongatus PCC 7942
MGRQEPSVSRLTAGEAIAINPIHYEIAARRILWSAMATINDNYLKLKAGYLFPEIARRVNAFAQSNPEAAIIRLGIGDVTEPLPVACRQAMIQAVEDMGQRENFKGYGPEQGYAWLREKIAAHDFQSRGCEVDASEIFISDGSKCDCGNILDIFGNNNRIAVTDPVYPVYVDTNVMAGHTGDANDRGEYDGLVYLPISAENNFTAEIPSEKVDLIYLCFPNNPTGAVASREYLQAWVDYARANGAIILFDAAYEAFITDPAIPHSIFEIPGARDCAIEFRSFSKNAGFTGTRCAFTVVPKGLKGKAADGSEVELWGLWNRRQSTKFNGVSYIVQRGAEAVYSAEGQAQIKELVAFYLENARIIREELTAAGLDVHGGVNAPYVWVKTPAGLTSWDFFDKLLQVCNVVGTPGSGFGAAGEGYFRISAFNSRENVVTAMQRIRSAGLA

SEQ ID NO: 25803 - protein, 422 aa, Synechococcus elongatus PCC 7942
MSPETVLAAVDAAIASPFSTDAFDACVMQTYGRFPLALERGEGCRVWDTQGRSYLDFVAGIATCTLGHAHPELVDAISDQIRKLHHVSNLYYIPEQGQLAAWLTANSCADRVFFCNSGAEANEAAIKLARKHGNTVLEAENPIILTAQASFHGRTLAAVTATGQPKYHKGFQPLVQGFRYVPYNDLAALEATLAELDAAGETVAAILLEPLQGEGGVNPGDRAYFQAVRQLCDQRRMLLILDEVQVGMGRSGQLWGYENLGIEPDAFTVAKGLGGGVPIGALLVKASCNILQAGEHASTFGGNPLACRAGLAIAQVMERDQLLANVQARGEQLRAGLQELVDRYPNLLAGVRGWGLINGLVLRNDPNVTPIALVKAAIEQGLLLVPAGAEVVRFVPPLIVSAAEIDEALAMTERALLAIAGE

SEQ ID NO: 25804 - protein, 479 aa, Synechococcus elongatus PCC 7942
MSSEFDYDVIVIGAGYGGFDAAKHACEKGLKTAIVEARDLGGTCVNRGCVPSKALLAASGRVREITDTDHLQNFGIQVQGVSFDRQAIADHAANLVDTVRTNLGNTLKRLGAEILMGRGRLAGSQRVTVTAADGTEKTYSARDVILATGSDPFVPPGIEIDGKTVFTSDDALKLETLPQWIAIIGSGYIGLEFSDVYTALGCEVTMIEALDRLLPTFDPDVAKVAQRSLLDGRDIETRTGVLARKITPGSPVVIELADFETKELVEVLEVDACLVATGRIPSTKNLGLETVAVEVDRRGFIPVDDGMRVLRDSKPVPHLFAVGDATGKLMLAHAAAAQGVVAIENITGHPRSVDYRSIPAATFTHPEISSVGLSEADAKALGGQEGFEVGSVRSYFKANSKALAEADADGFAKVLFRKDTGEVLGAHIFGLHAADLIQEVANAIARRQSVKELAFEVHTHPTLSEVIESAYKQAATAIA

SEQ ID NO: 25805 - protein, 231 aa, Synechococcus elongatus PCC 7942
MYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 25806 - protein, 478 aa, Synechococcus elongatus PCC 7942
MARSRSEYVCQNCGHRAPRYVGRCPACESWNSLVEEAIAPTAKTAIATVLPSRQRRDRLAEAPPQAVAAQPLSAIADVSQQRIASGSGEFDRVLGGGLVPGSLVLIGGDPGIGKSTLLLQTATALSQQQPILYVCAEESGQQVKLRWQRIAAHRSPNQADQQFYLLPEIDLDAIVAELETLRPPVAIIDSIQALYSPALGSAPGSVAQVRECTAALMRVAKQLTITLLIVGHVTKDGAIAGPKVLEHLVDTVLYFEGDRFASHRLLRSVKNRFGASQELGIFEMVDRGLEEVGNPSALFLGSRDQATSGTATIVACEGTRPLLVELQALVSPSSYSSPRRAGTGIEYNRLLQILAVLEKRLGLPLSKFDAYVASAGGLNVAEPAADLGIAIALVASFRDRCLRPDTVLIGEIGLGGQVRPVSQVELRLKEAAKLGFQRALLPKGQERCESDLELVPVSRLVDAIGLALQEAPPSSDRS

SEQ ID NO: 25807 - protein, 245 aa, Synechococcus elongatus PCC 7942
MVAAGVVGTLVFYPQSPAYQAIADPFLQRVVMGLGMGLTAMIIMYSPWGKRSGAHINPAVTLTFYRLKKIAAWDAFFYVVFQFIGGLLGVVLVAFLLQTPFTQAPVNYVVTVPGKQGAIVACIAEYFIAVLMMSMVLFTSNQPKLERFTPFFAGCLIVSYVIFESPLSGFGMNPARTVASALPSGIWTAIWLYFLAPIAGMLTAAELYLRMIGPRKIFCAKLYHDPLYRCIHCGHLIHWHRPHLR

SEQ ID NO: 25808 - protein, 1030 aa, Synechococcus elongatus PCC 7942
MNNGKVRIYELSKELNLDNKDVLAVCDRLEIPYKSYSSTLSEEQVVQVRQVLAGAAPSEPVAAASAADSPKAERKQEIVSVRRPTPQAAGGAKPEIVGRPTASEKPQAERPNIVAPPRRPAAANEPAKAPIKPARPEKSAEKPEIVTPRPPAPAASAEPAKSPSRPAPAATPRPVAETKKPKPAAAELLRKPEIVRRSEAKPERTSEAPTPRPKIERRPEQTGPARPQLGQPVAGNGVSKPAKPVKPIELVAPPSRPKVAASASGVPAAASRVLPNKPQKPTAPGGPELKQRPKPAAPASGEDLAATVDVFQPVPPLELRRPTAPARPARPRKGWEEEEDERAAANRKAGNKAAAKAKRRQLIQDDDDDDLLTAEQELAAADALNLAMSLARPSKPKVPQAKPAVAVMPTKGRKPRRESARERQHRRRMEREQKPVRPELISLRSSMTVQELAQLMVVPETDIIKSLFFKGIAATVTQSLDVATIEQVAEEFGILVEQETEESGARKTTQMVEDADAESLQTRPPVVTVMGHVDHGKTTLLDAIRKTRVAAGEAGGITQHIGAYHVDVEHNGDQHQIVFLDTPGHEAFTAMRARGARVTDIAILVVAADDGVRPQTLEAISHAKAAEVPLIVAINKCDKEEAQPDRVKQELTEYGLVPEEWGGETVMVPVSAIKGENIDQLLEMILLVTEVEELVANPDRAARGTVIEAHLDKARGPVATLLVQNGTLRVGDVLVAGSVLGKVRAMVDDRGDRVEAATPSFAVEVLGLGDVPAAGDEFEVYSDEKSARAVATSRADEQRQSRLQQAMASRRVSLGTVSAQAQEGELKELNLILKADVQGSVEAILGSLEQLPQKQVQVRVLLAAPGEITETDVDLAAASGAVIVGFNTTLASGAKRAADEAGVDVRDYDIIYKLLEDIQAAMEGLLEPELVEEPLGQVEVRAVFSIGRGAVAGCYVQSGKAIRNCNIRVRRGSNLVYTGTLDSLKRMKEDVKEVNSGYECGIGLDSFSAWQEGDIIETYRMVTKRRTLEV

SEQ ID NO: 25809 - protein, 138 aa, Synechococcus elongatus PCC 7942
MFVPESDPLRGDRRLSPAAAKQLSPQALAYLGDALYEFHVRLRLLLPAQRSHQFHQSVVAAVRAERQAELLVSLLPLLTAEELEIVRRGRNAAGRVPRRLTAECYQQATGLETLLGYLYLCDPQRLQALLQQLPVTEY

SEQ ID NO: 25810 - protein, 323 aa, Synechococcus elongatus PCC 7942
MNLEQALSGRLPIVYSDRFLDHDTGLGHPERPERLSATVTHLRSQPWSTALDWYLPTDLATRSPLPWIETCHSLHYIDSVQHLAERGGGSLDPDTPCSAASYEVALLAVNAWLDGIDRLLTRQSQAAFALTRPPGHHALATHGMGFCLFGNAAIAARYALAQGLTKVAIVDWDVHHGNGTQALVEQQPAIAYVSLHQSPAYPGTGSASETGFYENVRNLPLPPGSDGQDYRQCFETIVLPFLRAWQPQLLIVSAGYDAAAADPLANMRLQPADYGALTQQLRSLQIPILFGLEGGYDLPALSASVAATLAACLEPPSAPKQSG

SEQ ID NO: 25811 - protein, 273 aa, Synechococcus elongatus PCC 7942
MAHPIPVVVNGATGKMGRETIKAIAAADDVTLVGAIARSADVQGQDIGEIVGLGPLEVPVTNDLEGMLCLASQEREVPVVVDFTHPDCIYDNVRKAIAYGVRPVVGTTGLNNEQLQELAEFAEKASVGCLVIPNFSIGMVLLMQAAIQASRFYDHVEILELHHDQKADAPSGTAIKTAQMLAELGKTFNPPKVTEKETMPGARGAVGPENIRIHSVRLPGLIAHEEVIFGAPGEILTLRHDTMDRSCYMPGVLLAVRKVRQLTGLIYGLDRIL

SEQ ID NO: 25812 - protein, 447 aa, Synechococcus elongatus PCC 7942
MPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKPLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDPGEPLDVDIYDLSPEELAKIPSTPGSLKDALKALEADHDFLTVGGVFTEDFIQNWIEYKLDNEVIPISLRPHPYEFALYYDC

SEQ ID NO: 25813 - protein, 434 aa, Synechococcus elongatus PCC 7942
MDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDANGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 25814 - protein, 321 aa, Synechococcus elongatus PCC 7942
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFSSLYPGCVADTPLFRNTPKLFQKIFPWFQKNITGGYVTQELAGERVAQVVADPEFKTSGVHWSWGNRQQKDRQSFVQELSDKASDDRTAQRLWDLSAKLVGL

SEQ ID NO: 25815 - protein, 368 aa, Ralstonia eutropha JMP134
MKTKAAIAWKAGAPLTIEDVDLEGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPEREAMARKFGMTHFINPKDVGNVVDHIIQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFELMRRGESIRSVVLY

SEQ ID NO: 25816 - protein, 400 aa, Ralstonia eutropha JMP134
MDNWKTGTDAMFILLGAIMVLAMHAGFAFLELGTVRKKNQVNALVKILVDFAVSTIAYFFIGYTVAYGVQFMSGADTLAQKSGYELVKFFFLATFAAAIPAIISGGIAERSRFNPQLCATFVLVGFVYPFFEGIAWNQRFGIQDWITHLTGAPFHDFAGSVVVHAVGGWIALPAVLLLGARRGRYQKDGRISAHPPSNIPFLALGAWVLAVGWFGFNVMSAQTVDKISGLVAINSLMAMAGGTLAAWWAGRNDPGFAYNGPLAGLVAVCAGSDLMHPVGALVTGAVAGVLFVHLFTLAQNKWHIDDVLGVWPLHGLCGAWGGIAAGIFGSHALGGIGGVSLGAQLIGTLLGIVIAVAGGTIVYGTLKKLVGIRLDAEAEFNGADLTLHRISATPERETNW

SEQ ID NO: 25817 - protein, 351 aa, Ralstonia eutropha JMP134
MPTLFDPIRIGDLDLPNRVIMAPLTRSRAVGGKRVPNALMAEYYVQRASAGLIISEATAVTPQGVGYADTPGIWTDEQVAGWKHVTDAVHAAGGRIFMQLWHVGRISDPIFLDGELPVAPSAIAAQGHVSLVRPKRAYVTPRALETEEIAGVIAAYRHGAENAKKAGFDGVEIHGANGYLLDQFLQDSTNQRTDAYGGPIENRARLLLEITDACIDVWGADRVGVHLSPRGDVHSMGDSDLAATFGYVARELGKRRIAFICAREALGDNRLGPALKAAFGGVYIANEKMTKQTAEHVLAAGEADAVAFGQLFIANPDLPRRLALDASLNEPRPETFYHPGAEGYTDYPALV

SEQ ID NO: 25818 - protein, 499 aa, Ralstonia eutropha JMP134
MDTRTELLSAATRAFLQRPKRMLIDGQWCAATDGAVFTTEDPASETTLAEVPAAGPADVDAAVQAARAAFEQGPWNAMRPSDRERLLLRLADLVEANAEELAQIEALDNGKPATMARAIDVAGAAGFLRYMAGWATKLHGESLDVSVPLVREREFVAFTRQEAVGVVGAIIPWNFPLLMAAWKLGPALACGCTVVLKPAEETPLSALRLGELVMEAGYPAGVVNIVTGDGARCGAALAGHPQVDKIAFTGSTEVGKLVGGAAMERLARVTLELGGKSPVIMLDDMSPEAAATGAAQAIFFNQGQVCTAGSRLYLPRSKFDATVQALADIANSLRLGPGLEPDTGMGPLVSRRQHKRVAGYVQAGVDAGAQLICGGNADLPRGHFFKPTVLARAPETSSVVQEEIFGPVVVALPYDDIDEVVGRANGTPFGLAASVWSNDLSRVHRLVPRIKAGTVWVNCHNLLDNAMPFGGFKQSGLGREMGRAVFDHYTETKSVMIAV

SEQ ID NO: 25819 - protein, 294 aa, Ralstonia eutropha JMP134
MRIGFIGTGKMGLPMARHIAAAGHDVVAYDIAPEQASAARHAGLAVAPSLADAVSAAEVIFSSMPNDGAFSAVAGQIAKAARPGALYIDTSTVSPAASAAVAPLLAARDIAYLRVTVSGNNHMAEAAKLTALVSGPADAYERIKPLLAALGPAQFYLGDAEQARLMKLVVNLLIALTGGMLAEALTLGSKGGLEWQAMWDVITASAVASPIVKAKAAQLAVHDYTPTFTVEQMLKDVGLILDAGAQLHVPMGLTALLGQMLHGAAAQGMAGDDYAAIIKSAELAAGMQPGQRQP

SEQ ID NO: 25820 - protein, 473 aa, Ralstonia eutropha JMP134
MKTLDQFYIDGQWVDPAPGATAMDIINPATEAVAGKVALGTAADVDRAVAAARAAFPAWSQTSRETRIAMLERITALYKARMTDIAEAVRTEIGAPVALCNTLQAPIGLAHLAAATETLRKFEFETEYGNNYVRHEPIGVAALVTAWNWPLSLICAKTAAALAAGCTVVLKPSEIAPLDAAIFAEIMHEAGTPAGVFNMIYGEGKTVGARLSSHPDVDVISITGSTRAGVEVALSAAPTVKRVHQELGGKSPLLILDDADLQAAVTTGVTQVMMNSGQTCIAPTRMLVPRERYAEAVAVAAAVANAIPVGDPADAATKMGPISNRAQYEKVQRMIGAGIEEGARVAAGGTGRPDGLECGFFARPTVFADVNNGMAIAREEIFGPVLVMIPYDGEEDGIAIANDTPYGLAAYVASGDTARARRVAARLRAGSVRINGAQVDLAMPFGGYKASGNGRENGAYGLAEFFECKSVML

SEQ ID NO: 25821 - protein, 338 aa, Ralstonia eutropha JMP134
MRAAIIDATGGPGVLRIANVPVPELAAGEVLIRVICAGVNPADWKCREGYLGNFMHYSFPFVIGFDVSGVVAAVGEGVTGWIPGQRVFAQTDVGAGKWGSYAEYVAVSQDSVVAIPDGLGDAEAAAVPTPALAAWAGLFDEGGLKPGQTVLIHGGGGAVGTFAIQLARAAGASVAATCSASRCDELKSLGCDLPIDYRSDLTERAVEKWAPGGVDLVLDAVGCGTLPNGLDLLKPGGILVAIMTLVSGDSGPDAAEAARRGKRCALAYSRMPSGARLREISELLATGKIRPPRVECLPLEDAAAALGLVQSGKAPAKLVLQVSSPAEAEVPAQHRRVA

SEQ ID NO: 25822 - protein, 418 aa, Ralstonia eutropha JMP134
MTASSGKRRFARIDRLPPYVFNITAELKMAARRRGEDIIDMSMGNPDGATPPHIVAKLVEAAQRPDTHGYSASKGIPRLRRAISHWYRERYDVEIDPDTEAIVTIGSKEGLAHLMLATLDRGDSVLVPDPSYPIHIYGAVIAGADIRSVPLVPGVDFFAELERTIRGSYPKPKMIVLGFPSNPTAQCVELDFFERVIALARKHDIFVVHDLAYADIVFDGWKAPSIMQVPGAKDIAVEFFTLSKSYNMAGWRIGFMVGNPDLVAALTRIKSYHDYGTFTPVQIAAIAALEGDQECVKEIAAHYQSRRDVLAKGLIESGWLVDIPKASMYIWARIPEPYRALGSLEFAKQLLAKAKVSVSPGIGFGDYGDEYVRFALIENEARIRQAVRGIKAMFRADGLVKVPASEHADGHGKEKGKG

SEQ ID NO: 25823 - protein, 491 aa, Ralstonia eutropha JMP134
MSLTLANAALLRSQNFINQQWRDAGLGRRLAVANPATGEVFAHVPDSDDDDAGRAADAAAEAFPAWSARPARERAQLIKRWHALILANQEDLARIISTEQGKPLKEARGEVLYGASYVEWFAEEATRICGDIVAEAVPGRKLLVLKEPVGVVAAITPWNFPLAMIARKIAPALAAGCTVVAKPAEDTPLTALALVWLAEQAGLPAGVLNIVTASRESTPNVVDAWLADSRVRKITFTGSTPVGKHLARESAGTLKKLSLELGGNAPFIVFEDADLDAAVDGLMASKFRNGGQTCVCPNRVYVHESVHDDFVERLARRVGALHVAPATDENAQIGPMINARAVDKIARHVEDAVAKGARVVTGGRRVRTADGPHYYAPTVLIDATPAMELACEETFGPVAPVFRFRDESEVIRDANDTPFGLAAYFYSNDVRRIWRVAQALETGMVGINEGAIAAEAAPFGGVKESGYGREGSRHGLDDYMHTKYLCQGQLG

SEQ ID NO: 25824 - protein, 289 aa, Ralstonia eutropha JMP134
MLPHSDSPIPRWLAGTAGVAVLAGLARHLLFRALEREAFVTPPIPPQGGQSETTLHASTFASGGRVLHAAFAPAATAQAPALMVCHGDDECLSDWAPVQTMLSRAGISTFVFDYSGYGASSGRPTVRHLREDARAAYRMFLEATPAASRRYVLGHSLGSGVLLDVARELRPVPDGMIIASGFSSARAAAVQTGKVPARLAWLLPDPWNNLARTRRLNVPLLVLHSRDDEVLPFAHSERLAQAASRLQELVLFDGMPHDAAILPDYIEAFWAPIIAFMLAPQAPRIDGST

SEQ ID NO: 25825 - protein, 371 aa, Ralstonia eutropha JMP134
MSHLFDPLDIGNLTLPNRIIIAPMCQYSAQDGNAVDWHMIHLGSLALSGAGMLILEATAVSPEGRITAGDLGLYSDENEAALGHVLKAIRAHAPIAVAIQLGHAGRKASSQVPWEGGQQVAPDAPGGWQAVAPSAVPHAEGEARPTALDRAGMDKVRDDFVAAAVRAVRLGIQGFEIHAAHGYLLHQFLSPLANHRDDEYGGSLENRMRFPIEVFDAVRAAVPADRPVWMRISATDWVPGGWDIEGTVALSQAVKARGCAAIHVTTGGVSPAQAIKLGPGYQVPYAQRVKAKVGLPTIAVGLITEPEQAEAIITGNEADAVSLARAMLYDPRWPWHAAAKLGASVAAPKQYWRSQPRELKDLFSGANFGQR

SEQ ID NO: 25826 - protein, 324 aa, Ralstonia eutropha JMP134
MIGVAAHFRTPAKVPMSQSPSHRPPAAPPATGNEQARVAEFSVASGEREISVCVCYPPGYPAPATESGALLPWLVYLHAGGFVDGGLERAKEVVQMLAASVPAVVVTPAYSLAPDHPFPAAPEDAYNTVEWVLRYARRLKVDKARFALVGEEAGGNLAIALSQMLRDRCAPQPSGQWLIRPVTDPCLQHASCTGAGRGAVPLETLQRLACNYRDYLPTPAASVHPYAAPALASRLAGLPPTLVQVAEVDALRAEGEAFAGRLAKAGVPAEAMIMPGACGDGVEDTHDDCQSWVDEGARFLRRCLAGADDTSSRRESRSGMKPAG

SEQ ID NO: 25827 - protein, 466 aa, Ralstonia eutropha JMP134
MKTIQTDVAVIGAGTAGLAAYRAAIAAGKRAVIIEGGPYGTTCARVGCMPSKLLIAAAEAAHELRHTAPFGVHVDGQIRIDGREVMARVRSERDRFVGFVVRGVDGIPEADRIRGYASFIDNTTLEVAADDGNITVRASRVVIATGSRPVLPAPFKVFGDRLIVNDDVFAWEDLPRSVAVFGPGVIGLELGQALSRLGVRVRVFGVRGSLGPLTDPVIRRYADETFRKAFYLDTEASVTEMAREGDLARITYIDREGKSVAETFDYVLAATGREPNVRGLGLENTGLELDARGVPVFDPVTLQCGVSPVFIAGDANNILPLLHEAADEGKAAGENAATYPRVLPLARRAPLAVVFSDPQIAMVGKRFADLAEGSFVTGEVSFEDQGRSRVMLRNRGLMHVYADKATGQFLGAEWTGPRAENIAHLLAWSYQQGLTIAQMLAMPFYHPVVEEGLRTALRDAAAKLEG

SEQ ID NO: 25828 - protein, 314 aa, Ralstonia eutropha JMP134
MTPTIIYTHTACLEHRPGPHHPESPERLKAVVEALRTPEFASLEWRDAPMGTVEQLQLIHDTDYIDEIAQRAPTHGYVPLDAGDTVMSPGSWEAVMRCVGAACAGVDTVMNGDARNVFCATRPCGHHAEPAKAMGFCIFNQAAIAAAYACEVHKLERVAVVDFDVHHGNGTQAAFFNRPELFYASSHQSPFYPGTGARSETGVNHNIVNVPLPRGCESAQFRAAISALVLPSLRAFAPDLLIISAGFDAHRLDPLAGMNLEDSDFHWITRELMQIADEACNGRIVSILEGGYSLDALATSSMAHVGALMQDAGI

SEQ ID NO: 25829 - protein, 232 aa, Ralstonia eutropha JMP134
MSTQAKASPAIRRDFERVSPELVERASRFQAAILADVVGRRGTLNGRVQGLSPSMKVAGPALTVEVRPGDNLMFHVALAIAKPGDVIVIDAKGDQTAAMCGEIMATQAQASGIAGFVVDAAVRDSRELANGSFPIFAAGTNPCGPTKALGGLVNWPASVAGVAVNPGDLVVGDADGVVVIPREDVPAILELAQKKLDSETQRIAAIKAGDLRPGWLEGELRKAGVLAEGEVL

SEQ ID NO: 25830 - protein, 468 aa, Ralstonia eutropha JMP134
MASPFPSLGERRDTLRCLRTAIRGHAHRLAAAAQRDFSARAEAETLMVDVLPSVMHINHLLRGLRRWMKPSRRHTELLFFGNSARVMYQPKGVVGIVVPWNFPVYLALGPLATALAAGNRCMVKTSEYAPHTSAALRALLREVFDEDRVAIVEGDAEIARAFTSLPFDHIVFTGSPEIGRHVMRAAAANLTPVTLELGGKSPAIVSRSANLRTAATRIAHGKTVNGGQICVAPDYALVPAEDAEPFAQAVLDAASQMHPQGSDDYTAVIHDGALARQRALLDDARALGARVFSAAMPSGGRRLPLHVVLGVTPQMRLAQEEIFGPILPVFTYRSFDEAIAHVQSGTRPLALYYFGHDKAETGPLLERTHAGGVTLNDWGWHVVNHDLPFGGSGTSGMGNYHGAEGFRELSHAKSVFAERRWFPIELFHPPYGSWVQRLAMRLFLGAPAQGESQRGTPAGTQPAHRSTD

SEQ ID NO: 25831 - protein, 296 aa, Ralstonia eutropha JMP134
MAACGVCRTDLHVVDGDLSSPKPALIPGHEIVGRVDALGAGVVGLSIGARVGVPWLGHTCGQCRFCLSGRENLCDAPQFHGYTRDGGYAEYVVADASYCFRIPETYDDEHAAPLLCAGLIGFRTLRSAGDAQRIGIYGFGAAAHIVTQIAVAQGRTVYAFTRPGDQAAQTLATDVGAAWAGSSQDKAPATLDAALIFAPDGALVPAALAAVDKGGTVVCGGIHMSDIPSFPYRLLWEERRIVSVANLTRADGHGLMEAAATWPLHIRTTSYPLSSANAALDDLRAGRLAGAAVLRV

SEQ ID NO: 25832 - protein, 482 aa, Ralstonia eutropha JMP134
MHNLNTFYIGGEWVKPADGATLADLVNPATEAVIGTVAMGGAADVDRAVAAARDAFASWSRSSREERLALLRRISDGYKARIGEIAEAISTEIGAPIWLCREYQAPMGLVQIQAAIAALEAFEFVTVKGTTQVVREAVGVAALITPWNWPVNQIAAKVAPALAAGCTVVLKPSEIAPLDARIFAEIVQEACQATSTPAGVFNMLFGTGPTVGAALSRHPDVDMVSITGSTRAGVDVAMQAAPTVKRVAQELGGKSPNVILDDADLKAAVSQGVVSCMLNSGQTCTAPTRMLVPRAQYQMAIAIAQATVQALTVGDPSSPDSKLGPSSNRAQYERVQRMIEAGIQEGARVVAGGPGRPEGLAQGFYNRPTVFADVSNDMTIAREEIFGPVLSMIPYDNEAEAIRIANDTPYGLAAYVWSGNPARARRVAGELRAGSVQINGAKMDFAAPFGGYKTSGNGREFGAYGLAEFLEYKSVAGCTVDE

SEQ ID NO: 25833 - protein, 418 aa, Ralstonia eutropha JMP134
METARMTPSAPSQSRPRLIVVGNGMAGMRTVEELLKLAPDLYDITVFGAEPHGNYNRILLSPVLAGEKTVDDIMLNTREWYAQNGIELLAGDPVVAIDRPRRTVRAQSGREVRYDRLLLATGSKPFILPVPGHQLDGVIAFRDIQDVEIMLDAARNHRHAVVIGGGLLGLEAANGLLRQGMDVTVVHLCDSLMERQLDKPAATLLKGALERKGLRFMLGAQTAEILGDTRVTGVRFKDGNEIPADLVVMTAGVRPNIELAAGAGLRCERAIVVDDTLQTYDPRIYAVGECVQHRQATFGLVAPIWDQARVCAAHLAGAGHRRYIQQATATKLKVTGVDLYSAGDFIGGEGSEDLVLRDARRGVYKRLVLQDGRLIGAVLYGDVQDGPWYFDLIQQCAPVAALRQRLLFGKAQCEALAA

SEQ ID NO: 25834 - protein, 483 aa, Ralstonia eutropha JMP134
MNALTMLIGGQDRPAANGATFERRNPVTDVVASRAPAATPEDAIAAVEAAAAAFPAWAALGPGERRKRLLRAADMMDSRTDEFIAAGAAETGAMPNWIGFNVMLAANMLREAAAMTTQIDGSVIPSDVPGSLALAVRQPCGVVLGIAPWNAPVILATRALAMPLACGNTVVLKASEACPALHRMIGTVLEEAGLGSGVVNVVTHAPEDAATIVETLIAHPAVRRVNFTGSTHVGRIIAQHAAKHLKPALLELGGKAPVIVLDDADLDAAVEAVAFGAFFNQGQICMSTERVIAQRAVADLFVEKLAAKARTLRAGDPSDPSSVLGALVSTQAAQRIRALVEDARSKGARLPVGLHGDGAILQPAIVDGVTPEMALYREESFGPVVTVARVDSDEAAIQMANDSEFGLSAAVFSRDVPRALAVAKRIESGICHINGPTVHDEAQMPFGGVKGSGYGRFGSKASVDAFTELRWITIQSGPRHYPI

SEQ ID NO: 25835 - protein, 452 aa, Ralstonia eutropha JMP134
MQRGLGERHIRLMALGSAIGVGLFLGSANAIRMAGPAIMLAYLIGGAMIFLIMRALGEMAVHNPVAGSFCRYAQDHMGPLAGYLTGWNYWFLWLVTCVAEITAVAIYMGVWFPDVPRWIWALAALATMGSVNLLTVKAYGEFEFWFAMIKIVTIVLMLFGGGAMIVFGLGNGGIATGISNLWAHGGFMPNGASGVLMSLQMVMFAYLGVEMIGLTAGEAKNPRKSIPDAINSVFWRILIFYVGALFVILSLYPWNEIGAQGSPFVMTFERLGIKTAAGIINFVVLTAALSSCNGGIFSTGRMLYNLAQQGQAPAAFARVDRNGVPRRALLVSIGALLCGVLLNYLVPEKVFVWVTSISTFGAIWTWAIILVTQMQFRKNLSPAERDKLAFRMPFWPYGSWIALAFLALVIALMAYFPDTRIALYVGPAWLVLLTVLYYRLGMQARGPVTYQA

SEQ ID NO: 25836 - protein, 431 aa, Ralstonia eutropha JMP134
MAMATPTRAARMPEPVPSGAWTTLASSTFAFTICFAVWMLFAVLGIPLKKELGLNETEFGLLAATPVLSGSLIRVPLGLWTDRYGGRVVFFVLMLATVIPIWLISYAHTLWQLLVLGLFVGLAGGSFSVGTPYVARWFPRSRQGLAMGIFGAGNSGAALTKFVAPALILAAGTWEIVPRVYSVAMLVTAIVFWLGSRSNPAHRVMTSAGWREQLAVMRDPRVWRYSQYYSVVFGGYVGLSLWMTKYYIGEYGFDIKVAAFLAACFSLPGGVLRAIGGWISDRYGAHRTTWWVMWVSWVGFFLLSYPQTDFVIHTTTGPQSFRIALTPAVFTFLLFVVGIAFAIGKASVFKFISNDFTHNIGAVSGVVGLAGGLGGFVLPILFGALADLTGVRSSCFMLMYGTVCVSLVWMHYSQRAERRRKEQAVGLTQTA

SEQ ID NO: 25837 - protein, 464 aa, Ralstonia eutropha JMP134
MATWKPDPSFYPSPRLAAKAPPETIAYVAMFDPERKQPDAIAVVDVDPASPRYASIVGQVAMPHAGDELHHFGWNACSSCLCPNAPHPHMERRYLVVPGLRSSRIYILDTKPDPLKPFLAKVIEPETLAERTGYSRPHTVHCGPGGIYVTALGNAEGKGPGGIAMLDAQSFEPLGRWEVERGPQYFAYDGWWHLGYDTLVTSEWGTPDMVEDGLVPDILLGARYGRRLHFWDLTRRRHLQEIDFGDEHQLVFELRPAHDPTKAYGFVNCVISLKDLSSSIWTWYRDKDKWAVRKVIEIPAEAADPDQLPPVLKGFKAVPPLVTDIDLSMDDRFLYVSCWGTGDLLQYDVSDPFEPKLTGKVRIGGIVSRATHPGAKNGALNGGPQMVEISRDGRRVYFTNSLYGAVDPQFYPEGIDGWMVKLDAGPNGGIEFDPKFFLEWPKGHRPHQVRLQGGDCSSDSYCYP

SEQ ID NO: 25838 - protein, 457 aa, Ralstonia eutropha JMP134
MKHTPLELMRVRTGDRLERLPVCGYHRFLFAVIALAFFFDNLDLAMMTYLLGSIRSEFGLTPAQAGMLGSASFVGMAVGALGSGVLADRFGRKPVFQVSMIIWGVGSYLCSTAHSPTELGAYRVLLGLGMGMELPLAQTLMSEFIPARQRGKYLALMDGNWPIAFICAGMMSYYVLSAYSWRTMFLLGAVPALFLLVIRRYVPESPRWLESRGRHAEAADIVERIEQSVMRRMKLHALPEVTPMVAAPEPAASGLRVLWSREYRSRTLTVWGLWFFALLGFYGLNTWIGALLQQSGVGVTKSVLYTVYISIGGIPGFLWAAWAVERWGRKPACVATLVGGACMVFIYGRVAGSHSEALVLFLSGGMMQFFMFGMWAVLYTYTPELYPTRARASGCGMASTVGRVGSLLGPALVGLILPVAGQAGVFCLGALCFLAAAGIVCRFGIETRGRALETIAD

SEQ ID NO: 25839 - protein, 361 aa, Ralstonia eutropha JMP134
MKAAVLHQPKSPLVIEDVAIGKPGPHEVLIRTAAVGVCHSDLHFLDGAYPHPMPAVLGHEAAGVVEQVGELVRTVRPGDHVITCLSAYCGHCEHCLTGHLSLCTEPDTRRGEDEPPRLTAHHGGPMNQFINLSAFAEQMLVHEHALVAIRRDMPLDRAALIGCAVTTGFGAVVHTARVQPGETVAVIGCGGIGLATINGAAIAGAGRIIAIDRVPGKLELARQFGATDVVQAGDDTVDAVRALTGGGVHHAFEAIGLKQTAEQAFAMLRRGGTATIIGMIAPGVKIELKGSDFLGEKKIQGSLMGSNRFPVDMPRMVDFYMAGRLKLDELISRRLPLEEINSAFDELRRGELARSVVVFGD

SEQ ID NO: 25840 - protein, 511 aa, Ralstonia eutropha JMP134
MLSPSRAGMAAGVLLAYAGFCGAVFDHHRRRRARVASLAVSGAHQEGATLVAYASQTGFAEQLAMQTATALQGAGMPVHLLSFEELDARRLARVRQALFVVSTTGEGDAPDSASGFARRLLAGGGHDALRQLRYGVLALGDSSYARFCAFGHALSDWLQRHHARPLFDLIEVDNGDAGALRHWQNHLSALSGGAEIADWERPRYEHWQLAAREHLNPGSDGAPAFHLVLRPEGAVPGWQAGDIAEVGPCHDPADIGRLLSHLSMDGAAPVRCDAQTVTLAEALATRLLLPEAHLATMRALPPQQLVDALSPLPHREYSIASLPQDGQLELLVRQTRHADGRLGLASGWLTSHAPVGARIALRIRTNRSFHSPADGRPQVLIGNGTGLAGLRGHLKARALAGRHRNWLFFGERSARHDGFFADELAAWQAQGVLERVDLVYSRDGNALRYVQDALRERAPVLREWVEAGAAIYVCGSLQGMAGGVNDALADVLGEAGLRRLTEQGRYRRDVY

SEQ ID NO: 25841 - protein, 335 aa, Ralstonia eutropha JMP134
MEKLGELNIDTIQGSRATAIHRDRREVELADGGRVPYDRLLIATGARPRRLNCPGADLTGVHYLRTIEDSERIRASLSKGGRLLVVGGGWIGLEVAASAISMGVPVTLVEATDRLCGRSLPESLGRFFMDLHVRHGVEIHLNASLTRLEGNGRVERAVFGNGDAIEVTTVVVGIGVVPNTELAADCGLPLENGIVVNESACTADPSIFAAGDVANQPSSWLNGRVRFESWKNAQDHGVLAASAMLGGDTTGRDIPWFWSDQYDVNFQLLGIPSAGNQVYQKGDASSGRFTQYFVQNNHLTAVAAVNSPRDLRDAKRSMQSQSQFDTTGLVPVPAP

SEQ ID NO: 25842 - protein, 447 aa, Ralstonia eutropha JMP134
MTITSPKLPQAAELDLKAHWMPFSANRNFHDDPRMVVAAKGRWLIDDQGRKVFDGLSGLWTCGAGHARAEIQAAVASQLGTLDYSPAFQFGHPQSFMLAERIAELFPGDLNHVFYTGSGSECADTAVKMARAYWRIKGQPAKTKLIGRARGYHGVNIAGTSLGGIGGNRKMFGQLMDADHLPHTLQADCAFTKGQAETGGVELANELLKLIELHDASNIAAVIVEPMSGSAGVIVPPKGYLQRLREICTQHGILLIFDEVITGFGRLGKASGAEYFGVTPDIANVAKQLTNGAIPMGAVIASSEIYNTFMAQPTSGHAVEFGHGYTYSGHPVACAAGLATLDLLARENLIQQAADLAPHFEQAIHGIRGAKHVVDIRNCGLAGAIQMAPRDGDATIRPFEAGLALWKKGFYVRFGGDTLQFGPAFNTTISELDTMFDSVGAVIETLA

SEQ ID NO: 25843 - protein, 400 aa, Ralstonia eutropha JMP134
MIANTDDLAYLMTREQGKPLDEAKGEIAYAASFLEWFAEEAKRVDGEVLASPAADKRLVTLRQPVGVCAAITPWNFPAAMITRKAAPALAAGCAIVIKPAELTPLSAFALAELAHRAGVPAGVLQVVTGDARTIGAVLTASPIVRKLSFTGSTEVGRILMAQSAATVKRLSLELGGNAPFVVFDDADVDAAVDGAIAAKFRNGGQTCVCANRFYIQDGIYDAFATKFAQRASQLRVGNGLEQGVVIGPLIEEAAVEKVTSLVDDATSKGGRLLTGGLKHQLSGTYYAPTVIADATATMRVAREEIFGPLAPLFRFKRDEDAVAAANATEYGLAAYLYTRDIARAWRTAEALEYGMVGLNTGLISNEVAPFGGIKQSGLGREGSRHGIEEYLETKYLCLQM

SEQ ID NO: 25844 - protein, 329 aa, Ralstonia eutropha JMP134
MKTRTMSVPLDPELAAIVAAMREARAPAPFSGSPEHARERMRSAILAARARTPLPEVGAIEDGIAVHDGQRVPVRVYRPRTASAMLATVVFFHGGGFVLGSVELMDDIARKLCRDLDAVVVSVDYRLAPEHPFPAAHDDALAATSWAIRNVSALGGNPARIAVAGESAGANLAASTALLLRDQGETLAAQLLIVPGVDLARDTQKLEAARGEFPMLSPTDLRDISRLYMGERAALAGRFPPSPMHAVNVHRLPPAVVAVAGHDPLCEEGTRYAARLEAAGVPVCLLRFDDMFHPFFGFFEASASARRANNAICHTFKSWLHQHASPTST

SEQ ID NO: 25845 - protein, 438 aa, Ralstonia eutropha JMP134
MSQWGLVATLTLVTMLAQIDKNILVLMVGPIQREFGVNDLQISYLIGAAFAISNIAVGLPAGWLADRHNRRVIVAVGVLVWSIAVAANAAAAAFITLVVARIVVGGAEALIPPSSYSLIRDGVDDQRRARALSVYTMALMLGTGLSLVLGGPMLHWIASAGIRTIPLIGPVPPWQMTLFLIGIAGLPVGLLIFLCRDPGRPLSEAHGGKPSTRAALRHLADNKSLFLPLVAFAVCNAMITYGLGAWIPTIVARRFQLGMGEIGLIQGGLLLTMGPLGLWLAGLAMDARACANRLSGVALVGMVVSIAVPCLGVMLCVAGTPSAFWLLDAMVVLFSWTFMAVTSTIVARTVPTTAVGLVMAIVLVLNGLIGQGLSPTLIALAGKHVFDARSDALAHGMALVFACAGVLAVAASGWMYRSLLHAESQGGLSATPAQIPSR

SEQ ID NO: 25846 - protein, 442 aa, Ralstonia eutropha JMP134
MTAADVQAAIAAADRALPAWRATSSRERSRLLRRWFDLCMAHQEDLATILTLEQGKPLKESRGEIAYGSGFIEWFSEEARRIYGDVIPAPSSDRRIIVIKQPVGVVAAITPWNFPNAMITRKAGAALAAGCTIVIKPASATPFSALALAALAKEAGIPDGVLNVVTGSASVVGGELTSSPVVRKLSFTGSTDVGKTLLEQCAGTVKKVSMELGGNAPFLIFDDADLDAAVAGVMASKFRNAGQTCVCANRIFVQDGVYDAFAEKLRIAVEAQVVGDGMAPGVDLGPLIDDAAIEKVREHIYDAVSLGAQVFTGGRAHALGGRFFKPTILTDVSPKAKLMNEETFGPLAPLIRFKTEEEAVAMANDTPFGLAAYFYTTNYARSWRVAEALECGIVGLNEGLISTEVAPFGGVKESGVGREGSKYGIEDYVEVKYICAGGLALR

SEQ ID NO: 25847 - protein, 476 aa, Ralstonia eutropha JMP134
MKTSFINGKFVEGGDARANINPSDTHDVIDQFGEADALMATTAVDAAAESFRTWSQTSIQRRADALDSVGTELLARKEELGRLLSREQGKILPEGIAEVDRAGRIFKFFAGEAVRPAGVHAASVRDGVEIHVTSEPLGVVGIISPWNFPMAIPAWKIAPALAYGNTVVFKPAELVPSSAWALADIISRSGFPPGAFNLVLGAGRVVGNAMLTDPRVTGISFTGSTGVGARVMETAGRRFAKLQLEMGGKNPLVVLDDADLEVALNCSIQGSFYSTGQRCTASSRIICTKGIYPTFRKALAERVAALRVGHALHGDTQIGPVVDKSQLDSNLHYVSVGRAEGATLVCGGELLAKETRGFFMSPALFADVTNDMRIAREEIFGPVSCLIVADDFEHAIQIANDTDFGLSAGICTTSLRYATRFRREVKAGMVMVNVPTAGVDYHVPFGGTKASSYGAREQGSFARHFFTSTKTSYSGW

SEQ ID NO: 25848 - protein, 299 aa, Ralstonia eutropha JMP134
MSKIGFIGLGVMGKPMAEHLQAGGHIVYAHTRSGVPQELLDKGMQSCSSAADVARQAEVIFLMLPDTPDVARVLFDKNGVAEGLSAGKIVVDMSSISPIETREFAAKIEKLGCNYVDAPVSGGEVGAKAATLSIMAGGKQDVFDKVLPLLQLMGKNITLVGNAGDGQVAKVANQVIVALTIEAVSEALVLAAKAGADPARVRQALMGGFASSKILEVHGERMIQRTFNPGFRIELHQKDLNLALSTAKQLGLGLPNTASTQQLFNVCVAQGGAGWDHSGLVKAIEHLSSFAIGDTPKKA

SEQ ID NO: 25849 - protein, 395 aa, Ralstonia eutropha JMP134
MYASHFAQAVDDAAGFGWRAPTPVHDWASLIAAKNAEIARLEAIYVRMLQSAGVDAITGRAQIVGPHRVEVNGVIFTAKVILVASGSVPVEPAIQGAELMITSNEAFYLDTLPKRIAIIGGGYIACEFAGIFNGLGSDVTQLYRGQQILRGFDDELRNHLGAEVSKSGVDLRVAVDVAAVGKRGDGLVVHLTTGQAIEVDAVMAATGRRSNTSGMGLESAGVLLDESGAIKVDEYSATSNPDIYAVGDVTNRLNLTPVAIHEGHAFADTVFGGRKRASAHDNVPFAVFSQPQAASVGLTEAQARRRHAKVDVYSSAFRPMRTALSGRDERALVKLVVDASTDRVLGAHIVAADAAEIILGIAVAIKAKATKADFDATLGVHPTLAEEFVTLRNRR

SEQ ID NO: 25850 - protein, 435 aa, Ralstonia eutropha JMP134
MDAAKAAFPAWSRATSQERFDILRKASDEIIARKEELGRLLSREEGKTLAEGIGEVARAGQIFAFAAGECLRAGGEAIPSVRAGVGVEITREPVGIVGMITPWNFPIAIPAWKIAPALAWGNCVVIKPADLVPGSAWALVDIIQRAGLPKGVLNLVMGRGSVVGQALLEHKDVHAISFTGSVATGRKVAATCIASNPMKKVQIEMGGKNPLVVLDDADLNTAVEVAVNGAFFSTGQRCTASSRLVVQAGIHDRFVEACIERLKSIVVDDALKQGTQIGPVVDQSQIDQDLRYIQIAKDEGGKLVFGGELLKRATPGFYLQPALFTETTNAMRISREEVFGPVANIVRVRDYDEALALANDTEFGLSAGICTTSLKYATHFKRSSEAGMVMVNLPTAGVDYHVPFGGRKGSSYGSREQGTYAKEHYTTIKTAYTMA

SEQ ID NO: 25851 - protein, 415 aa, Ralstonia eutropha JMP134
MMPSSTVVIVGAGQAGLQAATSLRQAGFDGRIRLVGDEPCIPYERPPLSKSYLAGETGLDGLWLRPEMFYGKERIELELGQTATAIDRQTRQVELASGRKVAYDRLVLATGARFRPLSVPGAELDGVLPLRTLADADALRPRLAEAREVVVIGAGFIGLEFAAVARKAGVAVHIIEMTQRLMGRVVSEQTSRFYTRAHRDWGSAFLFGTGVARILGNRRVSGVETSDGRTLPADLVLIGIGVVPNTEIAAAAGLAIDNGIIVDQNLASTDPTIFAIGDCANYPSRFGRCRLESVQNAVDQGQAVAAAIVGESIPYDKVPWFWTDQADLKLQIAGITAGHDRSVLRGDPESRSFSVFFFRDGTLIGVESINRPADHVVARRLLLADPRLSPEQAVDPDFDLRAHAIRFSRRERAQT

SEQ ID NO: 25852 - protein, 323 aa, Ralstonia eutropha JMP134
MPAVPLDPQVAALLDLIARAKRPPIHVMDVEDAKIAYEKSAPILDISPLPMHAVDDLHVCARDGHGIPVRLYAPREASWADPLPMLVYFHGGGFTVGSVNSHDALCRMQAAHADCMVLSVDYRLGPQWRFPTAANDAFDVLHWVFEEAARLGADPARIALGGDSAGGTLATACAVHARDSGLAPVLQLLIYPGTCARQDTPSHGALAEGYLLTADMIQWFFSHYLDQESSRDDWRFAPLDGGGSGADVRGCCPAWIAVAGYDPLHDEGVAYADKLRAAGVTVTLADYAGMIHDFFKMGRFVPAVAQAHADAVAALRAAFGTGQ

SEQ ID NO: 25853 - protein, 506 aa, Ralstonia eutropha JMP134
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 25854 - protein, 233 aa, Ralstonia eutropha JMP134
MNKVYASAAEALAGVVRDGQTIAVGGFGLCGIPEALIAALRDTGVKQLTCISNNAGVDGFGLGQLLETRQIKKMISSYVGENKEFERQYLAGELELEFTPQGTLAEKLRAGGSGIPAFFTKTGVGTIVADGKEIREFDGEKYVMERSLTADVALVKAWKADKAGNLVFRRTARNFNPMCAMAGKFTVAEVEHIVETGELDPDEIHLAGIFVKRLVLNTTPEKRIEQRTVRAAK

SEQ ID NO: 25855 - protein, 429 aa, Ralstonia eutropha JMP134
MSAIVDIIGREVLDSRGNPTVECDVLLESGVMGRAAVPSGASTGSREAIELRDGDKSRYLGKGVLKAVEHINTEISEAIMGLDASEQAFLDRTLIDLDGTENKSRLGANAMLAVSMAVAKAAAEEAGLPLYRYFGGSGAMQMPVPMMNIVNGGAHANNSLDIQEFMVMPVSATSFREALRCGAEVFHALKKILADKGMSTAVGDEGGFAPNFSSNEECLNTIVQAVEKAGYRMGEDVLLALDCAASEFYHEAEDVYVLEGEGLKLSSTQFADYLANLCDKFPIVSIEDGMAEGDWDGWKTLTDKLGKRVQLVGDDLFVTNTKILKEGIDKGIGNSILIKINQIGTLTETFAAIEMAKRAGYTAVISHRSGETEDSTIADIAVGTNAGQIKTGSLSRSDRISKYNQLLRIEEDLGDIASYPGKSAFYNLR

SEQ ID NO: 25856 - protein, 172 aa, Ralstonia eutropha JMP134
MKDDFFALFGLPVQFGVDEAALDAAYRTVQSQAHPDRFAKAGEAERRVAMQWAAHANEAYRTLRQPLKRAIYLLGLRGVDVQAENNTAMSPAFLMQQMEWREDLQDAVESRDVDRLDGLLRGLRQEKRERHTALGKLLDAGDNEAAGAAVRQLMFIEKIEHDTSEAIDRLEG

SEQ ID NO: 25857 - protein, 234 aa, Ralstonia eutropha JMP134
MHGSLAANAALLEGIKAAPARARLAVCAPFPYLAQCQALLNGSQVAWGAQDVSAEARGAFTGEVAASMLGEFGCTYALVGHSERRTYHGESDAVVAAKALRALEFGIIPVICVGETLAQREAGETEVVVGRQLQAALDALSVEQLGRVVLAYEPVWAIGTGKTASSEQAQAVHAFLRAEVRERDAGVADRMAILYGGSVKPDNAAELFSMSDIDGGLIGGASLKSEDFLAIGNA

SEQ ID NO: 25858 - protein, 334 aa, Ralstonia eutropha JMP134
MQAIEIREYGAPEVLQETQRPDPVPGAGEILIRVAAAGVNRPDVFQRTGNYPVPPGASDLPGLEVAGVVVGGDLSHADNRFGLKVGDRVCALVQGGGYAQLCTAPVAQCLPAPKGLSDIEAAALPETFFTVWSNVFDRGYLGQGPRGKDETLLIQGGSSGIGTTAIQIAKALGYKVFVTAGTDEKCKACEDLGADRAINYKTQDFVAEVASLTEGKGVDVILDMVAGSYLARELKCIADDGRIVIIALLGGAKAEIPLGDILRRRITVTGSTLRPRSASFKGQIAQALHQQVWPLLEAGKIKPVIHKVFPAAQAAEAHRLMESSEHIGKIVLTW

SEQ ID NO: 25859 - protein, 1012 aa, Ralstonia eutropha JMP134
MILTRKRAAQGASTRLADGLAQASTTSTTSGSGRLATRLAAGLAGAMPTMDRRSFLKRSGIGVGVGLAASQLTLLRKADAADDKTVAAAEGKGGIVVKRTVCGHCSVGCAVDAVVQNGVWVRQEPVFDSPINMGAHCAKGAALREHGHGEYRLKYPMKLINGKYQRISWDQALDEITAKMKEMRQQTGPDSLFFVGSSKHSNEQSYLLRKWVSFFGTNNTDHQARICHSTTVAGVANTWGYGAMTNSYNDMQNAKAALYIGSNAAEAHPVSMLHLLHAKENGCKVIVVDPRFTRTAAKADHYVRIRSGTDIAFLFGVLYHIFQNGWEDPKYLQDRVYGMDKVRAEVLAKWTPDKVEEVCGVPEAQVKMVAETMAKNRPSTLVWCMGQTQHTIGNAIVRASCIVQLALGNIGVSGGGANIFRGHDNVQGATDVGPNPDSLPGYYGLATGAWKHYAAVWGVDYEWIKKQFASQTMMEKSGTTVSRWIDIVTEKNELIDQDNNVRSVFFWGHAPNSQTRGLEMKKAMDKLDLLVVIDPYPSATAAMANMPPAEGDKVNPNRAVYLLPACTQFETSGSCTASNRSLQWREKVIEPLFESMPDHTIMQAFADKLGFGKELSKNYKMIEVKRAGRTWMEPEIESILREINRSNWTIGYTGQSPERLKAHMRNMQMFDVKTLRCSGGKDAATGYDLTGDYFGLPWPCYGNPELKHPGSANLYDTSKHVMDGGGNFRANFGVERDGVNLLAEDGSCSKGAEITTGYPEFDHVLLKKLGWWDDLTDDEKKAAEGKNWKTDLSGGIQRVVLKVHGCHPFGNAKARAVVWNFPDPIPQHREPLYSTRPDMVAKYPTHDDKMAFWRLPTLYKTVQQRNIENKVYEKFPIILTSGRLVEYEGGGEETRSNPWLAELQQENFVEINPRAASDRGIRNGDFCWVKTPTGARIKVRALVTERVGPDTAFIPFHFSGWWQGKDLKDYYPDGAMPIVRGEAVNTATTYGYDSVTMMQETKTTICQIERFA

SEQ ID NO: 25860 - protein, 248 aa, Ralstonia eutropha JMP134
MYKLVLIRHGESTWNLENRFTGWVDVDLTDTGAAQARLAGKLLKEAGFAFDVAYTSVLKRAIRTLWHVQDEMDEMWIPVRNEWRLNERHYGALAGLNKAETAAKFGDEQVLVWRRSYDTPPPALEPTDPRASYDDPRYANVPREQIPLTECLKDTVARVLPLWNESIAPDIQSGKRVVIAAHGNSIRALVKYLDQISDDDIVGLNIPNGTPLVYELDASLRPLRHYYLGDQEAIAASLAAVASQGKAR

SEQ ID NO: 25861 - protein, 459 aa, Ralstonia eutropha JMP134
MAQGFDAIIIGTGQAGPALAARLSGAGMKLAIIERARFGGTCVNTGCIPTKTLIASAYAAQLARRAAEYGVTIGGPVAVDMKRVKARKDEISGRSSNGVEQWMRGLANITVYQGHARFENAHSVQVNGELLEATQIFVNVGGRALVPPMPGLDQVPYLTNAGMMDVDFLPEHLIVIGGSYIGLEFGQMYRRFGARVTVVEKGPRLIQREDEDVSQAVREILEAEGIDIRLNANCLSARRDGDHLAVGLDCASGAPEVHGTHLLMAVGRVPNTDDLGLDKAGVETDARGYIKVDEQLRTNVPGIWALGDCNGRGAFTHTSYNDHEIVAANLLDNDPRKVSDRIAAYAMFIDPPLGRAGMTETEARQSGRKILVGTRPMSRVGRAVERGESLGFMKVVVDADTRVILGAAILGLTGDEVIHSILDVMYAGAPYTVISRAMHIHPTVSELVPTLLQELRVPG

SEQ ID NO: 25862 - protein, 441 aa, Ralstonia eutropha JMP134
MTHVFHRNPRQTLPVAVAGSGVELVDSEGRRYLDASGGAAVSSLGHGHPRVIAAIKAQLDTIAYAHTSFFTTEVSETLAQTLAQAAPGDLEHVYFVSGGSEAVEAALKLARQYFVELGQGSRRHFIARRQSYHGNTLGALAIGGNAWRREPFLPLLVPAHHVSPCYAYRDQVAGETDAQYAQRLADELEAKIQELGAENVAAFVAETVVGATAGAVPPVGDYLKRIRAVCDKYGVLLILDEVMSGMGRTGYLFACEEDGVVPDIVTIAKGLGGGYQPIGAMISTRRIYDTIVAGSGFFQHGHTYIGHATACAAALAVQRTIAEDNLLANVRQRGEQLRARLRESLGNHPNLGDIRGRGLFVGVEFVADRDSKATLDPKLKTHARLKSTAMQHGLLVYPMGGTVDGVHGDHVLFAPPFICTAQDIDKIVERFTAAVAAVLPA

SEQ ID NO: 25863 - protein, 438 aa, Haemophilus influenzae R2866
MPTLEKTFELKQRGSTVRQEIIAGLTTFLAMVYSVIVVPNMLGAAGFPAESVFIATCLVAGLGSILIGLWANAPMAIGCAISLTAFTAFSLVIGQKVAIPVALGAVFLMGVVFTLISTTGIRAWILRNLPSNIAHGAGIGIGLFLLLIAANGVGLVVSNQAGLPVKLGDFTSFPVMMSLIGLAFIIGLEKMKIKGGILWVIIAITIVGLIFDPNVKFGGEIFKMPTFGENSLFLQLDFMGALQPAILPVVFALVMTAVFDATGTIRAVAGQADLLDKDGQIINGGKALTSDSISSLFSGLFGTAPAAVYIESAAGTAAGGKTGITAIVVGVLFLLMLFFQPLAFLVPGYATAPALMYVGLLMLSNVSKLDFDDFVGAMSGLICAVFIVLTANIVTGIMLGFAALVIGRIVSGDIKRLNVGTVIIAIVLVAFYAGGWAI

SEQ ID NO: 25864 - protein, 227 aa, Haemophilus influenzae R2866
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDSEIMDFEIPTGQPLVLKLDDKLNYVEHYYL

SEQ ID NO: 25865 - protein, 223 aa, Haemophilus influenzae R2866
MNAKELIARRIAMELHDGDIVNLGIGLPTQVVNYLPDNVNITLQSENGFLGLTAFDPENANSNLVNAGGQPCGIKKGGATFDSAFSFALIRGGHVDACVLGGLEVDQEANLANWMVPGKMVPGMGGAMDLVTGAKKVIIGMEHCAKSGSSKILKKCTLPLTASKKVAMVVTELAVFNFIEGRLVLKEHAPHVDLETIKAKTEADFIVADDFKEMQISQKGLEL

SEQ ID NO: 25866 - protein, 436 aa, Haemophilus influenzae R2866
MAKIVKVIGREIIDSRGNPTVEAEVHLEGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTPGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 25867 - protein, 454 aa, Haemophilus influenzae R2866
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVADALKVVRS

SEQ ID NO: 25868 - protein, 257 aa, Haemophilus influenzae R2866
MSMLKVSNIQKNFNGNHVLKGIDFEINKGEVVAILGPSGSGKTTFLRCLNLLERPEQGILEFTDGSLKIDFSQKISKADELKLRRRSSMVFQQYNLFPHRSALENVMEGMVVVQKQDKAQAREKALSLLEKVGLKNKADLFPSQLSGGQQQRVGIARALAVKPDIILLDEPTSALDPELVGEVLQTLKMLAQEGWTMIIVTHEMQFAKDVADRVILMADGYIVEQNTADKFFTCPQHERTKQFLLQAKIPLELDYYI

SEQ ID NO: 25869 - protein, 264 aa, Haemophilus influenzae R2866
MNQNLIEVKNLTFKRGDRVIYDNLNLQVKKGKITAIMGPSGIGKTTLLKLIGGQLMPEQGEILFDGQDICRLSNRELYEVRKRMGMLFQSGALFTDISTFDNVAFPIREHTHLPESLIRQIVLMKLEAVGLRGAAALMPSELSGGMARRAALARAIALDPDLIMFDEPFTGQDPISMGVILSLIKQLNEALNLTSIVVSHDVEEVLSIADYAYIIADQKVIAEGTSEQLLQSQDPRVVQFLKGESDGPVRFKYPAQDYMKELFE

SEQ ID NO: 25870 - protein, 465 aa, Haemophilus influenzae R2866
MGPSTDRDNNLEKIIAAGANVVRMNFSHGTPDDHIGRAERVRSIAKKLGKTVAILGDLQGPKIRVSTFKDGKIFLNIGDKFILDAELPKGEGTQESVGLDYKTLPQDVVPGDILLLDDGRVQLKVLSIDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 25871 - protein, 382 aa, Haemophilus influenzae R2866
MAKKDYYEVLGLQKGASEDDIKRAYKRLASKHHPDKNQGSKEAEEKFKEINEAYEVLGDDQKRTAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHHIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 25872 - protein, 342 aa, Haemophilus influenzae R2866
MKERIKAICLEKPNNVVVKEVPYPEKSDNDVLIQVESMGICGSDIGAYRGTNPLVTYPRILGHEIVGRVIESGIGMPDRVRVGDRVIVDPYVFCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYTSFAGRIALTGWPKTETPLPTNLITFKELNIYGSRTSKGEFEEALDMLATNKINASHIITKCIKFEEIPSFISDLSDHPENYLKINAVF

SEQ ID NO: 25873 - protein, 169 aa, Haemophilus influenzae R2866
MVTLHTNFGDIKIKLDFDKAPVTAENFLNYCKEGFYNNTIFHRVIDGFMIQGGGMESGMREKATKAPIQNEANNRLSNKRGTIAMARTSDPHSATAQFFINVADNDFLNYRSKEMFGREVVQEWGYAVFGEVVEGMDVVDKIKKVKTGNKGFHQDVPTEDVVITLVSVE

SEQ ID NO: 25874 - protein, 331 aa, Haemophilus influenzae R2866
MKIAIYSTKNYDRKYIELINAKYNFDLEFFDFMLNESTVRLAEHCEVVCIFVNDNGSRKVLEKLAALGVKIVALRCAGFNNVDLKAAQELGIQVVRVPAYSPEAVAEHTIGLMMTLNRRIHRAYQRTREANFSLEGLIGFNMYGRTVGVIGTGKIGIAVMRILKGFGMNILAYDPFKNPVVEELGGQYVELDELYAKSHVITLHCPATPENYHLLNREAFAKMKDGVMIVNTSRGSLIDTQAAIDALKQRKIGALGMDVYENERDLFFEDKSNEVIQDDIFRRLSSCHNVLLTGHQAFLTEEALTNIADVTLSNVYKLKSGKVCENIVLPS

SEQ ID NO: 25875 - protein, 369 aa, Haemophilus influenzae R2866
MTQQYAIDTLLAQAGNRSDERTGAVSAPIFLSTAYGHCGIGESTGFDYTRTKNPTRTVLEETIAKLENGDRGFAFSSGMAAIQVLMTLFTAPDEWIVSSDVYGGTYRLLDFSYKNNNSVKPVYVNTAFASEIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKDQPQVESVLYPNKGGMLSFRLQDEAWVNTFLKSIKLITFAESLGGTESFITYPATQTHMDIPESERVARGITNTLLRFSVGIEDVEDIKADLLQAFANLK

SEQ ID NO: 25876 - protein, 320 aa, Anabaena variabilis ATCC 29413
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALCAAIRVAQRPENAGRLIVLIQPSFGERYLSTPLFQDLETKVTASIS

SEQ ID NO: 25877 - protein, 365 aa, Anabaena variabilis ATCC 29413
MSTNINLFSSYQLGELKLPNRIVMAPLTRQRAGEGNVPHQLNAIYYGQRASAGLIIAEATQVTPQGQGYPHTPGIHSPEQVAGWKLVTDTVHQQGGRIFLQLWHVGRISHPDLQPDGELPVAPSAIAPKGEVLTYEGKKPYVTPRALETSEIPGIVEQYRQGAANALAAGFDGVEIHAANGYLIDQFLRDGTNQRTDEYGGAIENRARLLLEVTEAVTSVWDSQRVGVRLSPSGTFNDIRDSHPLETFGYVAQALNRFNLSYLHIFEAIDADIRHGGTIVPTSHLRDRFTGTLIVNGGYTREKGDTVIANKAADLVAFGTLFISNPDLPERLEVNAPLNQADPTTFYGGGEKGYTDYPFLEVASK

SEQ ID NO: 25878 - protein, 415 aa, Anabaena variabilis ATCC 29413
MQAANISLEISSFDTMNTQDYIELEQQYGADNYHPLDVVITKGEGVWVWDIEGKKYLDFLSAYSALNQGHCHPKILQAMIKQAQQVTLTSRAFRNDQLGKFYQKLCQISGLPKVLPMNSGAEAVETAIKAIRKWAYKVKGIPENQAEIIVCSNNFSGRTISLISFSTEEQYQDGFGPLTTGFKVIPFGDAQALEQAITPNTAAFLVEPIQGEGGIIVPPHGFLKQAEQICRHHHVLLVFDEIQTGLGRTGKMFAHQYENVKPDGITVGKALSGGFYPISAFISTEEVMGIFQPGDHGSTFGGNPLAAAIGIAALDVLIEEKLPEKALKLGEYFIEKLQSIESTYIKEVRGKGLLIGMELYPEAGGARRFCKALAKEGLLAKETRDNVIRFAPPLVISEDEIDWALEKIERVLTTT

SEQ ID NO: 25879 - protein, 239 aa, Anabaena variabilis ATCC 29413
MEIADFLGLIHPAIAVIFVFPLIGIVSNFAWQTRQRRFQTLAGGKSKIPPIVGTEHRRIGEWLSSAVVGISLVGLGYAIGKNIIKNQLWNKNLTQVIFILIMFVLTIASLVFLYQAKQKLWRGIFATLTGVGLVVIGCQDGVFRRTNEWYWSHYYIGIAASLLMIFSVAIVQDIYQDKTHRWRIIHTILNTIALLLFIGQGFTGTRDLLEIPLSWQEPYVYQCNFAQKTCPNPPSQESK

SEQ ID NO: 25880 - protein, 327 aa, Anabaena variabilis ATCC 29413
MRVFVTGATGFVGANLVRLLLQQGYTVKTLVRPQSNLGNLQGLDVEIVEGDFDNQYLWRQMSGCRYLFHVAAQYSLWQKDRDLLYQNNVLGTFQVLEAAQKAGIERTVYTSSVAAIGVNPSGAIADETYQSPVDKLIGHYKKSKFLAEQEAVQAAAKGQDVVIVNPSTPIGPWDIKPTPTGDIILRFLRRQMPAYVNTGLNLIDVRDVAWGHLLALEKGKSGDRYILGHQNLSLKQLLEKLAEITGLSAPQWTVPGWLPLSVAWMEEKILAPLGKPPSVPIDGVRMAQQTMYYDASKAVKELGLPQSPVDIALKDAVNWFVSQGYVK

SEQ ID NO: 25881 - protein, 334 aa, Anabaena variabilis ATCC 29413
MSDQANQGDLEIRPSPLLTVINDLHSKYKSLKEGIVANYIPELAKVNPDLFSISIVTVDGQVYQVGDYQQLFTIQSISKVFAYGLALEDHGRDYVLTRVGVEPTGEAFNSIILDEQSKRPYNPMVNAGAIATTSLIKGAGATERLNRVLEMFRRYIGHDVFVDISVFTSERSTGHRNRAMAHLMLNFGMIDRNLEEALDLYFQQCAVMVNCHDLAVMAATLANRGVNPVTGEQAVNSRYIKDILSVMYTCGMYNFAGEWAYKVGIPAKSGVCGGIMAVVPNQMGIAVFSPPLDIRGNSVRGVKVCEELSQQLGLHLFECVKVENGKWGVGNCEC

SEQ ID NO: 25882 - protein, 330 aa, Anabaena variabilis ATCC 29413
MTTQGNPEVLQLQEVPNPSLPVGSTELLVRLVAAGINPIDTKLRKRGTFYPEKMPAILGCDGAGIVEAVGAGVQSFGAGDAVYFCNGGLGGHQGNYAEYTVVDERFVARKPASLTFAEAAAAPLVLITAWEALYERGRLEPGEKVLIHAGAGGVGHVAIQLAKLKGATVATTVGSEDKAHFVKQLGADHVIFYKNTDFAQAALNWTNGEGVDLAFDTVGGDTFHKTFPAVRIYGDIVTILEPDANTVWKVARNRNLRIGLELMLTPMFLNLVEAQQHQAEILTECADWIDQGKLKIHVSHKFPLQDAAKAHQLLESGSIAGKIVLLISDE

SEQ ID NO: 25883 - protein, 331 aa, Anabaena variabilis ATCC 29413
MQNLQNFRDYYEILGVTKDATNEDIKKNYRRLARQYHPDLNPGNKDAEEKFKIIGEAYEMLSDATKRAQYDQFSRYWKQKGFPKQTPKSKAWGDSRNGERNGNENVDPSQFTNFEDFLNQVIGVGSRRDSKNGASTNTTTDPFRSPKSRVEYTVPKNPARPARRDIEARLTLPFEKAYSGGNERIRLEDGRSLEVTMPPGMVTGQTIRLRNQGISGGDLYLKITVEPHPLFKLEGTNIFCQVPVTPSEAVLGGQVEAPTLDGPVKMTIPPGVRSGQRFRLANKGYPSDNGKRGDQLVEIQILTPKTISQEERELYEKLRQIETFKPRADLI

SEQ ID NO: 25884 - protein, 355 aa, Anabaena variabilis ATCC 29413
MTHLFEPLRIREVTFRNRIALSPMCQYSSTNGFANDWHLVHLASRAVGGAGLVMTEAAAVEARGRISPQDLGIWSDAHIEALARTVSLIHNFGAVAAIQLAHAGRKASTSKPSKGGKFIDESQEGWRPVVSSSAIAFSKESPVPEALSIEGIQQVIQAFVQATKRSLQAGFKVIEIHAAHGYLLHQFLSPLVNQRQDDYGGSFENRTRLLREVVEAVREVLPESYPLFVRLSATDWVDKGWDIEQSIAISDKLKSLGVDLIDCSSGGVIPGINIPVKPGYQAQFAERIRKEANIPTGAVGLITSPEQADQIIRSGVADIVLLGRELLRNPYWPHLAAKELGHEKHWPVQYDRAWL

SEQ ID NO: 25885 - protein, 306 aa, Anabaena variabilis ATCC 29413
MFPVIYSDEFLDHKTGKYHPESPERLTAIVNALKQAAFAEKVTWIEPTPALENSSVMPLLVKVHSPGYVNKVRDIATTGGGYLDGDTPVSPRSYDVALLAVSAWLNGMDAVLESANPAFVLARPPGHHAEGDAGMGFCLFSNAAIAAYYALEQPGINRVAIIDWDVHHGNGTQAIVEVNPQIAYCSLHQYPCYPGTGRATEKGFHNNVLNLPVPPGSDLAVYQPLWEKKIIPFLSEFQPDLLIVSAGYDGNADDPLASVNLQPKDYGLFTNYCLGITRKILFGLEGGYDLPTLSQSVLATIASCLA

SEQ ID NO: 25886 - protein, 328 aa, Anabaena variabilis ATCC 29413
MRAMILDAPRQPLRLTELPIPRPNSEQVLIRVHACAVCRTDLHIVDGELTHPKLPLILGHQIVGTIEALGEKVDQFHLGQRVGVPWLGHTCAHCPYCLSGRENLCDYAEFTGYNIDGGYADYTVADHHFCFPLDPTYPDLQAAPLLCGGLIGYRAYNMTGDAEKLGFYGFGSSAHILIQLARYQGRKVFAFTRPGDIDGQEFARQLGANWAGDSDVLPPESLDAAIIFAPVGKLVPTALRAVAKGGVVVCAGIHMSDIPSFPYSILWEERVLRSVANLTRQDGEEFLTIAPQIPIRTKINSFPLTQANEALDALRSGKIEGSAVLVMK

SEQ ID NO: 25887 - protein, 307 aa, Anabaena variabilis ATCC 29413
MSLTFVPPPIQKINSEIANNAGVEIDVLRLDLMHPWVNGNKWYKLKYNLLEAKEKGYTTLLTFGGAYSNHIFATAAAGNLLGFQTIGVIRGEETLPLNPTLSFATKQGMQLVYVDRETYRQRNSATLHADLRKRFGEVFIIPEGGSNLNGVRGCLEIISAATQAFNIVCVACGTATTLAGIALALEAKQRVIGFPVLKNGGFLAEEITQFMNNYVAAGLPISSSSPAHWELVCDYHFGGYAKVKDDLIVFSQQFTQTHGVPLDYVYTAKMFYGVMDLLKQRYFTKGDRILMIHTGGLQGNIGMSERL

SEQ ID NO: 25888 - protein, 181 aa, Anabaena variabilis ATCC 29413
MVLGGSGSGKSTQAQRLCSHLGITQISTGEILREAISHLSELGRQAQPYMVKGELVPDEMIIELIRLRLKKFDVSDGWVLEGYPRTAFQAEELDFLLDELGQKLDWAIYLQVPEAVMVSRSLGRSLPDDQPEIVQRRVEIFYDRTVPILEYYDRRRRLLTINGDQAPELVLQNILKLLLVT

SEQ ID NO: 25889 - protein, 354 aa, Anabaena variabilis ATCC 29413
MSSPLFPVILAGGKGERFWPLSRQDRPKQFLSLDGSSRSLLQSTAERLVKFAGEWNDLWVITSSQLGQGVQQQLPELPSQNLLTEPQGRDTAAAVAWASLEIQKRYGDDAIIGFFPSDHWIADPEAFKRTLDAASQLATSTEAIVTLGIKPTFPSTGYGYIEQGEKIGTFNELPAYHVNRFTEKPIREKAETFLSTGRYSWNSGMFVFRAGVVLKELYTYAPEIIEPLVEHGVDVYPQLPKKSIDYALMEKTNLVYVLPAEFGWDDLGDWNAIERLLKKPDDPNVELATHVGLDTQGAIVYATNPEDVIVTIGLEDVVIVRDRNVTLIVNKERTQEIKQIIKTLQGDPRFTDLL

SEQ ID NO: 25890 - protein, 310 aa, Anabaena variabilis ATCC 29413
MDELGHPPISELKPEASRFFYQEAIKLYHLTNEEGVTIEDRWIKRLEDISIPIRVYTPRDEVDNINSIQEKSTLYPILVYFQGGGWIFGNLDSADAPCSFLCKHINCIVVSVQYRQAPEYKCPIPVIDALEAIKWVHKNSQSLGGDAQKIAVGGESAGANLAAVAAIKLRDEGNISLEAQLLITPVTQYGFNTQSYQAGYTKGLSLETMKWFWNHYLENDLQGEEYYASPLKVQDARNLPPCLIVTAEHDPLRDDGLLYAQYLQSFQVKVKILHYESFIHSFIRMIRVIEDTRQALYEIAINFREMLYFY

SEQ ID NO: 25891 - protein, 493 aa, Anabaena variabilis ATCC 29413
MQLNHNGVHSEGHSFVVPQICPSQSSVGSDFPSNRVHSLPGEASSQYLERQQARESNARSYPRRIPIAISEAQGIYIKDADGNVYIDCLAGAGTLALGHNHPVAIEAMRKVLDGGLPLHTLDLTTPVKDKFVEELFASLPPEFAQNVKIQFCGPSGADAVEAAIKLVKTATGNRSVLSFHGGYHGMTHGALSLTGNLNPKQAVTGLMPDVHFLPYPYHYRCPFGLGGEAGQRTSSRYIESILDDPESGIVTPAAMILEVVQGEGGVIPAPDDWLREMRRITRDRHIPLIVDEIQTGLGRTGKLYAFEHSGIMPDVLLLSKAIGGSLPLSVVLYNKELDKWSPGAHAGTFRGNQMAMAAGTATLQYILENSLTEHAAAMGDRLLKHLHQIQGETYCIGEVRGRGLMVGVEIINPQASADRRGKYPAHPQLASRIQAECLRRGLIVELGGRFGSVVRFLPPLIVTPAQIDSICEIFASAVQAAEKQVLSVLSQVS

SEQ ID NO: 25892 - protein, 498 aa, Anabaena variabilis ATCC 29413
MAINTGKNKLMNRHIQPWQRLLVLAIGSMVFAVFAPTIVQAANTPTLESLSETTIKLQISIDTTWVLLSGFLVFFMQTGFAMLEAGLVRQRSVVNTLLENFIDAAVTVLAWWAVGFGIAFGTSAGGLFGIDTFFLNQLPGADGSYPLGAPGSTAAINTYTLFFFQFAFAATASTITTGSMAGRTDFIGDLIYSAIMGAISYPIIVHWAWNSNGWLGKLSYHDFAGGSIVHTVGGWTALVGAYLLGPRPDRPPWGKLPPAHNLALATLGTMILWFGWYGFNPGSTLGTANPGLIGLVTINTTLAAGAGALTALIFLYVRTGKWDLVYCLNGSLAGLVAITAPCAYVAPWASVLIGFTGGISVVLGVSLIESLHIDDPVGAFSVHGISGMMGTLSIGFLGQAELTLNQKAGLFLGGGFDLLGIQMLGIVAITVFTVAFAFLMYGGLKAVGYLRVNAEADSIGIDAYEHGASVWPDIYPVEEVSKLQDQTKISENKTLEEQ

SEQ ID NO: 25893 - protein, 429 aa, Anabaena variabilis ATCC 29413
MSNIVDTAIEAIVAREILDSRGRPTIEAEVHLLSGAVGLAQVPSGASTGTFEAHELRDKDKSRYGGKGVLKAVHNVNEVLAPKLIDLDAINQELIDRTMIALDGSGNKSNLGANAILAVSLAAARAGAASLGIPLYRYLGGPLANLLPVPLMNVINGGAHAANNVDFQEFMIVPVGATSFREALRWGAEVFATLSEVLHDKGLLTGVGDEGGFAPNLESNQVALELLVAAIEKAGYKPGEQVALALDVAASEFYKEGQYVYDGRPHAPTEFIDYLGQLVDQYPIVSIEDGLHEEDWQNWQLLTQKVGSRVQLVGDDLFVTNATRLQKGIQEKAGNAILIKLNQIGSLTETLETIDLGTRNGFRSVISHRSGETEDTTIADLAVATRAGQIKTGSLCRSERVAKYNRLLRIEDELGDRAVYAGAVGLGPK

SEQ ID NO: 25894 - protein, 460 aa, Anabaena variabilis ATCC 29413
MLTIETSKIREIIQQERNFFQTGQTKNINFRLEQLKKLRKLVTDNETAITKALKADLNKSEYEAYFAEIGVIKEIDYAIKNLKNWSKPKKADVPLDFFSYSARIYPEPLGVVLIICPWNYPFGLIISPLVGAIAAGNCAIIKPSELAPHTSNLVAELISKYFSSEYLTVVEGGAETSQELLAEKFDHIFFTGGTAIGKVVMEAAAKHLTPVTLELGGKSPCIVDSEIHLEYTAKRITWGKFINAGQTCIAPDYLLVNQKIKKDLIAAIQKSLTEFYGDNPIDSPDYGRIISHRHFERLAKFLNNGQVIVGGETNYEDKYIAPTLLDNISVTDPVMQEEIFGPILPVIEYTEIKDAIALINSQPKPLALYIFSQNKDLQQQILQETSSGGVCINDTIMQVGVSSLPFGGVGDSGIGSYHGKASFDTFSHYKSVLKNAFWLDLDWRYAPYKDKLSLLKRMMK

SEQ ID NO: 25895 - protein, 472 aa, Dechloromonas aromatica RCB
MHRNRNAKIVATLGPASSDRDTIQKLYLNGADIFRLNFSHGTHEDHKRSLETIRDVEREAGRPIGVLLDLQGPKLRLGKFANGPITLAEGDKFRLDLDCDRPGDQTRAPMPHPEIFKALSVQSSLLIDDGRIRLFVEKCGPDFAETRVVAGGTLSDRKGVNVPGSLIPMSAMTDKDRADLDFGLTLGVDWVALSFVQRAEDILEIKKIIDGRAGVIAKLEKPAAIERLEAIVNVSDAIMVARGDLGVEMPPEQVPAIQKRIIRACRSAGKPVIVATQMLDSMVAAPVPTRAEASDVATAIYDGADAVMLSAESASGKYPVAAVKMMDSIISRTESDPYYRVAIDASQPPARANKADAIGSAVRHVADLLHIAVTVAYTSSGTSALSMARERPKAPIIALTPRLATARRLSLAWGLHAVMCHDVVDVTEMTDLACETARRQHFASRGQSVVISAGMPFGRSGTTNLLRIAELS

SEQ ID NO: 25896 - protein, 359 aa, Dechloromonas aromatica RCB
MAQLELSGVVQRYGKHTVVDGVNFRLEGGSIACLLGPSGCGKTTLLRCIAGFEDISGGEISLRGEVVSRAGQRVAPEKRRIGMVFQDYALFPHLSVEENVAFGLGRKPAEDAHLRVRQLLATVGLHGQGNKYPHELSGGQQQRVALARALAPRPELILLDEPFSNLDVGLRERLSVEVREILKREGSTAIMVTHDQNEAFAMADEIGIMHEGRIQQWDVPYNLYHRPANRFVADFIGQGVLLPGVVAGGTNVEMELGQLVSDIAVECSETCANCGDGCEVDVLLRPDDIVHDDRSPLQAEVLHKAFRGADILYSLRLKSGAEVLSLVPSHHNHAIGEKIGIRLDADHVIAFKKLNDQHA

SEQ ID NO: 25897 - protein, 299 aa, Dechloromonas aromatica RCB
MYKTLQDFVGNTPLVRLVRIPGADNDKRGNVILAKLEGNNPAGSVKDRPALSMIVHAEARGDIKPGDTLIEATSGNTGIALAMAAAIKGYRMILVMPENQSVERRQSMRAYGAELVLTPKDGGMELARDVADKMRDEGKGIILDQFANPDNPLAHYEGTGPEIWRDTDGKITHFVSSMGTTGTIMGTSRFLKEANPAIEIVGCQPEDGSQIPGIRKWPEAYLPKIFDKTNVDRVEYVSQADAEAMTRRLAMEEGIFAGISSGGALAVALRLSQQLENAVIVSIICDRGDRYLSTGVFPA

SEQ ID NO: 25898 - protein, 384 aa, Dechloromonas aromatica RCB
MYITNRPDLVFERGEGSWLIDHQGKRYLDFIQGWAVNCLGHCPPEITEALVEQAGRLINPSPAFYNGPMVELAGLLTANSCFDRVFFANTGAEANEGAIKLARKWGRLHKGGAHEIITFEHSFHGRTLATMSASGKAGWDTLYAPQVSGFPKAAYNDIAAVEALIGPKTVAVMLEPVQGEGGVIPAGIEFLKALRELTRQRGILLIVDEVQTGVGRTGKLFAHEHADIEPDIMTLGKGIGGGVPLAALLAREAICCFEPGDQGGTYNGNPLMTAVGVAIMKRMLAPGFLAEIEARGQYLAKCLRELSAKHGLKGERGSGLLRALILDDERAPQIVQRALTMQPVGLLLNAPRPTLLRFMPALNVSETEIDQMIAMLDELLAKQD

SEQ ID NO: 25899 - protein, 396 aa, Dechloromonas aromatica RCB
MNPHLAQLQPYPFEKLRALFAGVTPNPQYKEIKLSIGEPQHPTPAFIMDALANGLKGLANYPTTQGIPLLRQTIAKWCRHRYGLELNPETEILPVNGSREALFSFAQTVIDPSRGHVPLIVSPNPFYQIYEGAAYLSGAEPRFLNNLPDNDFAFDYASLSEEEWARVQLFYVCSPGNPTGKVLSLADWKTLFALSDKYGFIIASDECYSEIYFDEANPPIGGLQAAKLLGRTNERLVMFSSLSKRSNVPGMRSGFVAGDEKILKKFLLYRTYHGCAMAPPVQTASIAAWNDESHVLDNRNQYREKFAACTPLIGEVLGTGMPDASFYLWAKTPIADTEFARGLLEHYNVVVLPGSFLAREVRGVNPGANFVRIALVASLDECLEATQRIRQFAQQL

SEQ ID NO: 25900 - protein, 172 aa, Dechloromonas aromatica RCB
MGFSPTAALAEVRTYKLARATETRNTCPYCSVACGLLMYSIGDKSKNVHQEIIHIEGDPDNPVNRGSLCPKGAGLLDFVHSPNRLKHPEVREAGTNEWKRISWDEAFTRIATLMKEDRDANFIAKNADGVTVNRWLSTGFLAASASSNESGYITHKVVRSTGMIAFDNQARV

SEQ ID NO: 25901 - protein, 175 aa, Dechloromonas aromatica RCB
MDLRADHFSLFGLNRGFRLDLSDLDSRYRDIQAQVHPDRFANASDAERRMSMQWATHANEAYQTLKKPLERAKYLLHLAGHDIKAESNTSMPADFLMEQMEWREAVMDARNGGDHHELEHLHNRLSGDVKNRYEELAQLLDDAGDHAQATDRVRRLMFLEKLLYEIDDALASLEE

SEQ ID NO: 25902 - protein, 453 aa, Dechloromonas aromatica RCB
MAKVKTIYSCTECGATSPKWQGQCPGCNEWNTLVETVAEKAATNSRFESLAPTARLQNLSEIEAREVERIATGIGEFDRALGGGLVNGAVVLIGGDPGIGKSTLLLQALAHLSLDNKVLYVSGEESGEQVALRARRLGLDTRRLQLMAEINLERILATLQAEKPVVAVIDSIQTLWSDQLSSAPGSVAQVRECAAQLTRLAKQAGITVILVGHVTKEGALAGPRVLEHIVDTVLYFEGDTHSSFRLVRAVKNRFGAVNELGVFAMTDKGLKGVNNPSALFLSQHGQDVAGSCVMVTQEGTRPLLVEIQALVDTSHGNPRRLTVGLDPQRLAMLLAVLHRHAGIVCFDQDVFVNAVGGVKITEPAADLAVLLSITSSLKNKALPSKLIVFGEVGLAGEIRPAPRGQERLKEAAKLGFTRALIPEANRPKQAIPGMEVIAVKRVEEAVARIREME

SEQ ID NO: 25903 - protein, 315 aa, Dechloromonas aromatica RCB
MEFKDYYKIMGVARDATQDEIKRAYRQLARKYHPDVSKDPEAEIRFKELGEAYAVLKDLEKRAAYDRLGANWQAGQDFRPPPDWNAGFEFSGDGANGRGAEDFSDFFESLYGRGFAGAGRGQREFHARGEDRHAQIMIDLADAYSGATRVITLGTPEVDANGRVTMRSHQLNVTIPRGVRAGQHIRLTGQGAPGIGQGKAGDLYLEVAFNPHAHFRVEQRDVFLDLPLAPWEAALGATVSVPTPDATVDLKIPPNSKSGGKLRLKGRGIPGNTPGDFYVVLQVVLPVAESEADKAFYASMAEQFKSFKPRSRLGA

SEQ ID NO: 25904 - protein, 275 aa, Dechloromonas aromatica RCB
MQTSPSTTLQQQDLSIAGPAGPLALRLYRPSLARVVLPVVLYFHGGGFVGGSLDDADAAAGFIAEHTPALVVAVDYALAPARPFPAAPEDAHAAALWTAAHAAELGGDPARLAVAGDDAGGNLAAALTLIARDRNGPAIAAQALVGPMLDPSMTRLGDGVRLNSDLSAATCASCYSQYLPQSRQRLHPYASPLASVRQAGLPPALIVTAECDVLHNEAEKYAAALIAAGVPTQVVRFAGVNHATLASHRPALAEIAHFLRRRLWDAEAPAHPLNL

SEQ ID NO: 25905 - protein, 511 aa, Dechloromonas aromatica RCB
MHDIIRQLEKKREMARLGGGQKRIDSQHKKGKLTARERLELLLDPDSFEEWDMFKEHRCVDFGMDQAEKTPGDGVVVGYGTINGRLVFVFSQDFTVFGGSLSETHAEKICKVMDQAMKVGAPVIGLNDSGGARIQEGVASLGGYADVFQRNVMASGVVPQISMIMGPCAGGAVYSPSMTDFIFMVKDSSYMFVTGPEVVKTVTHEDVTAEELGGAVTHTTKSGVADLAFENDVEALSMLRRFMNFVPSNNKEKPPVTPTNDPVDRMDYSLDTLVPDNANKPYDMKELLVKVVDDNDFFELQADYAKNIIIGFGRVDGHPVGIVANQPLVLAGCLDIKSSIKAARFVRFCDAFNIPVVTFVDVPGFMPGTTQEYGGIIKHGAKLLYAYAECTVPKVTVITRKAYGGAYDVMSSKHLRGDVNLAWPSAEIAVMGPKGAVEIIFREEKSDPAKLAQREAEYKEKFANPFVAGARGFIDDVIMPHATRKRIARSLAMLRDKKLDNPWRKHGNIPL

SEQ ID NO: 25906 - protein, 300 aa, Dechloromonas aromatica RCB
MNPSLAKHQSWFEATARKRVAGLLDAGSFNEILPPAASMPSPHLAQLDLPGAFDDGVVVGTGQLSGKPIYVIAQEGQFMGGAVGEIHGAKIVGLLRRAVAEKPAAVLFLIDSGGVRLHEANAGLIAISEIMRAVLDARAAGVPVIALVGGSCGAFGGMGIVAKLCSAILISEEGRLALSGPEVIETVAGVEEFDSKDRALVWRVTGGKHRYLMGDCAALVEDDIAAFRAGASEFVATWQEPLPSVANLRATQQRLENRLAAYATCRDGLQVWAALGVAQPEAVPLLDRDSLVALKEGLPT

SEQ ID NO: 25907 - protein, 453 aa, Dechloromonas aromatica RCB
MNSKEDLARLQQELEAKGVKYCIGAYVDIHGVPKAKVVPIHHLLHMAKGSERYTGYALDGLGQAPNDDELTSIPDFSRLIQLPWEPKIAWIPSDNHFQGKPYPLNTRVALQNQLAEAAKLGFGMNLGIECEIFLLRQNADGSLSVPDPEDKLAKACYDVRGFTNNFSWLDKVATAINDLGWDLYSFDHEDANGQFEFDFQYADALTTCDRLTFFRYMAKHYAREEGLLATMMPKPFADKTGNGAHFNMSLYDLQDGRNLFACDPKDDPNGIGLTKLGYHFVAGILKHGRALCAVFAPTVNSYKRLVRRGAMNYFSWAPVFNSYGSNNRTNSVRIPSGGGRCESRNADGAVNPYLVATLVLAAGLEGIREGLDPGKPNEDNLYAISEAERHARGIEFLPQTLQEAVAAFAADPLVEQTLGKELRDEFIRYKSEEWEAYHLTVSQWEIDRYSYMF

SEQ ID NO: 25908 - protein, 243 aa, Psychrobacter sp. 273-4
MKKITTLSISALASAMLLITGCSANNGNKETAAKSVSVTEQSPAKEKVGYSLGYMMAEGNKEAVGDLNLDTFEKGFRDGYEGKKAALTEEQMQEVLTTYQKEQEAKFVKDMESKAGANKTKGSAFLVENGKKAGVKTTASGLQYKVVTAGTGKSPKATDVVEVNYEGKLIDGTVFDSSYERGEPVEFPLNQVIAGWTEGLQLMKEGGKYEFYIPSDIAYGEAGNAGIEPNSTLIFTVELLKVK

SEQ ID NO: 25909 - protein, 473 aa, Psychrobacter sp. 273-4
MAKRLENSFQFLDVPRLEPIKKDIATRSTEFVEIYQPFESESVAQQSHRCLECGNPYCEWKCPVHNYIPNWLKLAAEGQIFQAAELCHQTNTLPEVCGRVCPQDRLCEGSCTLNDGFGAVTIGNVEKYINDTAFALGWRPDMSEVIWTDKKVAIIGAGPAGLGCADILVRNGVKPVIFDKRPEIGGLLTFGIPEFKMEKDVMRNRRVIFEGMGMEFRLETEIGTDVSIDELLGEYDAVFMGMGTYTYMRGGFAGEELEGVYDALDYLIANVNRCNDWEKDPAEYIDLKGKKVVVLGGGDTAMDCNRTSIRQGAHQVVCAYRRDEENMPGSRREVVNAREEGVEFLFNRQPTEIIGLNGKVNAVKVVTTQLGAPDENGRQYPEPIANSEEIIPCDAVIMAFGFSPSPADWFESQQISMDKSGRVLAAEKQTFKFQTNNPKIFAGGDMVRGSDLVVTAIWEGREAAEGILDYLEV

SEQ ID NO: 25910 - protein, 408 aa, Psychrobacter sp. 273-4
MALSLQKDKIRFLLLEGLHDNALKVLKDAGYQNIENISHALDQDELIEKIKDAHFIGIRSRTQLTREVLEHAQKLIGIGCFCIGTNQVDLDAAREFGIPVFNAPFSNTRSVAELVLAEAIMLYRGIPEKNATVHRGGWGKSATNSHEVRGKTIGIVGYGSIGSQLSVLAESFGMKVIYHDVLTKLPLGNAVQVASLEELLSTADIVTLHVPELPSTRYMMKAEQFAHMKEGSYFINAARGTCVEIDDLTAVLESGKILGAAIDVFPKEPKSADEEFESPLRKFDNVILTPHIGGSTQEAQANIGLEVADKFVRYSDQGNTATAVNFPEVSIPFKEGTHRLLHIHKNVPGVLSQINRLFAEANINILAQSLMTEGDVGYLVMDVDYNDSTAALDQLKDVQETIRVRILF

SEQ ID NO: 25911 - protein, 436 aa, Psychrobacter sp. 273-4
MTTVSTNDFDQQHLWHPYASLPPRYPNIMIDHADGIHIVTQDGTRLIDGMSSWWASVHGYNHPKLNAAIIEQLGKMAHVMFGGLTHQPAIDLGKKLLSIVPAGIDAIFYADSGSIAVEVALKMALQYQIAAKRPNKQQFASTHSGYYGDTWHAMSVCDPINGMHSLYGKQLPMQHFVAAPPMGFERDITQNERDELTAFFAKNSHQLAGFIIEPIIQGAGGMRFYSPEYLQLLRQLCCEHDVLLIADEIATGFGRSGKLFACEHANISPDIMTIGKALTGGYMTFAATLCTRSIADTISQSDYSALMHGPTFMGNPLACAVACASIDLILSYDIEARTENMHALMVEQLASAAKLEGVKEVRCLGAVAVIELDDAVDMPTFQSLLIEHGIWVRPFGKLVYIMPPYIITDSELITLCQALLKVVSIYLTQTSLSAKG

SEQ ID NO: 25912 - protein, 272 aa, Psychrobacter sp. 273-4
MNEPVINNADTYTNEFGGLVTNTGHASDEIVIQMSDVSKWYGDFQVLTGCSAHVHKGDVVVVCGPSGSGKSTLIKTVNGLETFQKGEIMVSGISVGAPKTNLPKLRSSVGMVFQHFELFPHLTIIDNLAVAQIKVLGRKEAEAKQKAMAYLDRVGLTAQAAKYPAELSGGQQQRVAIARALAMDPVAMLFDEPTSALDPEMIQEVLDVMVELTREGMTMMCVTHEMGFASQVANRIIFMDEGRIVENCSKDEFFEGAKSERAQLFLSKILNH

SEQ ID NO: 25913 - protein, 367 aa, Psychrobacter sp. 273-4
MAHDNLFEPVKMGTQTLKNRIIMAPLTRLRSVEPGDVPTALASEYYAQRSGAGLIIAEATQVSFQAKGYAGAPGIHTEEQMTAWKTIVDNVHAKGCKIVVQLWHTGLVAHESVQPDGKAPISASDVNVGVRTSLRDSNNQAIRVDATTPRPATLEEIQQVIADFGLATKNAKEAGFDGVEIHGAHGYLLHQFWVEHTNQRTDEYGGSRENRARLMLAVIDACVDAWDADHVGIRISPLGTFNNVEAGYNEDENIWLIEQINQRGLMYLHLSEPDWAGGTPYSTEFRQRVREAFGQMIIAAGGYTAEKAETNIKDGYIDAVAFGRDYIANPDLAERIREGAPLNEQHPQSFYGGGTEGYTDYPFLNQA

SEQ ID NO: 25914 - protein, 433 aa, Psychrobacter sp. 273-4
MSTKNEQLFAQACKHIPGGVNSPVRAFAGVGGTPIFMHRANGSKIYDTEDNAYIDYVGSWGPMILGHAHPKVIDAVKKAADDGLSFGTPTPFETTVADKICEIVPSVEMIRMTSSGTEATMSAIRLARGYTQRDKIVKFEGCYHGHSDSLLVKAGSGMLDIGEPTSKGVPADFAKHTITIPYNDSQAIKDCFEKWGEEIACVILEPIAGNMNMVIPSQEFHDTLREQCTANNSVLIFDEVMTGFRVGLGGAQAHFGIDPDLTCFGKIIGAGLPVGAFGGKKEVMSCIAPLGGVYQAGTLSGNPLAMRAGIAMFEDLTAEGFYDELAVKVDRLVDGFQAAADKHGINLRTNKLGGMFGMFFVTDGDTAVPQNFDEVTECDMEVFNTFFHGMLDRGIYLAPSAYEAGFMSIKHSDEDIDTSIKAADEIFAEMAKA

SEQ ID NO: 25915 - protein, 483 aa, Psychrobacter sp. 273-4
MKDSYDLVVIGGGPGGYEAAIRAGQLGMSVACIEKRVYKGEPALGGTCLNVGCIPSKALLDSSHRYEATKHDLAEHGISTGDVAIDIEQMIARKEGIVKQLTGGIAALLKGNGVDWLQGWGTLVDGKGNDKKVKFTALADDSETTITAKNVILAAGSVPIDIPVAKTDGDRIVDSTGALDFTAVPKRLGVIGAGVIGLELGSVWRRLGAEVVVYEALPSFLAAADKDIAKEAGKMLKKQGLDIRVDTKVTNAEVKGDQVIVTSEAKGESSEESFDKLIVCVGRRAYSEKLLGEDSGIQLTERGLIDVNDQCKTNLDGVYAIGDLVRGPMLAHKAMEEGMMAVERIHGDKAQVNYDTIINVIYTHPEIAWVGLTEQEAEAAGYEVKTGSFNLAANGRALAQSEAQGSIKVVADAKTDRLLGMHAISAGAGDIVHQGMIAMEFVSSIEDLQLMTFAHPTISEAVHEAALSADGRAIHAIQRKKRK

SEQ ID NO: 25916 - protein, 269 aa, Psychrobacter sp. 273-4
MQAWVIGNWKQNPATSHDVDALLNELCTAISTTKQLSHNNSTRCQIMVAPSFLHLAAVSSRLKDTSVLCAAQDVSAYSASVGAYTGDCSAQQIADVGATWTILGHSERRQYHQESNDTLLQKMTHALTQELGVVFCIGETQAQYDAKQTLPVIDSQLAVVKKLIAEQPEVIDSLSTRLIIAYEPVWAIGTGKVPTVSEVSATHQYIKQTLAGFADSLSNMTVLYGGSVNADNADSFAADPMIHGALVGGASLKAESFLAIVTAFSKGSM

SEQ ID NO: 25917 - protein, 229 aa, Psychrobacter sp. 273-4
MISPSKPYLIAPSILSADFAKLGEEVERVLASGADVIHFDVMDNHYVPNLTFGSMICKALRDYGIEAPIDVHLMVSPVDSMIEQFLEAGASIITFHPEASSHIDRSLQLIKDGGAECGLVLNPATPLHYLDYVMDKVDQILLMSVNPGYGGQSFIEGTLEKVRQVRQRIITSGREIRLEVDGGIKASNIRAIAEAGADMFVAGSAIFNQEDYKAAIDAMRTELALANRE

SEQ ID NO: 25918 - protein, 482 aa, Psychrobacter sp. 273-4
MAKNKTSYVCQHCGAHFGKWAGQCSDCGEWNSLLEAPNVSMPHHNKNTAKPNAGRATPRNVSGSGTTAAGNYAGTHSAVMPLNAVSVGLDTRLPTGISEFDRVLGGGLVAGSVVLIGGDPGIGKSTILLQTATNMAKADSLAGSALYVTGEESLAQVAMRAKRLDLPADRLRVLAETNVETICAALTQEQPAIAIIDSIQTIYTDAINSAPGGVSQIRESAAILTRYAKQTGTALFLVGHVTKEGTLAGPRVLEHMVDTVLYFEGQSDSRFRMIRAVKNRFGAVNELGIFGMTDMGLKEVANPSAIFLSRYDKPVAGSVVMVSREGTRPLLVEVQALVDDSQGSPRRMALGLDFQRLSMLLAVMHRHGGIHTSGQDVYVNVVGGVKVIETGSDLAVLLACASSIREKALPSSLAVFGEVGLSGEIRPVPNGQERLKEAMKHGFKHAIIPKANAPAKDAPQFKGINVIAVERLDDAIASAFEL

SEQ ID NO: 25919 - protein, 321 aa, Psychrobacter sp. 273-4
MATNDKGSSNTTTTDNDGTTAKPNIAFIGLGNMGGPMAENLLKAGYTLSVYDLSAEATARLQQAGANIANSPKDAAQNAQVVISMLPAGKHVHSVYLGEDRSKGLLADLPKGTLVIDSSTIAAADARKVAEAASKLGIDFLDAPVSGGTGGAIAGTLTFIVGGSDDAFAKAEPILAVMGKNIFHAGEHGAGQVAKICNNMLLGILMAGTAEAINLGVKNGLDPKVLSDIMLQSSGRNWTLEVYNPYPQVMENVPSSNGYQGGFMSKLMQKDLNLAMQTAQDTNVETPMGAKATELYAAHTVENGDRDFSSIMARYDSSVLS

SEQ ID NO: 25920 - protein, 282 aa, Psychrobacter sp. 273-4
MMTLPAWLTAVNFNADGLIPAIAQDHESGRILMMAWMNAESLQLTADTQTAVYFSRSRAKLWHKGESSGHTQRVHDIRLDCDADVIVLSVTQAGGIACHTGRESCFYQRLDLSGQTPEWQTVDKVIKDPAEIYHSNEVANPPPTNDATAHNSVSFDADANQAKADKTSILQQLDRVLAERKQADADSSYVASLYDKGLNKILEKVGEESTESIIAAKDFANCDENIDKSQYDEARSELIYEVADVWFHTLVGLAWFGIESDAVLNELGRRFGLSGIDEKAAR

SEQ ID NO: 25921 - protein, 420 aa, Psychrobacter sp. 273-4
MQNQIFELQYALDTFYLLMCGALVMWMTAGFTMLEAGLVRSKNTVEILTKNIALFATACTMYMICGYAIMYDGNLFLSGIAGTESLVADALATSAENGFDGDAVYSSASDFFFQVVFVATCMSIVSGAVAERMKLWSFLLFAVVMTGVIYPLEGSWTWGGKAVFGLYSLGDLGFSDFAGSGIVHMAGAAAALAGVLLLGARLGKYGSKGEIRAIPGANLPLAALGTLILWMGWFGFNGGSVLKLGDIASANSVAVVFLNTNAAAAGGAIGALLIARLIFGKADLTMLLNGALAGLVAITAEPLTPSALQATLFGMTAGIIVVLSILLLDKIKIDDPVGAISVHGVVGLFGLLIVPLTNPAASLIGQLAGAATIFAWVFVSSLIIWSIIKFVIGLRISEEEEYQGADIAECGMEAYPEFIR

SEQ ID NO: 25922 - protein, 177 aa, Psychrobacter sp. 273-4
MPESATMTKENFVTCDLLDANPESQVCLPNIEGKSFYSFGGKDKFCGEVVTVKCFEDNSRVKSLLNSDGKDKDGNGKVLVVDGGGSMRCALLGDMIAQSAIDNHWAGVIIYGCVRDVDDMAQMELGVMALGCIPRKSNRRDEGQTDLEISFGDLTLNSGMFVYADNNGIIASDKPLI

SEQ ID NO: 25923 - protein, 121 aa, Methanococcoides burtonii DSM 6242
MIDLDTLKFDGNGLIGAIAQDNRTGEVLMFAFMNREALEKTIETGIAHYWSRSRQKLWKKGESSGHMQKVHELLIDCDMDAIILKISQEGGACHTGYRSCFYRNIEGDVVGEKVFDPADVY

SEQ ID NO: 25924 - protein, 477 aa, Methanococcoides burtonii DSM 6242
MNMKEYDLIVIGSGSGMNYVSLIIQQYPEMKIAVIDKDKPGGICLTRGCIPSKMLLYPAELVREIGKANRFGIDAEIKSIDFKFVMERMRSSIDKDIEMIHHGLSSDPNLDYYEHVAKFVEPYVLEIGEELITSKMIFLSIGSKPMIPPVKGLDDISYLTSDTVLELTTLPKSLAIIGGGYIAAEYGHFFSAMGSKVTIIGRSPRIVDNEEPEISELARKKMARYVDIITDHEVSEIHPSGRQKKIVAKDRNSENEMEILVDEVLVATGRSPNTDILHPEKGGIETDERGWIKVNDHLETTCSNVWAFGDANGQYLFKHVGNYESTLVYENAILNEGIKIDYNAVPYAIFSYPEIAGVGIGESAAIEQYGEDNISIGFHRFEDTGKGMAMGLDSYFVKVILGDSGNTLLGAHIIGPQASILIHQLITLMNTPGSNVGPVVNGMDIHPSLSEVVKRALYSRMSVEEYHSVLKSLELEY

SEQ ID NO: 25925 - protein, 181 aa, Methanococcoides burtonii DSM 6242
MRKALLLLILTGMLLVSGCASNGDQENTMVQEGDLISVNYIGQLDDGTIFDTSFEDVAKEAGQYNPARGYEPLEFTVGASRLIAGFDAGVVGMTVGEEKTVVIPAAEAYGEYDEERVQPVPISQLKEKDIEPEVGMLLNTISGQQVPIVRMDETNAYVDNNYPLAGETLTFQITLVSIGQD

SEQ ID NO: 25926 - protein, 207 aa, Methanococcoides burtonii DSM 6242
MAFQIVFAAIALAILTSGVAERIKLSSFIVFGLLWTTLVYDPLAYWAWGDGWVGSMGALDFAGGTVVHISSGFGALALSFVIGKRIGFGKYSMEPENITTTLLGGALLWFGWFAFNAGNALAANAFVVTLISASSGALTWMGASWIKGKSSSLGMNSGAIAGLVAITPACGFVGPLAAIIIGGSAGILCYGTLLFCIYKKFDESLDA

SEQ ID NO: 25927 - protein, 396 aa, Methanococcoides burtonii DSM 6242
MSTTRDYYEILGVSKDASDTELKKAYRKLAMKFHPDKNKEADAEEKFKEISEAYAVLSDAEKKAQYDRFGHAGIDGRYSTEDIFRNADFGDFGDLGDIFGSIFGGGGGFGGFGGGGRRRQGPTRGSDLRYDLGVTLEQAAFGEKVHINVPRAENCETCGGTGAKEGTSPKTCATCRGSGQVTHARRTPLGNFMTTTTCDACHGKGQVIESPCPVCRGSGKQKKVRKMGVSIPKGADTGLRLKMSGEGEAGSPGAPSGDLYIVIHVKQHDEFERIGDDIVYGIPISFSQAALGAEIKVPTLHGKVKMKIKPGTQTHSILRLKGKGMPRLHGHGQGDQLVKVIVETPTDLTGKQKELLDEFDRLSTGNSKGSKGKGFFDKVKDTFESAISTISPGTVE

SEQ ID NO: 25928 - protein, 455 aa, Methanococcoides burtonii DSM 6242
MSIRPKMPQQAPEDRITNFDEVALGYTEEQAILEAERCLECKNPKCVEGCPVNIDIPGFISKIKEGDFQEAINIIKATNILPAVCGRVCPQEEQCEKLCILGKKSEPIAIGRLERICADIERKVGVKDPVVAQSTGKTVAIVGSGPAGLTAASDLAKAGHSVTIFEALHEAGGVLVYGIPEFRLPKAIVKEEVDHIRKLGADIKMDYVIGRILTLDQLTDRFDAVFLGTGAGLPKFMGIEGENLNGVYSANEFLTRVNLMKAYNNDFDTPIKRGSNVIVVGGGNVAMDAARSALRLGADEVSIVYRRSDEELPARREEIEHAKEEGIVFRLLTNPVRIIEGENMSVNGVECIKMELGEPDDSGRRRPEVVEGSEHIVDADIVIMAIGTSPNPIIFDGSKGLEVTPWGTIVVDESGMSSIEGVCAGGDAVTGAATVISAMGAGKLAADTINNYLSK

SEQ ID NO: 25929 - protein, 383 aa, Methanococcoides burtonii DSM 6242
MNAIRQLRKSFPNHTILADMKIADTGAFEVEMAAKAGADIVMLLGNADDSTVLDAVRSAHKYGVKLMADLIIVEDPVSRAIELELMGVDYINMHTGIDQQMTGKDPTPILEKMTTAVSIPVAAAGGLDAGSAAMAVKAGASIVIVGGNITQSDNVTGAAKKIRAAVDSNEIPERAHRTLEEEIRQLLSEVSTPNITDAMHRKGAMNDIHTMVAGKRMVGKAVTVQTFEGDWAKTVEAIEVAVKGDVIVIYNGSRHISPWGGLATLSCLNKGIAGVVIDGPVRDIEEIRTIGLPVFATSNVPNAGDPKGFGEIGASIHCGSQNVNPGDYIIGDDNGVVVIPKERAYEIARRSKEVEKNEKRIYEEIKRGSTLSEVLKLKKWEKM

SEQ ID NO: 25930 - protein, 433 aa, Methanococcoides burtonii DSM 6242
MNDVSSEKSIGYLSAVSIGIGGMVGGGIFAVLGLAVEIGKGGTPIAFGLAGIVALITSYSYAKLSVRYPSEGGTVEFLNQAFGSGLVTGGLNILLWLSYVVMLSLYAYAFGSYGSTFFPDSMQAVLRHVLTSIIIVSLTVVNIVGAKVVGKLETWIVGFKVAILLIFIGVGIWSVKSQPFQPTISSNPLQLVAGGMIIFLAYEGFELIANTAKDVKNPGKTLPCAYYSAVVFVIVLYVLIAFITVETVSIDSIIQAKDYALAVAAKPFLGNFGFNLIAVAALLSTASAINATLYGASRVSFTIAKDGELPEILEEKIWNRPIEGLLITSALTLIVANTFNLASISIMGSAGFLLIFGAVNASNACLYQKTASYRWISITGIIVCSIALFTLIWYTLNNSPKDIFILAFMLCSAFAIEAIYRRFTGRYIKKIHE

SEQ ID NO: 25931 - protein, 449 aa, Methanococcoides burtonii DSM 6242
MNPATGEVNEEIELYSEERINRTITKARTTFLEWKNLDISERAHYLKTAATQLRKDKDELGRIITIEMGKPIKESVPEVEKCAWALEYYAENAENFLAPEAVETDALESGVSFEPKGVILSIMPWNFPFWQALRFAAPALVGGNTVILKHASSVPMCALAIEKVFADAGLPEGAFQTLIIDGRTASELIARDEIAAVTFTGSLTAGRKVAEAAGRNMKKAVLELGGSDPFIVLDDANVEMAAKAGVNSRFQNGGQSCIAAKRFIVTEAVADEFLRIFIGSARKLQVGDPMDPQTDVGPLVNAQQVDIIDAQVKDSVDKGAELLLEGGRLDRLGSFYAPVILSNVNENMRVLKEETFGPVAPVIIVKDEEEAIRVAGNSDFGLGASLWTEDREHAMEIEKHIESGILSVNSMVASDPRLPFGGVKKSGIGRELYKYGLYEFMNIKSIKVY

SEQ ID NO: 25932 - protein, 425 aa, Methanococcoides burtonii DSM 6242
MNSISEEAKYTIQKVHAREILDSRGNPTVEVDIYTGCGFGRASVPSGASTGSNEALELRDKDADRYNGKGVLKAVDNINKTLSKELLGMDARNQREIDELMIALDGTENKKTFGANAILGISMATAKAAADSLGIALYRYLGGTNAFALPVPTMNVINGGKHAGNDLSIQEFMIQPKGADTFSNALRMGAETYHALGKVLEDKYGASATNVGYEGGYAPPISTTADALDALVSAIEEAGYTESEISIGLDSAASEFFDGDKYFIDGNKLAPAELVDYYLDLIETYPILSIEDPFHEESFEDFAALTSEAWDTIIVGDDLFVTNVNRLAKGIEMEAANALLLKVNQIGTISESFDAANLAQRNGYSVVVSHRSAETEDTMIADISVAIGGDLIKTGAPARSERTAKYNQLLRIEEDLGDAARYVQL

SEQ ID NO: 25933 - protein, 317 aa, Methanococcoides burtonii DSM 6242
MKVFVSTHPFSSTSQTPLELLKSNEIDVILNSHERKITTRELASDIGNSDVLIAGTERITEEVIKNAPNLKLISRVGVGLDGVNFELCNKYGIKVTYTPDAPTMAVAELCVGIILDLSRKISYTDRNVRKGVWDRYMGNLLYGKTVGIFGMGRIGKSLVHLLSSFNVKFLVNDITPDFSFGRLYNIEFVSKNDVLEKSDIISINIPLKKDTYDFITLNEIKKMRSNAILINTARGGIVNESDLYEALKNSMISGAGIDVFEEEPYKGKLTELGNCVLTCHVGASTINSRTEMETQAVEEVIRFKNERPLKNEVFANE

SEQ ID NO: 25934 - protein, 337 aa, Methanococcoides burtonii DSM 6242
MKIITWYGILTIGDDGVSECEPFNKDVDELAELLLRKDVVAYSPGSGFDIRTVAIECGFVENDEEYNSLLRDVSIRAAKLQISRTNTPDMQIIQAVEALDDIDDVVNVLSERLSEWYGLHFPELGLSSEPLARFVSEFGSRNNVPAEHPMFEKATSSMGSELPSADEELIKGFASNACELYDSRHSIEASIVRNMEKMAPNVTLITGSLIGARFISMTGGLARLSQLPSSTVQVMGANRALFKHLRGRAPSPKHGIIFNNPLVKNSPWWQRGKIARALAAKISLAARMDVYSGELHPEIKVDLEKKVNSIKAANPKPPVKQKPAGKGYKGKNKGGER

SEQ ID NO: 25935 - protein, 309 aa, Methanococcoides burtonii DSM 6242
MENIYEDITKTVGKTPLVRLNRITVGCYATVLVKVEAFNPLGSIKDRIALNMIETAEKDGMLKKGAIVIEPTSGNTGIGLAFVCATKGYRLILTMPETMSVERRNILKVLGAEIVLTPGPNGMKGAIEEAERIGKETPDSFIPHQFMNPANPDIHRCTTAGEIWDDTGGKVDILVAGVGTGGTITGVSEELKSRKPGFKAIAVEPKDSAVLSGGSPGPHMIQGIGAGFVPDVLNVDIIDEIITVSNEDAFETTRELAKKEGILAGISSGAALFAALDVARRKENEGKMIVVVLPDTGERYLSTTIVEKE

SEQ ID NO: 25936 - protein, 336 aa, Actinobacillus pleuropneumoniae serovar 1 str. 4074
MVHWWSKSERGTIVSIWNCAHNVGGMVPGAMVLLASTIYFSNTGEHATAKDVWQQALYYPGIAAMIAAIPVYFVMKDTPQSCGLPPVEKWRNDYPDDYNEETAEKDLSTKEIFVTYVLKNKLLWYIAIANVFVYLIRYGVLKWSPVYLGEVKHFNIKGTAWAYTIYELAAIPGTLLCGWVSDKLFKGKRGLTGFIFMILTTIAVFALWKNPATPEAELAQYAGKAWYENPYQLMDFILMTTIGFLIYGPVMLIGLHALELAPKKAAGTSAGFTGLFGYLGGTVSASAVVGWAAEYYGWDGGFYVMIAGGVLAVLLMFIVMIEEGKHKAKLGDHYGK

SEQ ID NO: 25937 - protein, 463 aa, Actinobacillus pleuropneumoniae serovar 1 str. 4074
MNLQWQRYPENTRKLFKLTLPIFISQLSVAGMGLADIVMAGLVSDDDVSAIAVSNSIYFPLFLFVLGLLNVITPTVSYLNGSNQRHLIAHQIRQGFWLVLVCSVPLIIVFLNSHWILDYMNTPQAFSTKSQQYLAIMAIGVVPALLGINLRCMNDGLSNPKPAMRIMFFGLLLNIPLNYIFIFGKFGLPEMGAVGCGMATAIVNWIMFLLLFHYSYTNKSQKDIGLFNRWFEMPSGQTLLKICKLGLPIGFATFTEVMLFSTSALLLSPLGSQVVASHQAALQTSSLLFMIPMSFSIATTIVVGKTLGQKQVEQAKIISYHALITGALFALAAAVVIVILDEIIPLAFTGDPVSIAIAAHLLLFAAVYQIPDSLQAVANGILRGYKHTKPILYVTMFCYWVIGMPFGYILARTDWIVEPMAASGFWFIFCVSLSIAAGLLIYQMHKIQQIPAEQLLAKLERIK

SEQ ID NO: 25938 - protein, 456 aa, Actinobacillus pleuropneumoniae serovar 1 str. 4074
MTKHYDYLAIGGGSGGIASINRAASYGKKCAIVEAKHLGGTCVNVGCVPKKVMFYGAHIAEAINSYAPDYGFDVTVNNFDFVKLIESREAYISRIHTSYNNVLAKNNVDVLNGFAKFVAAKTVEVTYADGSSEQVTADHILIATGGRPSIPAIKGAEYGIDSDGFFALREVPKRVAVVGAGYIAVEIAGVLNSLGSEMHLFVRQHAPLRMQDPLIVDTLLEVLAQDGITLHTQAIPQEVRKNADGSLVLTLADGREATVDCLIWAIGREPACDKINLDAVGVKTNAKGQIIVDKFQNTNVPNVYAVGDIIEGGIELTPVAVAAGRRLSERLFNNKPNEHLDYNLVPTVIFSHPPIGTVGLTEPQAIEQYGAENVKVYKSSFTAMYTAVTQHRQPCRMKLVCVGKDEKVVGLHGIGFGVDEMIQGFAVAIKMGATKADFDNTVAIHPTGSEEFVTMR

SEQ ID NO: 25939 - protein, 378 aa, Actinobacillus pleuropneumoniae serovar 1 str. 4074
MTDVRLVNVCKSYGNVHISKDVNLEIKDGEFVVFVGPSGCGKSTVLRMIAGLEEITSGDLFIGDKRMNDVPPANRNIGMVFQSYALYPHLSVAENMSFGLKLAGAKKEEIDQRVNQVAEILQLAHLLNRKPKELSGGQRQRVAIGRTLVSQPEVFLLDEPLSNLDAALRVQMRVEISKLHKKLGRTMIYVTHDQIEAMTLADKIVVLQALSAGSNLTTNVAQVGKPLELYHYPANRFVAGFIGSPKMNFLPVRVIDVREGGVKIELPDSTHLNFWVPVESGGVKVGDNLSLGIRPEHLLPCEQSEVCISGTVKVVEQLGNETQVHIEMPPIKQSLVYRQNDIVLVKEGDLLIRIVVIFSEKMARHANVYLSSKAYKCS

SEQ ID NO: 25940 - protein, 431 aa, Actinobacillus pleuropneumoniae serovar 1 str. 4074
MLERLFQLSEKGSNAKTEIVAGITTFFTMVYIVFVNPSILGVAGMDTQVVFVTTCLIAAFGTIAMGLFSNLPIALAPAMSLNAFFAFVVVQKLGYSWQVGMGAIFLGSVGLFLLTVFQIRYWFMSAIPLGLRVGIGAGIGLFIALIGFKNMGLVVANSATLVALGDLHDPKVLMGILGFFIIVVLAAKSFHSGVLISIAVITTLALIFDPAVSFNGVMSMPPSLDAVVGQVDIAGALDVGLLGIIFSFMLVNLFDSSGTLIAVTTKAGFADKQGRFPRMKQALLVDSTAAMAGSFMGTSAISTYIESGSGVSVGGRTGLTAVTVGILFLLTIFFSPLAGVVPAYATAGALVFVGILMASSLIEVKWDDLTEATPAFITTAMMPFTYSITEGIAFGFISYCVMKACTGRWKEINPSVAVVSLLFIAKFVWVG

SEQ ID NO: 25941 - protein, 493 aa, Actinobacillus pleuropneumoniae serovar 1 str. 4074
MKDLNVFDKNYGLLINGKWTQGSGNDLLPSYNPANGEVLAHFVDATDADVDAAVKAAQEAFKSWRKTTVAERAAILNKIADVIDENSELFALQETLDNGKPIRETRAADIPLASDHFRYFASAIRAGEGSLNQINQEELSLVLREPIGVVGQIIPWNFPFLMAAWKIAPALAAGCTVVIHPSSTTSLSLLSFAQKINHLLPKGVLNVITGKGSKSGEYMLHHKGFNKLAFTGSTEIGRHIAISAAELLIPATLELAAKSANIFFDDMPFDKALEGAQKGILFNQGQVCCAGSRIFVQEGIYDKFVAALAEEFKKVKVGLPWEDDTQMGAQVNAGQLNTILKYVKIGEEEGCRIITGGRKVLSDNLACGEFVEPTLIESKDNNSRIAQEEIFGPVATVIKFKTEEDVIRMANDSEYGLGGGVWTKDINRALRVSQAIETGRVWVNCYNILPAGAPFGGYKSSGIGRETHQMMLDAYTQVKNIYISTREEREGMY

SEQ ID NO: 25942 - protein, 214 aa, Actinobacillus pleuropneumoniae serovar 1 str. 4074
MKIILLGAPGAGKGTQAQFMMNKFGIPQISTGDMFRAAIKEGTELGKQAKALMDEGKLVPDELTVALVKDRIAQPDCANGFLLDGFPRTIPQADALKDSGVKIDLVLEFDVADEVIVERMSGRRVHQPSGRTYHVVYNPPKVEGKDDVTGEDLIIRQDDKPETVLERLAIYHKQTKPLIAYYTAEAEAGNTRYERLDGTKPVEEVSAELAKILG

SEQ ID NO: 25943 - protein, 501 aa, Actinobacillus pleuropneumoniae serovar 1 str. 4074
MLQIRPLVTNQNQQEKTMSVKGDIGVIGLAVMGQNLILNMNDNGFKVVAYNRTTSKVDEFLAGAAKGTNIIGAYSLEDLAAKLEKPRKVMLMVRAGDVVDQFIDALLPHLEEGDIIIDGGNSNYPDTNRRTAALAEKGIRFIGTGVSGGEEGARHGPSIMPGGNIEAWEHVKPILQAISAKTDKGEPCCDWVGKEGAGHFVKMVHNGIEYGDMQLICEAYQFLKDGLGLSYDEMQAIFQEWKKTELDSYLIDITTDILGYKDTDGTPLVEKILDTAGQKGTGKWTGINALDFGIPLTLITESVFARCVSSFKDQRVAASKLFNKTIMPIEGDKKVWIEAVRKALLASKIISYAQGFMLIREASENFGWDINYGATALLWREGCIIRSRFLGNIRDAYEANPDLVFLGSDDYFKGILENAMADWRKVVAKSIEVGIPMPCMASAITFLDGYTSDRVPANLLQAQRDYFGAHTYERTDKPRGEFFHTNWTGRGGNTASTTYDV

SEQ ID NO: 25944 - protein, 407 aa, Actinobacillus pleuropneumoniae serovar 1 str. 4074
MVYSVIVVPGMLSQAGFPAESVFIATCLVSGLGSILIGLWANAPMAIGCAISLTAFTAFSLVLGQGISIPVALGAIFLMGVLFTLISVTGIRAWILRNLPASIAHGAGIGIGLFLLLIAANGVGLVVGNQAGLPVKMGDFTSFPVIMALLGLAAIIGLERLKVKGSILWVIIAITIIGLVFDPNVKYAGFFKMPSFGENSQFLNLDVMGALNTAILPVVFALVMTAIFDATGTIRAVAGQANLLDKDGQIINGDKALTSDSLGSVLSGLFGTAPAAVYIESAAGTAVGGKTGLTAVVVGIGFLLMLFFQPLAFLVPGYATAPALMYVGLLMLSNVSKLDFDDFVGAMSGLVCAVFIVLTANIVTGIMLGFAALVIGRIISGEFKKLNVGTVIIAIALVAFYAFELAI

SEQ ID NO: 25945 - protein, 316 aa, Actinobacillus pleuropneumoniae serovar 1 str. 4074
MTIYADNSYTIGNTPIVRLKNFGQNGNLLVKIESRNPSFSVKCRIGANMVWQAEKDGILTKGKEIVDATSGNTGIALAYVAAARGYKITLTMPETMSTERKRLLRGLGVNLVLTEGSKGMKGAISKAEEIVASDPNRYVILKQFENPANPAIHQQTTGPEIWNATEGKVDVIVAGVGTGGTITGISRYIKQDQGKQIISVAVEPKESPVITQTLNGEEVKPGPHKIQGIGAGFIPKNLDLSLIDRVEQVSSEEAIATARRIMAEEGILVGISSGAAVAAADRLAKLPEFADKQIVAILPSASERYLSTLLFEGVEV

SEQ ID NO: 25946 - protein, 114 aa, Actinobacillus pleuropneumoniae serovar 1 str. 4074
MARQPFLIAPSILSADLARLGEDVAEVLKAGGDIIHFDVMDNHFVPNLTFGPAICKALRDYGITAEIDVHLMVKPVERLIPDFAKAGANYITFHPEATDHIDRTLQMYRVSGCK

SEQ ID NO: 25947 - protein, 405 aa, Actinobacillus pleuropneumoniae serovar 1 str. 4074
MERFPKSDKLANVRYDIRGAIHKEALRLEEEGNKILKLNIGNPAPFGFEAPDEIVVDVIRNLPKSQGYCDSKGLYSARKAIVQYYQSKGIRNVDVNDVYIGNGVSELITMSMQALLNDGDEMLIPMPDYPLWTAAATLAGGKAVHYLCDENNEWMPDIEDIKAKITPRTKGILVINPNNPTGAVYSRSMLLEIAEIARQHNLMIFADEIYEKIIYDGAVHHHIAALAPDLLCVTYNGLSKAYRVAGFRQGWMVLSGPKNQARGFIEGLDMLASMRLCATTPMQHAIQTALGGYQSINEFVLPGGRLLEQRNKMYELLVQIPGISCVKAKGALYMFPKIDTEMYGIKDDAKFIYDLLQAERVLLVQGSGFNWHKPDHFRVVTLPYAHQIEEALGRLANFLKTYKQS

SEQ ID NO: 25948 - protein, 232 aa, Actinobacillus pleuropneumoniae serovar 1 str. 4074
MPSIAFLLAKAFQLPPDLPIGVILVGSCPGGTSSNVMTYLARGNTALSVACTTVSTLLAPVLTPAIFYLFASEWLEIDAGAMFVSVLKMVLLPIFVGVVIRSIFKQKIEQFSQTMPLISVVAIILIVTAVVSVSKDRIIESGLLIFFVVVLHNGLGYLIGYTVGRVLKLPIADSKAISIEVGMQNSGLGAALAALHFKANPVVAVPSAVFSFWHNISGPVLAMIFASIKNEK

SEQ ID NO: 25949 - protein, 1201 aa, Actinobacillus pleuropneumoniae serovar 1 str. 4074
MPTNIYQLLPSSAVLRENISRHYRIDEAELVQQLLIEAETETLQPEIKNLARKLIEKVRTNRQKASGVDALMHEFSLSSQEGIALMCLAEALLRIPDQVTRDKLIKDKIAKGDWKSHIGNSPSLFVNASAWGLVFTGKLLSLNQQALSSSLNQLISKAGEPVIRKGIDFAMRLLGKQFVTGETIQLALKNSEARFNKGFRFTYDMLGESAFTEQDAQHYYQDYVNSIHAVGAASKGLGVYHSSGVSVKLSAIHPRYSLAQYDRVMDELYPRLRDLFLLAKRYNIGLNIDAEEANRLEISLDLIDRLLSEPELADFDGIGIVVQAYQKRCRSVIDYLIAKARENNRKLMIRLVKGAYWDSEVKLAQTESASGYPVFTRKVHTDLNYVACAKKLLAAQDVVFPQFATHNAQTLATIYHLAKGKRFEFQCLHGMGETLYDQVVGKENLNIQCRVYAPVGSYQTLLAYLVRRLLENGSNSSFVNQIVDENVSIDKLLEDPVAKAGITAGTMHPKTPLPIKLFADRKNSAGYELSDMHHLVQLGAQLNALADHNQYRAVPQIAEQFYQGSQRKVIYNPADQTQIVGEVTYANETDVEKAFAIAEQNQTAWQATPAEQRAAILEKIADLMESNMPTLFDLAVREAGKTLNNAIAEVREAVDFCRYYANQVKRNPQAYQNPRGIIVAISPWNFPLAIFTGEVVSALVAGNVVLAKPAEQTSLMAHYAVELFYQAGVPKSVLQCLPGSGAEIGNKLTADPRVDGVIFTGSTETAKTINRNLQKHSKIIPLIAETGGQNALIMDSSALGEQVVADVLNSAFDSAGQRCSALRVLYLQEDVADHILTMLKGAMAELRVGKPQLLNTDIGPVIDRTAQSRLLAHIEKMKAVAKSYYQVPIAAEVEQNGIFVPPTLLEIDHISQIEHEVFGPVLHVIRFNADRFEQIIDDINSTGFGLTSGLHSRIDATIDQWLDKVHAGNLYVNRNTVGAVVGVQPFGGMGLSGTGPKAGGPLYLQRLVKSEAWTLADLEGEAVIETDKLAQAVRQTLTGEQQSEALALLQTLRQKSPLAQVYKMQGITGENNYLRFEARPMIAVSNGSLFAQIKALIAIAVCGSKAVVKKDSPLAEYAHQFAEYLMVTDDFNNLSALSVMIVLEPLSTQERQHYAECNGSILTYVESLELALSLLPLVHEKSISINTAAAGGNATLMSEMD

SEQ ID NO: 25950 - protein, 409 aa, Actinobacillus pleuropneumoniae serovar 1 str. 4074
MTVQIDKSKIKFLLLEGVHQNALDVLQAAGYTNIEYHKKALDGEELINAIKDAHFVGLRSRTYLTKEVLSHAKNLVSIGCFCIGTNQVDLKEAKRLGIPVFNAPFSNTRSVAELVLAEIILLMRQVPKANAEVHRGVWNKSAAGSNEVRGKKLGIVGYGHIGSQLSVMAESIGMQVYFYDIENKLPLGNAQQIASLNELLAGCDAISLHVPENASTKNLMNADRIAQLKEDSVLINAARGTVVDIDALAARLAQGTLRGAAIDVFPEEPASINDPFESPLRQFDNVILTPHIGGSTAEAQANIGTEVANKFVKYADNGSTLSAVNFPEVSLPILHSDAKRLLHIHENRPGILNKINQVFVDGNVNIAGQYLQTDPNIGYVVIDVELDDASEALERLQQIDGTIKARVIS

SEQ ID NO: 25951 - protein, 228 aa, Actinobacillus pleuropneumoniae serovar 1 str. 4074
MKKYFAEFFGTFWLVFGGCGSAVLAAGIPELGIGYAGVSLAFGLTVLTMAYAVGHISGGHFNPAVSIGLLVGGRFNAKDLVPYIVAQVIGAIAAAAVLYTIASGAAGFDVTAGFASNGFAEHSPHGYSMAAALVIEVVLTAFFLIIIMGATDKRAPAGFAPIAIGLALTLIHLISIPVTNTSVNPARSTGVALFQGSWAIEQLWLFWVAPILGAIIGALAYRFIAEEK

SEQ ID NO: 25952 - protein, 487 aa, Actinobacillus pleuropneumoniae serovar 1 str. 4074
MLRIILEALTFDDVLLVPAHSTVLPNTADLSTQLTKDIRLNIPMLSAAMDTVTETKLAISLAQEGGIGFIHKNMSIERQADRVRKVKKFESGIVSEPVTVSPDLTLAELAELVKKNGFAGYPVVDSENNLIGIITGRDTRFVRDLTKTVAKVMTPKERLVTVKESANREEILELMHQHRVEKVLMVDDNFKLKGMITVKDFQKAEQKPNACKDEFGRLRVGAAVGAGPGNEERIDALVKAGVDVLLIDSSHGHSEGVLQRVRETRAKYPNLPIVAGNIATAEGAIALADAGASAVKVGIGPGSICTTRIVTGVGVPQITAIAEAAAALEGRGIPVIADGGIRYSGDISKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGSATIEDLRTKAQFVRISGAGIKESHVHDVTITKEAPNYRMG

SEQ ID NO: 25953 - protein, 206 aa, Actinobacillus pleuropneumoniae serovar 1 str. 4074
MIDFDGYRPNVGIVICNKAGQVLWAKRFGQNSWQFPQGGINEGENIETAMYRELYEEVGLTKKDVRLLWASKYWLKYKLPKRLVRSDGSQPVCIGQKQRWFLLQLLSDENLIDLKTTKSPEFDGWRWVSFWYPVRQVVSFKRDVYRKVMKEFAGVLLNESKKPETVEKPRVERTEKRDFQKRDNQKREFRKSARMWNNSHQKGKAQ

SEQ ID NO: 25954 - protein, 205 aa, Actinobacillus pleuropneumoniae serovar 1 str. 4074
MVNVLFLGVIMQISRRKFFKVCAGGMAGTSAAMLGFAPATALAAPREYKLLRAKETRQTCTYCSVGCGMLMYSLGDGAMNSRGKLFHVEGDPDHPVSRGALCPKGAGVLDYVNSPNRLQYPEYRAPGSDKWERISWHDAIHRIAKLMKEDRDANWQDVNEEGTVVNRWTTTGLLCGSATSNETSLVSQKWARALGLVVIDQVAST

SEQ ID NO: 25955 - protein, 349 aa, Pisum sativum
GSYADELVKTAKTIASPGRGILAMDESNATCGKRLDSIGLENTEANRQAWRTLLVTVPTLGEYISGAILFEETLYQSTVDGRKIVDVLVEQNIIPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYIGDGESEEAKKDCCQGYSY

SEQ ID NO: 25956 - protein, 286 aa, Haemophilus somnus 2336
  misc_feature (279)..(279): Xaa can be any naturally occurring amino acid
  misc_feature (286)..(286): Xaa can be any naturally occurring amino acid
MNNDFLVLKNITKSFGKSVVIDNLNLNIKRGSMVTLLGPSGCGKTTVLRLVAGLESPTEGEIFIDGEDVTKSSIQNRDICIVFQSYALFPHMSIGDNVGYGLKMQGVGSDERKQRVKEALELVDLAGFEDRYVDQISGGQQQRVALARALVLKPKVLLFDEPLSNLDANLRRSMREKIRELQQRLNITSLYVTHDQTEAFAVSDEVIVMNKGKIMQKAPAKELYKYPNSLFLASFMGESSIFNGYLEQGKITINDYQFILPDADKFALNDGECLVGIRXEAVKRGX

SEQ ID NO: 25957 - protein, 236 aa, Haemophilus somnus 2336
MSKLSLIQQLKQQKLSVGILSANWLQLNEEVTTLLEKQINVLHFDIADGQFSSLFTVGAIGIKYFPTHCFKDVHLMVRNQLEVAKAVVANGANLVTLQLEQYHDFALTIEWLAKQKTTYANQVYPVLIGACLCPETPISELEPYLDQIDVIQLLTLDPRNGTKYPSELILDRVIQVEKRLGNRRVEKLINIDGSMTLELAKYFKQGTHQIDWIVSGSALFSGELKTNLKVWKSSIM

SEQ ID NO: 25958 - protein, 217 aa, Haemophilus somnus 2336
MDLTKFKEQIEFLDQKVAYFHIDIMDGHYVPNLTLSPFFVSQVKKLATKPLDCHLMVTNPENYIDDLAKAGCDMITLHVETISGQAFRLIEKIRYLEMKVGIIFNPETPIEKAKYYLSKADKVTILTVDPGFAGQSFIPEMLEKVAELKLFRETHQLNYEIEIDGSCNPKTYEMLIKAGADVLIVGSSGLFNNSDNIVEAWDMLEKEIERILSKGML

SEQ ID NO: 25959 - protein, 436 aa, Haemophilus somnus 2336
MENQSFLQKYFKFNEKKTTTKTEIIAGITTFFTMVYIVFVNPSILGDAGMDKQVVFVTTCLIAGLGTIAMGLFSNLPIALAPAMGLNAFFAYVVVGKLGYSWEIGMGTIFWGSVGLLLLTVFQIRYWLMASIPLSLRVGIGAGIGFFIALIGFKNMGLVVPNPVTLVSLGDLHSPQVLMGVLGFFIIVVLAARNIYSGVLVSIVTITALALIFDENVVFNGVISMPPSLDAVVGKVDVLGALDTALLGIIFSFLLVNLFDSSGTLLGVTDKAGFSDAQGRFPKMKQALYVDSISAVTGSYIGTSAISTYIESGAGVSVGGRTGMTAVVVGILFLLTIFFSPLAGMVPAYATAGALVYVGILMASSLIRVEWDDLTEATSAFITAAMMPFTYSITEGIAFGFISYCVMKTCTGRWKEINAPVWVVSLLFVAKFVWVG

SEQ ID NO: 25960 - protein, 214 aa, Haemophilus somnus 2336
MKIILLGAPGAGKGTQAQFITNKFGIPQISTGDMLRAAIKAGSELGQKAKILMDMGQLVPDDLIISLVKERVAQEDCEKGFLLDGFPRTIPQADALKSVGISIDYVLEFDVPDEVIVERMSGRRVHPASGRTYHIVYNPPKVEDKDDITGEDLILRADDKPETVLDRLKIYHNTTKLLVDYYQAEAAQGNTKYFRLDGTQKVEEVSQELDKILS

SEQ ID NO: 25961 - protein, 333 aa, Haemophilus somnus 2336
MFLLKKFSHLLAKYTALVIIALACVTFYSPNLFTWVKGDAQIIVLGLIMLSMGMTLGKEDYRILAKRPFDILVGTIAQYSIMPFVAISIAQLFNLSLGLTLGLVLVGCCPGGVASNIMSFLCKGDVAYSVGMTTVSTILAPIMTPLLLNYLVGETVAMDGWAMFKFMLLVTLVPVGIGSIMNITFENKKWFQELRELMPGVAVINFAFIVGGVVAVHGNKFLESGFIIFVCIVFHNVIGYILGFFTGRLFGMSTAKKRTLSIEVGVQNAGLATGLSSKFFPTNAESAIACAVSCVWHSISGTILANLFLWWDKRKNTSTQENNPAKNLMNSTK

SEQ ID NO: 25962 - protein, 219 aa, Haemophilus somnus 2336
MNAKEIIARRIALELKDGDVVNLGIGLPTMVANYIPSDISITLQSENGFLGLTAFDPENPDENIVNAGGQLCSIQAGGMFFDSAYSFALIRGGHVDACVLGGLEVDQEANLANWMVPGKMVPGMGGAMDLVTGARRVIIGMEHCAKTGTSKILKKCTLPLTARNKVHLVVTELAVFEFINGQLTLTEMAEGYDLDMIKAKTEAEFVVSPNLKIMSLAGA

SEQ ID NO: 25963 - protein, 215 aa, Haemophilus somnus 2336
MSKFISIDELKSHFFDGMTMMSGGFMGCGAPELIIKEILEANIKDITLISTDTAMVDTGVGPLIVNGRIKKLYASHIGTNSETGKKMISGELNVELCPQGTLAERIRAGGAGLGGFLTPTGVGTVVEKGKQKITIDGVEYLLELPLKADIAIIKADIADEIGNLVFLGAARNFNPIMALAANTVIVQATKIVKVGEMDPNLVMTPAAVVDYIVKA

SEQ ID NO: 25964 - protein, 389 aa, Haemophilus somnus 2336
MSVIKMTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFVMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 25965 - protein, 169 aa, Haemophilus somnus 2336
MITLHTNFGDIKLALNFEKAPITAENFLTYCKEGFYNNTIFHRVIDGFMIQGGGMESGLREKNTKAPIKNEASNGLSNKRGTIAMARTSDPHSATAQFFINVADNTFLDYRAKEMFGKTVVQEWGYAVFGEVVEGMDIVDKIKGVKTGNKGFHQDVPVEDVIITSVTIE

SEQ ID NO: 25966 - protein, 481 aa, Haemophilus somnus 2336
MNIQHLLKTQAYINGEFISAKNHRTFPVINPANQQVICEITCCGKEETELAIKSAKQAQVHWKKYTAKERSKILKKWFELIMQHQESLAYLLSLEQGKPLSESRAEIAYGASFVEWFSEEAKRAYGEIIPQVREENRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 25967 - protein, 464 aa, Haemophilus somnus 2336
MKLTRFQQYHTEAKKLIAIATPILLAQVAQNSMGLVDTIMAGRVSAADMAAVAVGASIWLPLVLFGHGLLLALPPTISYLNGSGQRDHIAHQIRQGLWIVFISCIPLGLLIYNSDFVIQYMKMEEKLANITIGYLRAMLWGLPGYLLLINFRCLNDGIAKTKPAMVITFFGLLCNIPLNYIFIYGKLGIPAFGAVGCGIATAIVNWIMCLMMIVYSKHARNQRDLKVFEHLFEKPDTKTLAKLFRLGLPIAVSLCCEVALFALTSLLLSPLGTQVVASHQIALNTSSFAFMLPMSLGMATTILVGQRLGEGKIDNAKQISFSALTVGLSIAFLTASIIFFFRYEIAAIFVNDKEVIAISSSLLMLVALYQFSDTAQVVSSGALRGYKDTQAILYITLFCYWGMGMPLGFSLSRTDWIIPSIGAAGFWVSFVVSLTIAAILLLWRMYKIQQQPAPILLAKLDKLK

SEQ ID NO: 25968 - protein, 269 aa, Haemophilus somnus 2336
MGYFEQKFLQLQKQKQGAFVPFVTLCDPNFDRSFEIICTLVDNGADALELGFPFSDPLLDGSVIQAANHRALNAGCSTKESFQLIAKVRSKYPDIPISLLLCANLIYAQTLDGFYQRCAEVGVDAVLVADIPLLASEPYIQSAQKYDIQPVFICPPNADETTLKAVAEKSKGYIYLVSRAGVTSAENQQSAKNLANLIKGLKKYGSAPILQGFGIAQPQQVKDVLKSGVAGAISGSAIVQIIEQNLTDREKCLSELAEFVQKMKQATLL

SEQ ID NO: 25969 - protein, 202 aa, Haemophilus somnus 2336
MMFVTAYGGLIEFGKVQKGDFVVLGGATSSVGIAAIQIAKMQGANVIALSRTHAKGDVLLQKGADFVIATKEDDVTAKLLEITNGKGVNLVFDPVGGKEAAKIINAMTQDGKYIIYGALSHDDIAVPVFPILGKHLTVRGYELFEITTVPEKLAQAKKFVFDGLASGQLKPEIDKVFAFDEMAEAHRYMESNAQIGKILVKV

SEQ ID NO: 25970 - protein, 450 aa, Haemophilus somnus 2336
MGIFFGYAAYYFVRANFDLAQKGLIEAGLYNKAELGIIGTGAGLAYGLSKFVMAGISDRSNPKVFLPFGLLLSGLCMTMMGLMPWATSGIAVMFVMIFLNGWFQGMGWPPCGRTMVHWWSKSERGTIASIWNCAHNIGGMVPGLMVLLASAIYFSEFGVQATAKDIWQQALYYPGIAAMICAIPVYFVMKDTPQSCGLPAIEKWRNDYPDDYNEKTYENNLTTKEIFVTYVLKNKLLWYIAIANVFVYLIRYGVLKWSPVYLGEVKHFNIKGTAWAYTIYELAAVPGTLLCGWVSDKVFKGKRGLTGFIFMILTTIAVVALWMNPATPEHELAQYAGKAWYQNPYQLTDFILMTTVGFLIYGPVMLIGLHALELAPKKAAGTSAGFTGLFGYLGGTVSASAVVGWAAEYYGWDGGFYVMITGGILAILLMFITMIEEGKHKAKLDDHYGK

SEQ ID NO: 25971 - protein, 385 aa, Haemophilus somnus 2336
MSLDLNEIRQQITQIDRSLLKLLSERHRLAFDVVRSKEITQKALRDVQREQQLLKELVQFADNENYQLEPQYITQIFQKIIEDSVLTQQVYLQKKLNEQREKNIHIAFLGKRGSYSHLAARNYATRYQEQLIELSCASFDEVFSSVQNEEADYGIVPLENTTSGAINEVYDLLQHTDLSLVGELAYPIKHCVLVNAQDDLDKIDTLYSHPQVIQQCSQFIRTLKRVHIEYCESSSHAMQLVASLNKPNIAALGNEDGGNLYGLKVLKSGIANQENNITRFIVLAKHPIAVSPQIHTKTLLLMSTAQKVGALVDALLVFKKYNINMTKLESRPIYGKPWEEMFYLEIEANINNPIAQQAFTELKAFSNYLKILGCYPSEIVKPAEV

SEQ ID NO: 25972 - protein, 227 aa, Haemophilus somnus 2336
MELVFIRHGFSEWNAKNLFTGWRDVNLTERGIEEAKAAGKKLLEAGYEFDIAFTSVLTRAIKTCNIVLEESNQLWIPQVKHWRLNERHYGALQGLDKKATAEQYGDEQVHIWRRSYDVSPPDLDPQDPNSAHNDRRYALLPKDVVPNAENLKITLERVLPFWEDQIAPALLSGKRVLVTAHGNSLRALAKHIIGISDEEIMAFEIPTGQPLVLKLDEQLNFVEKFYL

SEQ ID NO: 25973 - protein, 373 aa, Haemophilus somnus 2336
MAKRDYYEILGVQKGADDKEIKRAYKRLAMKYHPDRTKGDKESEEKFKEINEAYEVLADKEKRAMYDQYGHAAFEQGGGAGGFGGFSGADFGDIFGDMFGDIFGGGRSRQRVVRGEDLRYDIEISLEEAVKSCKKDIQINTLVHCGTCHGSGAEAGSKIESCPTCHGAGRVRRQQSFFVTEQTCPHCHGTGKKIEKPCHTCHGEGRVHKTQNLTVTIPMGVDTGNQLRLAGKGAAGENGAPAGDLYVVIHVKKHHIFERDGNNLYCEVPISFTMAALGGEVEIPTLDGRLKVKIPAETQTGKLLRLRGKGITSRGYAGDLICEIVIETPIKLNEEQKELLRKLEESLEGKTLQRPKSSGFLDGVKKFFDNLGK

SEQ ID NO: 25974 - protein, 458 aa, Haemophilus somnus 2336
MAKSPKTAYVCNDCGAEFARWQGQCSACKAWNTISEVRLVSTAKVKNDRFSGYAGETKAKIQTLAEISLQETPRFTSGFRELDRVLGGGIVPGSAILIGGHPGAGKSTLLLQVMCGLAQSMTALYITGEESLQQVAMRANRLGLPTDRLQLLSETSIEQICHLADQLKPQIIVIDSIQVMHLSDIQSSPGSVAQVRECAAFLTRYAKTRQVAIIMVGHVTKDGTLAGPKVLEHAIDASLLLEGESDSRYRTLRSHKNRFGAVNELGVFAMTEQGLREVKNPSAIFLSRGDEQTSGSSVMVVWEGTRPLLVEIQALVDHSMLANPRRVAVGLEHNRLALLLAVLHRHGGLQMSDQDIFVNVVGGVKVTETSADLALLLALISSFRNRPLPQDLVVFGEVGLAGEIRPVPSGQERISEAAKHGFKRAIVPFANKPKSAVENMQVFTVKKLADALAILDNF

SEQ ID NO: 25975 - protein, 411 aa, Pseudomonas aeruginosa UCBPP-PA14
MNLFDTLTLPNGSTIPNRLAKAAMEENMTDAAQAPSERLMRLYQAWADGGAGLLISGNVMVDSRAMTGPGGVVLEDDAQLEKFRHWARIGRSAGAQFWLQINHPGRQMQANLGQQAWAPSAVPLELGGMSRHFATPKAMDEAMIAEVIQRFARSAVLAERAGFSGVEIHAAHGYLLSQFLSPLSNRRSDAWGGSLENRARLLLEIVRAVRAEVAPGFAVAVKLNSADFQRGGFSADDAREVVRMLDGLGIDLVELSGGSYEAPAMQGEARDGRTLAREAYFVEFARDIRAAARMPVMVTGGIRRRPVAEQVLASGVDMVGIGTALAIEPNLPRDWRAGKDSAPQLRPITWRNKPLASLANMAAVKFQLRKLSRGRATNPRVSPLCALLAQQAGALLQTRRYRRLMRSRAEA

SEQ ID NO: 25976 - protein, 161 aa, Pseudomonas aeruginosa UCBPP-PA14
MSDSLLSIPCTTIKGEQKTLADFGGKALLVVNTASKCGFTPQYQGLEALWEKYRERGLVVLGFPCNQFGKQEPGDEGEISQFCELNYGVSFPLFRKIEVNGAGAHPLFVSLKKRALGLLGSQGIKWNFTKFLIGRDGQVVKRYAPTTKPEELSSAIEALLE

SEQ ID NO: 25977 - protein, 469 aa, Pseudomonas aeruginosa UCBPP-PA14
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 25978 - protein, 402 aa, Pseudomonas aeruginosa UCBPP-PA14
MDNLNSAVQVLIHGSNTLFILLGAVMVLAMHAGFAFLEVGTVRLKNQVNALSKILSDFAISALAYFFVGYWIAYGVTFFHPAAALTVDSGYALVKFFFLLTFAAAIPAIISGGIAERARFGPQLCATALIVAFVYPFFEGLVWNGNFGLQEWLKLEFGAPFHDFAGSVVVHALGGWLALAAVLLLGSRNGRYRDGKLVAMAPSSIPFLALGSWILIIGWFGFNVMSAQTLAGVSGLVAVNSLLAMVGGTMASLLIGRNDPGFLHNGPLAGLVAVCAGSDLMHPIGALATGLVAGALFVWAFTATQVRWKIDDVLGVWPLHGLCGVWGGIACGIFGQQALGGLGGVSLASQALGSLLGVTVAFAGGLLVYGLMKALLGIRLSQEEEYYGADLSIHKIGAISHE

SEQ ID NO: 25979 - protein, 403 aa, Pseudomonas aeruginosa UCBPP-PA14
MTQDWDAGRLDSDLEGAAFDTLAVRAGQRRTPEGEHGEALFTTSSYVFRTAADAAARFAGEVPGNVYSRYTNPTVRTFEERIAALEGAEQAVATASGMSAILALVMSLCSSGDHVLVSRSVFGSTISLFDKYFKRFGIQVDYPPLSDLAAWEAACKPNTKLFFVESPSNPLAELVDIAALAEIAHDKGALLAVDNCFCTPALQQPLKLGADVVIHSATKYIDGQGRGMGGVVAGRGEQMKEVVGFLRTAGPTLSPFNAWLFLKGLETLRIRMQAHSASALALAEWLEHQPGIERVYYTGLQSHPQHELARRQQSGFGAVVSFDVKGGRDAAWRFIDATRMVSITTNLGDTKTTIAHPATTSHGRLSPEDRARAGIGDSLIRVAVGLEDLDDLKADMARGLAAL

SEQ ID NO: 25980 - protein, 317 aa, Pseudomonas aeruginosa UCBPP-PA14
MQGIEGRVEWSEIAAPSCGQGEIRIRVAAAGLNRADLLQKAGLYPPPPGASPALGLECAGVVSEVGAGSTWQVGDRVCALLAGGGMAEEVVVDARHVLPVPAGLSLAEAAGIPEVYATAWLNLFQLAALQPGEKVLLHAGASGVGSAGIQLCKAFGNPCWVSVGSAERLAYCESLGAAGGALRKQSLESLRDFAPFDVILDPVGARYAGLNLELLRSDGRWVIIGLMGGREAQLDLAQLLGKRIQLTGSTLRTRDTEFKAQLIAELGLKVWPLFSAGKLRAQLERTFPIGDAEAAFEALASNQVQGKVVLVVDPSLA

SEQ ID NO: 25981 - protein, 298 aa, Pseudomonas aeruginosa UCBPP-PA14
MTDIAFLGLGNMGGPMAANLLKAGHRVNVFDLQPKAVLSLVEQGAQGADSALQCCEGAEVVISMLPAGQHVESLYLGADGLLARVAGKPLLIDCSTIAPETARKVAEAAAAKGLTLLDAPVSGGVGGARAGTLSFIVGGPAEGFARARPILENMGRNIFHAGDHGAGQVAKICNNMLLGILMAGTAEALALGVKNGLDPAVLSEVMKQSSGGNWALNLYNPWPGVMPQAPASNGYAGGFQVRLMNKDLGLALANAQAVQASTPLGALARNLFSLHAQADAEHDGLDFSSIQKLYRGKD

SEQ ID NO: 25982 - protein, 440 aa, Pseudomonas aeruginosa UCBPP-PA14
MARLKRTLSLGSVVLFGIAYMTPIIVLGTFGILAETTQGHVPAAYIAASLAMLFTALSYGRMAAAFPVAGSAYTYVRKAIDSRLGFIAGWAVLLDYLFLPMAIWLIGAAYLHSAFPAVPNAVWVLAFIGVTTTINIVGLRLAKNVNGLLMLVQFLVLGAFVALCVHYVLGDPGKPLWSLQPLLGGDLQVPLVMSGAAIACYSFLGFDAVSTLTEETRDPRRNIPRAILLITLLGGLIFIVTSYFVQLAHPSFAFDSADSAAYEIARNIGGDLFVTFFLVGLIVGQFTSGLSAQASASRLLFAMGRDGVLPRPFFGRLGKRFETPVNSIVLCGVVALLALQMDVTTSTSFINFGAFLAFSLVNLSVVFHYYLGAERRGPRETLLFLVFPGIGLVADLWLMASLDHLAIILGLCWLALGAVYLAAITHGFREQPPEMRFEEG

SEQ ID NO: 25983 - protein, 370 aa, Pseudomonas aeruginosa UCBPP-PA14
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLDKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 25984 - protein, 368 aa, Pseudomonas aeruginosa UCBPP-PA14
MSLLFEPLSLRQITLPNRIAVSPMCQYSAQEGLANDWHLVHLGSRAVGGAGLVIVEATAVLPEGRITADDLGIWSDAHVEPLHRITRFIESQGAVAGVQLAHAGRKASTWRPWLGKHGSVPIGQGGWIPVAPSAIPFDPQHTTPEALSEAQIEALVQAFVRATERSLAAGFKVAEVHAAHGYLLHQFLSPLSNQRRDQYGGCFENRIRLLLQVTAAVRKAWPEELPLFVRLSATDWVEDGWNPDETVELARRLKDLGVDLIDVSSGGTAANAEIPVGPGYQTEFAERVKKEAGIASGTVGMITEPVQAEHILRTGQADLILLARELLRDPYWPLHAADELRNEQMPWPPQYLRAAHRSTPPRKSLEMQ

SEQ ID NO: 25985 - protein, 299 aa, Pseudomonas aeruginosa UCBPP-PA14
MAGQDLSGKTAIVTGGYSGLGLETTKALAYAGARVIVTARRPDVAREALLGLDEVEVQALDLAELACVRRFAEAFSASRRRADIVINNAGVMACPETRVGPGWEAQFATNHLGHYALVNLLWPSLADDARVVAVSSAGHHYSAIRWDDVQFERGYDKWLAYAQSKTANALFAIQLDALGRERGVRAFAVHPGSIATPLQRHVPRAEMIALGWMDEAGNPASPDTLKTPQQGAATQLWAATSPLLAGMGGLYCEDCDIAGVAPDDSRTLAGVREHAIDPEQARRLWRLSATLTGIDAFAS

SEQ ID NO: 25986 - protein, 418 aa, Pseudomonas aeruginosa UCBPP-PA14
MSTLSFAVNFAVWTMFSIIGIRIKDELGLSESQFGLMVALPILTGSLVRLPLGLITDRFGGRIVFFIHMLLVAIPIYGLAFASQYWHYLVLGLFVGLAGGSFAVGIAYTSAWFEKERQGTAMGIFGAGNAGAAITNLVAPMIVVAFGWRMVPQVYSVAMLVTAVLFWLFTWTDPAHLKGAAEASQRPTLAKQLAPLAELRVWRFGLYYFFVFGGFVALALWLPKYYIAEYGLDLKTASFITMLFTLPSGLIRALGGWFSDHYGARSVNWGVFWVCLVCLFFLSYPQTTMTIHGIQGDLSLGIGLNVWLFTFLVFVVGIAQGFGKASVYRIIHDYYPSNMGTVGGMVGVIGGLGGFCLPILFGYAADHIGVRSSCFMLLFGLTVVCMVWMHYAIKQQRRIDGQAASADVDLPPTLPTHS

SEQ ID NO: 25987 - protein, 495 aa, Pseudomonas aeruginosa UCBPP-PA14
MSIAIDPSVSAFLRSPHGLLIEGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 25988 - protein, 483 aa, Pseudomonas aeruginosa UCBPP-PA14
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVQAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 25989 - protein, 421 aa, Bifidobacterium longum DJO10A
MPDWVKYGVFWHVYPLGFCGADIRPAGPRQFHGRGLDAIIPWLEYVRDLGASGLLLGPVFESATHGYDTLDHMHIDVRLGGDAAFDQLVAACRDMGLQVMLDGVFNHVSRNHPAVQAALDETAGRLNPADNPWHGLVRAHVGDNGEPALDVFEGHGDLVALDHSADETVDYVVHVMSHWLDRGVAGWRLDAAYAVPSPFWARVLPQVKAAHPYSWIFGEVIHGDYPRIIEESTMDSITQYELWKSIQHALETENFFELDWNLKRHNAFLDSFVPQTFIGNHDVTRIASQIGPAKAALALAVLMTVGGVPSIYYGDEQGYVGVKQERFGGDDDVRPKFPGSPAELSTLGEPTYRLHQALIALRRRNPWLLDARTEAVKLENKHFVYRSTSADAQHSLTVDLNIEQSPTFTIRNADGSTAYQW

SEQ ID NO: 25990 - protein, 306 aa, Bifidobacterium longum DJO10A
MCVSLAACSSSSSDSKSSSSDSSSSSDSSDKKGQIAGVTAKGKLGEKPTISFNTPMTVSDGSYVVLQKGDGDVIEEGDRVCAQGIALNVKDGTELMDTWTKNTPDCSLKVDSKTLSSTYYNQIKGAKINTTIGFGVNAQDSSGYSYILAMTFVSKSKDLEKATGEEVKDVPANLPKVTRAKNGEPSIDMNGQGSVDSLISQTLIKGNGAKLTDKNTVVVKYTGWLTNGKQFDSSWDRDSTIDADLFSDSSGQHQVIEGWQKGLVGQTVGSQVLLVIPPDQAYGDKEQGPIPANSTLVFVIDILAAY

SEQ ID NO: 25991 - protein, 256 aa, Bifidobacterium longum DJO10A
MTPLVPGKEDPNRPLVELTHVEKHFGALHVLKDINLTVTKGEVLVVVGPSGSGKSTMCRTINRLETIDSGDIRIDGKPLPQEGKELANLRAEVGMVFQSFNLFANKTILENVTLALIKVRHMDKKEAEQLAMDLLARVGVDSQASKMPSQLSGGQQQRVAIARALAMRPKVMLFDEPTSALDPEMVNEVLDVMVELAHEGMTMICVTHEMGFARKAADRIVFMSDGQILEENTPDEFFEHPQTDRAKDFLSKILTH

SEQ ID NO: 25992 - protein, 438 aa, Bifidobacterium longum DJO10A
MGTESVERLGTGFSEFDRVLGGGVVPGSVTLIAGEPGIGKSTLLLQTAGNIARVVAGDSTFRGAGQRPAQQSGRAQGNASNTVPMRGNASSTHANTVLYISGEESQAQVRLRASRINAVEPNLLLASTTDLSTVLGLIEQNKPALAIVDSAQTIVSQEVDGISGGSTQVREVASALIDTAKTLDIPVFLVGHVTKDGSIAGPRTLEHLVDVVCQFEGDSETALRMLRAVKNRFGPTDEVGCFDMSGEGIEEVTDPAGLFLSGDGPDAANAAPVEGTCVTFTLDGHRSLPIEVQALVTTSVLPTPRRAVNGVDPSRIAMLVAVLYRHSKLNLLSNDLYISTIAGGQAKEPGSDLAIVAALASAATSKPIARATCAIGEISLTGQVRPVPRMEYRLREAARLGFTTAVIPPLRKPVHVEGLQLVESNTLSDALDALGVRK

SEQ ID NO: 25993 - protein, 190 aa, Bifidobacterium longum DJO10A
MVRMRIADVEEDIDHELVSKEQIDAKIHEMAALASEDYRDKNPLLVAVLKGAVNTLVAFTQAMSIPVQIDFMSLSSYGSGTVSSGEVTVRQDLSADVRGRHILIVEDIVDSGHTLAWLVAELKRRGAASVEVFALLSKPSRREVDVDVKYAGYEIPDEFVVGFGLDFDERYRNLDSIAVLKPSVYQGVQA

SEQ ID NO: 25994 - protein, 507 aa, Bifidobacterium longum DJO10A
MADTNVNGGTQQATGKLKSVESLDQTNEMERGLSNRHVQFIAIGGTIGTGLFLGSGKSISLTGPSIIFVYILVGVIMFFLMRAIGEMMYRDPSQHTFINFITRYLGNGWGHFAGWTYWAALVLLGMTEITAVSTYFITFFDTFGIDLTHWKWLIELCFLVSLVSINLIAVKVFGEVEFWFSMIKITLICAMIATAVVMIVIGYHYPAVQIHGVDHVSPAGHAGFDNLFAIFSFAPNGWMAFLMSFQMVFFAYEMIEFVGVTVSETKNPRKVLPKAINEIIVRVLIFYVGALVAIMCIVPWTSFKPNEDGSFASPFIMVFQYAGLNWASALVFFVVITAASSALNSLLYSAGRHLYQLSEVSPNPTLNKLGKVSDRKVPARAILVSAALILLSPIVNAIPGISGAFVLFSSASSAVFLFIYILTLLAHRRYRRSADFIADGFVMPAWKVLNTVAIVFFVFIYLTLFLADDTRNSAIAGLVWLVGFGGFSMLRERYRSRDLKAALEHKE

SEQ ID NO: 25995 - protein, 448 aa, Bifidobacterium longum DJO10A
MTTVAVIGCTHAGTFATTSILAEHPDWTVHVFERNGTLSFLSCGIALWVGDHVSDPKKMFYSSPAALAEAGATMHMRTDVTSVDLDARTLTYRALDEAGDPAEQTLAFDKLVVTTGSRPVIPPIPGIDSPHVLLCKNWDHAIAIKEKAKTAKSAVVIGSGYIGAEIAEQFSVTGVKTTLVDGLDRPLANNFDKTITDQVAAAFEEHGVTLALGQKVVEFRDNDDDTVTVVTEKGEYTAEMAILAVGFLPNTDLLKGKVDMLPNGAIVVDDYMQASAPGVYAAGDSATVFYNPTGQHDYIPLATNAVRQGLLVGRNIETPTVKYMGTQATSAVQLYDLSLAASGLTRAGAERRGLTVRETSLTEDYRPDFMLTTTPVTSILTWDPETRKVKGGQFCSKADISGAANVISMAIQAGFTIDQLANVDFLFQPNFDKPVYYVGAVAMKAAAE

SEQ ID NO: 25996 - protein, 440 aa, Bifidobacterium longum DJO10A
MVDYSPALMTDMYEYTMLDAALKDGTADRKCVFEVFTRHLPEGRRYGVVAGTGRILDALEHFHLDEADLKFLADRHVVSPETIKWLENFHFSGTIRGYREGEMFFPNSPILQVEGTFGECTLLETLILSVLNYDSAVASAASRMASAAKDRPCMDMGGRRTNEWAAVAAARAAVVGGFKGTANLLAAQLYGLKAIGTAAHCFTLVHDSERDAFESQIEALGKNTTLLVDTYNIEEAVKTAVEVAGPELGGVRIDSGDLAAMAQRVRNQLDALGATNTTITVTNDLDEYALAALQTAPVDSYGVGTMLVTGSGAPTCAMVYKLTEREGADGTMVPVMKKSKDKATVPGRKLAFRSYEYALAEAEHVISGSEEKLAGFTPEPTWKNLLVDFVDHGHIDAQWQGHDAIMAAHDYHAKALSELPITAQSLMKGEPVIPTETQVL

SEQ ID NO: 25997 - protein, 330 aa, Bifidobacterium longum DJO10A
MKAVYASTVNHADPLAALAVGEQPEPQARPFWSTVSVRAVTVNHHDVWSLQGVGLAAEQTPMILGTDAVGILDEDIPGKHGLKAGSEVVLYTFVGTDGAGVAPGERRTILSEKYPGTMAEKTSVPSANVFAKPASLTTAEAAALGTSWLTAYSLLFDAAGIKPGDSVLIQGAGGGVSTAAIQLAHAAGLEVFVTSRDADKRAKALKLGANAALETGARLPRKVDAVIESVGAATWGHSVRSVRPGGTIAICGATTGDQPGAELTRLFFQDIRVQGCTMGSREDFARLLRFVEHADLHPVIDSVVSGLDAAPEAFARMIAGDMFGKIVIEL

SEQ ID NO: 25998 - protein, 475 aa, Bifidobacterium longum DJO10A
MIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQAGLEFGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 25999 - protein, 487 aa, Bifidobacterium longum DJO10A
MLLLPNETDVIPSEVDTSTHLTRKIVMKAPVLSAAMDTVTESEMAIAMARNGGIGVLHRNLSIDDQAAQVDVVKRSESGMITDPLTVNPEVTLADLDKLCGKFHISGLPVVDKENKLVGIITNRDMRFIASEDYDTLKVKDVMTKENLVTGPSNISKDDAHRLLAQHKVEKLPLVDEEGHLTGLITVKDFVKTEQYPDATKDEQGRLRVAAGVGFLGDAWQRASALMEAGVDVLVVDTANGEARLALDMISRLKHDSAFDGVQIIGGNVGTRSGAQAMIEAGADAVKVGIGPGSICTTRIVAGVGVPQLTAVYEAAQACRAAGVPCIADGGIHYSGDIAKALVAGASSVMLGGTLAGCEEAPGEKVLLHGKQYKLYRGMGSLGAMAPRGKKSYSKDRYFQADVTSSDKVVPEGVEGEVPYRGPLNAVLYQMLGGLHQSMFYIGAHNIAEMPERGKFIRITDAGLRESHPHDIVMTTEAPNYSGFHNN

SEQ ID NO: 26000 - protein, 426 aa, Bifidobacterium longum DJO10A
MYARQILDSRGNPTVQVVLDTEDGAQGLGLVPSGASTGEAEAWERRDGDKSVYGGKGVLNAVKAVNEVIAPKVIGMDAADQRALDDLMIELDGTPNKGKLGANAILGVSLAALYASAESAGLPLYRYIGGTNGHILPVPNMNIMNGGAHADFATDIQEYMISPYGFDTYSEALRAGVEVYHTLKNVLKKEGLNTGLGDEGGFAPKMKSNEDSLKYIMDAISAAGYEPGKQIGICLDVASSEFYNKETGKYRFDGEERDSAYMLDYYENLINEYPIVSIEDPFNEEGWEDWAAITARLGDRLQFVGDDLLVTNPARLQKAIDLGAANSLLVKLNQIGSVTETLDAIELATANGYTSMVSHRSGETPDTTISDLAVAKNTRQIKTGAPARGERVAKYNRLLEIEEELGSTAQYAGYSAFKACKKYLAK

SEQ ID NO: 26001 - protein, 407 aa, Bifidobacterium longum DJO10A
MNVFGTPLRVMDHGQGAHIWDVDGNEYLDFLAGIAVNSLGYAHPKWVKAVADQAAKVAHISNYFASEPQIELASKLVKLAGAPEGSKVYFGNSGAEGNEAALKLAKLYGRTLPGALPSIGGKPARILAMTHGFHGRTMGALSATWKPGIRKPYDPLVPNIEFVRAGDKVALHDAFAQTGLGRYGKGPVAAVILELIQGEAGVQPLGADYVKFVRELCDINHALLIIDEVQTGIGRTGKWFAFQRDDLSGGVTPDMVTFAKGVAGGFPMGGMIAFGEKLAALFTPGSHGSTFAGNPLGAAAGLATLDVIEDENLVANAEARGEQLRDGIMATGNPLFVSVRGRGLLDAVELKHPCSHAVMNYCLEHGLIVNAVAPNALRFAPPLIVTAQDVDQALAILKDVPTDLPDD

SEQ ID NO: 26002 - protein, 496 aa, Bifidobacterium longum DJO10A
MSEQFDLVIIGAGPGGYSTALRAAELGMKVALVERDATVGGTCLNRGCIPSKALITATHTIDTVHRAAELGVNASVNGIDFGTLRDYRLRVVKTMVGGLAGLLAHRGITVFRANAAFHADETAPATSNHIVHLVPSPDQSDILTYHKADVPEPSGPTMDLTATNIVIATGAKPRPLPGNPFAGALIDSTQALEVNEFPSSAVIIGAGAIALEFASMWNAAGSKVTLLIRKDRVLSAWDRRAGTTLTRELKRHGVNIITRASVTHVDTGANLGATVHYTREGQDGEQSVWGEIALVAIGRDPITDPAWGVTIDDHGHVATDAYGRTDKPGVWAVGDVTAGHALAHRAFEQGIVIAETIAGLNPKPVDEATVPQIVFSFPEAASVGLTVEQAQAREDLIEIKETNYPMLANARMLMSGTAGSLTIVSGCDAANPDTPRVLGVHMVSQMASDIIAEAEQLVGNHVPLADAARLVHPHPTFSETLGEALLKADGRPLHTR

SEQ ID NO: 26003 - protein, 457 aa, Bifidobacterium longum DJO10A
MSNDDLTHENFDFRGFDVPDLKAVTLASSSDGDQSKQPKTKHEDASKNRKHGKKKSKSDARSKKRAGAGKTSESFDDYEDYEEREAVSKADKKVSKDRPGLFAPMTLREVTVRNRIWLPPMCTYSSFARDGRPTPFHYQHYVSRAFGGFGMVIVESTAVAPEGRITPCDLGLWEDGQIDAWRWIVDGIREAGAVPAIQLNHAGRKASTGCFAVGYDGQSVPEEAGGWPTMAPSEIAFGGLRTPRALSVDEIHGLVGAFAAAAGRAVAAGFQAIQIHAAHGYLISQFLDPLSNERDDEYGGDLTGRSRFLVEVVDAVRGAVPEGVPVLVRISATDWAAGGWDLDQTIALSKVLKEHGVDVMDVSTGGIMSGVSIPVKPNYQVPFSEQVKAKADIPVTAVGLITKPKQAAKILAHGEADAVEIGRAALRDPYWPLRAANKLGIPSTEIPYAPQYVAGAY

SEQ ID NO: 26004 - protein, 512 aa, Bifidobacterium longum DJO10A
MGDPRGFLKVRTRRELAERPVEERIKDWFDVHAETGLQPWTQAQAARCMDCGTPFCMTGCPLGNLIPEWNDLVRQGKWEDACNRLSMTNNFPEVTGRICPALCEQACVLGIHQPPTMIRNDECTIIDQAWDLDIVKPLPPQRLTDQTVAVVGSGPAGLAAAQQLTRAGHTVVVYEKDDAIGGLMRYGIPNFKLEKGLIDRRVKQMEAEGTRFRTNVEIGKDITWDDLRDRYDAVVVAIGSRVPRDMKIPGRELDGIHFALDFLPDATRRIFGVKPVHDITAKDKHVVVIGGGDTGSDCLGTSIRQGAKDVTVLQIMPKEPSSRPDNSPWPTFARTYQKTSSMEEGGEYIYSTDSVNFEGTEEEKAKVTIDNSTTAEGFVADERGHVTGLKVVSVAPGENGPFTRQPGTERVLPADLVLISVGFLHPDTETILDQLPVELDKRGNIARNDKFATSQDGVFVCGDAGRGQSLVVWAIAEGRSCAAAVDEYLSSEQTSELPAPIKASQRPMMLPR

SEQ ID NO: 26005 - protein, 289 aa, Bifidobacterium longum DJO10A
MTNEATTPSGQPLGISHKPSKSVAMFTKFKAENKPAFIGYLPYGFPNPDVSLDAFKTMVEHGVDAVEIGLPYSDPVMDGPVIQAAASIALNNGETIKRVFEAVETVANAGGVPLIMSYWNLVYHYGVERFARDFENAGGAGLITPDLIPDEAGEWIEASDRHGLDRIFLVSPDSSTERLETVARNARGFVYAAARMGVTGERATIDASPELLVERTRQAGAENVCVGIGVSTAEQGAKVGSYADGVIVGSALVHTLLADDNKTARDPKEGLKLLAAKSEELAEGIHNAR

SEQ ID NO: 26006 - protein, 401 aa, Bifidobacterium longum DJO10A
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAAGAFTIVGGGDSASAVRNLGFPEDGFSHISTGGGASLEFLEGKELPGLKVLE

SEQ ID NO: 26007 - protein, 328 aa, Rhodobacter sphaeroides 2.4.1
MSLPETMRAIEISRPGGPEVLRPATVPVPVPGHGQILIRVAYAGVNRPDALQRAGAYAPPPGASPLPGLEASGTVAAVGPGVTRWRVGEEVCALLPGGGYADYAVTPADHALPVPSGLTLREAACLPETCFTVWSNVALRGGLRAGERFLVHGGSSGIGTTAIQLAAALGARVFATAGSEEKCAACRALGAERAINYREEDFVAVLKAEGGADLILDMVGGSYLPRNVKALATEGRLVQIAFLEGTKVELNFAEVMMRRLTITGSTLRPQSDLAKARYARDIETQVWPLVARGALRPVIDSEFPIEQAAEAHARMEGSSHIGKIVLKL

SEQ ID NO: 26008 - protein, 252 aa, Rhodobacter sphaeroides 2.4.1
MEAIPCRTFEDAIELVRAGEADLAMLPVENSTYGRVADIHTLLPGSGLRIVDESFVRVHINLLTLRGTPIEQVERAMSHTVLLGQCRTFLRGHDIRPVTGADTAGSARLVAEQGDPALAALASELAGEIYGLDVVARHIEDQSNNTTRFLVMAREADWTRRGPGKMVTTFTFRVRNIPAALYKALGGFATNGINMTKLESYMVGGSFTATEFYADIEGHPEDGNVALALDELRFFTSQSEILGVYPADPGRG

SEQ ID NO: 26009 - protein, 403 aa, Rhodobacter sphaeroides 2.4.1
MKDLKAKDAPDLGRFDWEDPFRMELQLSEEERMLRDGARAYAQERLMPRVTAAYREEQTDPAIFREMGEMGLLGATVPEEYGGLGASYVSYGLIAREIERVDSGYRSMMSVQSSLVMYPIYAYGSEDQRRRYLPGLAKGELIGCFGLTEPDAGSDTAGMKTVARKTAQGYVLSGSKMWISNAPIADVFVVWAKSEAHGGKIRGFVLEKGMKGLSAPKIGGKLSLRASITGEIVMEGVEVGEEALLPGVEGLKGPFGCLNRARYGISWGVLGAAEACLHAARQYGLDRRQFGRPLAQTQLYQLKLANMMTDIALGAQASLRVGRLLDEANAAPEMISIVKRSNCGKALEAARHARDMHGGNGIQEEFHVMRHMANLETVNTYEGTHDVHALILGRAITGLQAFF

SEQ ID NO: 26010 - protein, 382 aa, Rhodobacter sphaeroides 2.4.1
MAKRDYYEVLGVSRTASADELKKAYRTKAKELHPDRNADNPQAEAQFKEVNEAYDVLRDADKKAAYDRYGHAAFEGGMGGGARAGGGYGQQGDFASAFSDVFEDLFGDFMGGRGGAPRSRAQRGSDLRYNLRVTLDEAYRGVQKTINVPASVACDACKGTGAEGGAEAVTCPTCSGMGKVRAQQGFFTVERTCPTCNGMGQIVKNPCKVCHGAGRVEKERSLSVNIPAGVETGTRIRLAGEGEAGMRGGPSGDLYIFIEVREHALFQRDGVHLFCRVPVSIAAAALGGEVEVPTIDGGSSRVKIPAGSQTGKQMRLRGKGMPALRGGGAGDMLIELAVETPVNLTARQKELLREFEKLSEDNNPEGKSFFSKVKGFWDGMTG

SEQ ID NO: 26011 - protein, 470 aa, Rhodobacter sphaeroides 2.4.1
MLQFVKMARETPEKRPASLRSQDFHEIYREFAAATAAEQSSRCSQCGVPFCQSHCPLHNNIPDWLRLTATGRLQEAYEISQATNTFPEICGRICPQDRLCEGNCVIEQSGHGTVTIGAVEKYITDTAWENGWVVPGKPAYERSESVGIIGAGPGGLAAADALRRAGLQVTVYDRYDRAGGLLTYGIPGFKLEKDVVARRVEQLEQAGVQFVLNCNVGEDLSFDAIRGQHDAVLIATGVYKQRDLAAPGVGSAGVVQALSYLTASNRRSFGDEVDDDGLDANGKRVVVIGGGDTAMDCVRTAIRQGATSVKCLYRRDRANMPGSQREVANAEEEGVEFVWLSAPRGFIAGDAVEGVIVQKMRLGEPDATGRQMPEIIEGADYVEPADLAIMALGFEPEDLPTLWGVPDLTVTRWGTIKADFRTHATSLPGVYAVGDIVRGASLVVWAIRDGRDAAQSILDYLAQPAVVAAE

SEQ ID NO: 26012 - protein, 239 aa, Rhodobacter sphaeroides 2.4.1
MHIEIDEIAKSFGPTTALHPVSLSIPSGALIALLGPSGSGKTTLLRILGGLEFPTSGRVLFDGQDATGLTVQERRAGFVFQSYALFRHMTVFENVAYGLRARPRRSRPTGAEIDRRVHRLLGLIQLPDIARRYPAQLSGGQRQRVALARALAIEPRMLLLDEPFGALDARVRKELRQGLRDIHDETGLTTVFVTHDQDEAMELADLVVVMSMGRIEQIGKPAEIRARPRTDFVRQFLTA

SEQ ID NO: 26013 - protein, 492 aa, Rhodobacter sphaeroides 2.4.1
MLDSVTDLRSLLKDPSLLETRAFVAGEWVDADDGATFEVTNPARGDVICTVPDLGRAETARAIAAAEEAMKEWAARTGKERAQVMRKWFDLMMANQDDLGAILTAEMGKPLAEAKGEIAYGASFIEWFGEEAKRIYGETIPGHMRDKRITVLKQPIGVVGSITPWNFPNAMITRKCGPALAAGCGFVARPAAETPLSALALAVLGERAGLPKGILSVITSSRSSDIGKEMCENPIVRKLTFTGSTEVGRILLRQAADQVMKCSMELGGNAPFIVFDDADLDAAVQGAMASKFRNNGQTCVCANRIYVQSGVYDAFAEKLAAAVKKLKVGDGLVEGTEAGPLINEKAVAKVEEHIRDVLDGGGQVLTGGKRHALGGTFFEPTVVTGVKQEMKVSTEETFGPLAPLFRFETEDEAVGYANDTIFGLASYFYARDVGRITRVQEALEYGIVGVNTGIISTEVAPFGGVKQSGLGREGSRHGIEDYLEMKYICLSI

SEQ ID NO: 26014 - protein, 459 aa, Rhodobacter sphaeroides 2.4.1
MEGLAQANDLSEVIEADRAHMWHHLSQHKQYETVDPRIIVEGKGMRVWDAAGKEHLDAVSGGVWTVNVGYGRESIANAVRDQLIKMNYFAHSAGSIPASRFSKRLIEKMPGLSRVYYSNSGSEANEKVFKMVRQISHRHHGGKKGKILFRERDYHGTTITALATSGQPQRAEQYGPLTPGFVMVPHCLEYRKQWDVENYGERAADAIEEVILREGPDTIGALCLEPVTAGGGVIVPPAGYWERVQEICRKYDILLHIDEVVCGLGRTGTWFGYQNFGVKPDFVTMAKGVASGYAAISCTVTTEAVFDMFKDDPSDPMSYFRDISTFGGCTAGPVAALENMRIIEDEGLLENTLKMGARVVENLSALQEKHAVIGDVRGKGLFCGAELVADRATKEPMDEKRVAAVVADVMAQGVIIGMTNRSLPGFNNTLCLSPALIATPDDIDQITDAIDRALTRVFG

SEQ ID NO: 26015 - protein, 397 aa, Rhodobacter sphaeroides 2.4.1
MGWKTLDDMDLAGKVVLVRVDVNVPMENGEVTDATRIEKIVPTVEDILKKGGKPVLLAHFGRPKGKVVDEMSLRLVLPALQNALPGTKVSFAADCVGPEPEQAVAAMLEGEVLLLENTRFHAGEEKNDPELAAAMAKLGQVYVNDAFSAAHRAHASTEGLARLLPSAAGRLMEAELKALEAALGHPERPVVAVVGGAKVSTKLDLLGNLVGRVDHLVIGGGMANTFLVAQGIEVGKSLAERDMADTAREILSKAKAAGCTIHLPLDVVVAREFKAGAANETVETAACPADAMILDAGPKTVAALSEVFASAKTLIWNGPLGAFEIEPFDAATNAAALQVAQLTKAGQLISVAGGGDTVAALNKAGAAEGFSYISTAGGAFLEWMEGKELPGVAALTV

SEQ ID NO: 26016 - protein, 370 aa, Rhodobacter sphaeroides 2.4.1
MAEAIFLTQGFVYDSAEQAEARFIETGADEFIYARYGNPTTRMFEERIAAVEGTEDAFATASGMAAIHGVLTSIVRAGDHLVAARALFGSCIYILEEVLGRFGVEVTFVDGTDLDQWRAAVRPGTKAVFFESVSNPTLEVADIGAIAEIAHAVGALVIVDNVFATPVFSTAVRQGADVVIYSATKHIDGQGRALGGVVCASQAFIRKVLEPFMKHTGGSMSPFNAWLMLNGMATLDLRCRAMADTAEKIARALEGHPQLGRVIHPALESHPQHEMAKAQMERPGTMIALDLAGGKEAAFRFLDALRIVKISNNLGDARSIATHPATTTHQRLSDAQKAHLGITPGLVRLSVGLEDADDLIADLKQALAVI

SEQ ID NO: 26017 - protein, 440 aa, Rhodobacter sphaeroides 2.4.1
MTFSRADFPADFLFGVATSAYQIEGHGAGGAGRTHWDDFAAAPGNVAHAEDGRRACDHYHRWEEDLDFVRDAGFDSYRFSASWARVMPEGRGTVNAEGLDFYDRLVDGMLARGLKPALTLYHWELPSALQDLGGWRNRDIAGWFADYAEVLLGRIGDRVWSTAPVNEPWCVAWLSHFLGHHAPGLRDIRAAARAMHHVLLAHGAAVESARGLGVGNLGAVCNFEHAIPADGSEASAAATRRHDALINRWFVSALFNRQYPEEALDGIAPHLPSGWEKDLDRIAQPLDWFGINYYTRKLVAAAPGPWPGLSEVEGPLPRTRMGWEIHPEGLSDILLRIHEGYTRGLPLIVTENGMAAADRVQAGEVQDPDRIAYLEGHLAAVQRAIAQGVPVRGYHVWSLLDNFEWAFGYDQRFGLVHVDFQNLQRTPKASYHALARALAR

SEQ ID NO: 26018 - protein, 379 aa, Rhodobacter sphaeroides 2.4.1
MATGFFWDERCFWHHGGNYALTLPVGGLVQPGGGLPESPETKRRLKNLLDVTGLAGALRMQGAPPASEEELRRVHPAAYLTAFKALSDRGGGELGLRSPFGRDGYETAALSAGLATAALREVLRGRLANAYALSRPPGHHCLPDWPNGFCLLANIAIAVEAALAEQRAERIAVVDWDVHHGNGTEAIFLSRPEVLTVSLHQERNYPLDTGGAEVRGEGPGHGANLNIPLPPGTGHRGYLEAMDRLVLPALRRHRPDAIVVACGFDASAMDPLGRMMASADTFREMTRRMKEAAADLCEGRLVLVHEGGYSEVHVPFCGHAVLEELSESGIPAPDPLGATIRARQPGPGFDRFLSEHLSDLAAHFGLGGPRPPGPVPTAS

SEQ ID NO: 26019 - protein, 481 aa, Rhodobacter sphaeroides 2.4.1
MSDLIHPVLLCGGSGTRLWPLSRKSYPKQFARLTGDESLYQASARRLSGAGFAAPTVVAASDFRFVVIEQLAALKIQPGCVLIEPEARNTAGAIAAAALALEARRPGALMLVAPSDHVIPDADRFRAAVQAAAPAARAGQIVTFGIRPDRPETGYGWLELSTPTADFAPEPQPLRSFVEKPDLATAERLLSGGMHLWNAGIFLFTTTAILEALERHAPEVLAPVRQAVEAAEKDLSFTRLAPGPWADLPDISIDYAVMERAENLTVVPYAGAWSDLGDWQAVWRDAPPQEGGVVLSGPATAIDCHDSLLQATNAAQQLVGIGLTDIIAVAMPDAVLVAHKDRAQEVKRAVAALKAKGVEQAETLPRDYRPWGWYESLVKGPRFQVKRIVVTPGATLSLQSHHHRAEHWIVVEGTAKVTIDNQVTLVTENQSVYIPLGARHRMENPGKVPLTLIEVQTGAYLGEDDIIRYEDVYARGQGARG

SEQ ID NO: 26020 - protein, 290 aa, Rhodobacter sphaeroides 2.4.1
MKIAFIGLGNMGGPMARNLATAGHEVTGFDLAAPAPEGVRAAASAAQAATGAEVVVTMLPNGAILRQVAQEIVPAMTAGAVLCDCSTVDVESARAVAAEAEAAGLGALDAPVSGGVGGAAAGTLTFMVGGSDAAFATVQPLFEIMGQKAVHCGGPGAGQAAKICNNMILGVTMIATCEAFALADKLGLDRQKMFDVVSTSSGYSWSMNAYCPAPGVGPTSPADNGYKPGFAAELMLKDLRLSQQAAEDADADTPMGQLAATLYETFVEAEGGRGRDFSAMLPRFETRGRG

SEQ ID NO: 26021 - protein, 278 aa, Rhodobacter sphaeroides 2.4.1
MRLREIGAPDAARIAKREGQHKYDHGHVLVLGGPPAQGGAGRLAARAALRVGAGLVTLACPPAALAENAARLDAVMLRALEGTEDLERLLADRRLSALCLGPGLGLSDRERDLVAVALDAGRPTVLDADALTLVARERGLRQRLHPGCVLTPHMGEFRSLFPGTPNDEASRAEAVRAAAAETGAVILLKGAKTLVAGPEGLAVHAATGARGAPWLATAGAGDVLAGLIAGLLGRGLRGQEAAEAGAWLHVEAARIVGPGLIAEDLPEALPAVFRALGL

SEQ ID NO: 26022 - protein, 249 aa, Rhodobacter sphaeroides 2.4.1
MGKKMRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAALSAA

SEQ ID NO: 26023 - protein, 472 aa, Rhodobacter sphaeroides 2.4.1
MRNIDRFFIGGAWTAPLGTDRHRLVNPATEEEIAAIPMASTEDVDRAVTAARAAFEGWQASSKEERLLLLRRLLDLYNEAYDELAELMTREMGTVARFSREAQAWVGRAHLEAAIEALEAESFEEMRGSTLISKEPIGVCALITPWNWPMNQLVVKVAPALAAGCTVVAKPSEFSPLSSIRFAELVEAAGFPPGVYNHITGAGPVAGEALARHPDVDMISITGSTRAGIAVARAAADTVKRVTQELGGKSANIILPDADLATAVRQGVLDCFGNAGQACKAPARMLVPAERMEEAAALAGAAAEALTVGAPEGEVDLGPVVNESQWRRIQSLIEAGIAEGARLVTGGPGRPDHLPRGWYVRPTVFADVAHGSTIATEEIFGPVVALIPYRDEEEAVRIANDSIYGLAGYIQTGDPETARRIARKLRVGMVYINGAGWDARAPFGGYKQSGNGREHGAWGLADYLETKATAGL

SEQ ID NO: 26024 - protein, 455 aa, Rhodobacter sphaeroides 2.4.1
MRDDAPNSWESRADASSFYGFTDLPSVHQRGTVVLTHGKGPYIYDVHGRAYLDANSGLWNMVAGFDHPGLIEAAKAQYERFPGYHAFFGRMSDQTVMLSEKLVEVSPFARGRVFYTNSGSEANDTMVKMLWFLGAAEGHPERRKIITRVNSYHGVTAVSASMTGKPYNSLFGLPLPGFIHVGCPHYWRFGQAGETEAEFTQRLARELEATIIKEGPDTIAGFFAEPVMGAGGVIPPSEGYFQAVQPVLKRYGIPLIADEVICGFGRTGNTWGCQTYDFMPDGIISSKNITAGFFPMGAVILGPELADRLQAASEAVEEFPHGFTASGHPVGCAIALKAIDVVMNEGLAENVRALTPKFEAGLAYLAENPNIGEWRGKGLMGALEAVKDKATKTPFPGDLSVSERIANSCTDHGLICRPLGQSIVLCPPFIMTEAQMDEMFEKLGAALKKVFAEVA

SEQ ID NO: 26025 - protein, 371 aa, Rhodobacter sphaeroides 2.4.1
MTMTISHLIRRFGPVEVLRGIDLEVRKGELIALLGPSGSGKTTLLKIIAGLDWPDAGGLAVNGQDWLARKAQERRTGFVFQHYALFPHMKVADNVAFGLTVLPRAQRPSAAKIRARVEELLHFLQIAQLADRYPGELSGGQRQRVALGRALAIDPEILLLDEPFGALDAQVRRDLRRWLREVHDATGTTTIFVTHDQEEAFELADRVVIMGAGRIEQIGHADEIYDHPATPFVARFLGLTVEIPVALRAGRAIAAGLDTSLLPRRAMADGPATLFLRPADLRPAPDPEGTFRVTDVSSTGALLRIGLEGPAGCRAEAEVPRRTASGLAPGQTVRLEAQAGQIFPGQTHLGGDTAAAAAPSADRPILKESHL

SEQ ID NO: 26026 - protein, 464 aa, Rhodobacter sphaeroides 2.4.1
MTDQPSPSGSTLSEAETFLAAHPEIEAFDIVLHDANGIGRGKIIRRHELLSFYKGGRHLPISILGLDICGEDVHETGLIWDQGDGDLRAWPIPGTLVPLHGTTPPRGEVFMCMYDLDGRPMSSDPRHALARQVEALAELGLHPSAAFELEFFLLANERGPDGRVQPAADVLDGRRSAKTEVYSVDHLHGMMPLFSDIYAGAETAGIKAETMISEYAPGQYELTLHYRTDVLQAADDLMRLKRIVRAQARRHGVTACFMAKPVESYAGSGMHLHVSLCDAEGRNIFVEETEGQWSRPILHALGGLRETMGESMLVFAPHANSWRRFASQSYAPVSPSWGVNNRSVALRIPAGDIRARRIEHRPAGVDANPYLVAATVLAGIRRGLEQQIDPGPETTGNGYEDPGDTQPIPTCWRSAIAAAEHSAFLREALGPDMHRTFTAIKAAEYARVARTIPDVDYDLYLHTV

SEQ ID NO: 26027 - protein, 447 aa, Rhodobacter sphaeroides 2.4.1
MAEDRLAAFLADETARFERENPRSKEALQRGAQSYLGGVPMHWMKDWPSPFPLVAAEAQGARLTDLDGHRLDDFCLGDTGSMFGHSPAPVARAIRRQARQGLTYMLPTEATFEAGQLLNRTFGDFRWQVALTATDANRFALRVARAVTGRRKVLVFNGCYHGTVDDTMVMLENGRTRARPGLVGMVADLASKAVAVEFNDVAGVEAALATGEIAAILTEPVMTNSCMVLPEAGFHDALRTLSRRYGAVLILDETHTLSSGLGGYGRVHSLSPDILVVGKCVAGGTPTAVWGLTPDLGARFAAYNATRPAGHSGMGTTLSANPMQFACLCATLSEVMTPEAYAHMERGAKRLAKGLAAAIARVGAPWHVVRVGARVEFICAPGPLRNGTEAAAAHQPRLEGAVHLGLLNRGSLIAPFHNMMLVSPMTRTRQIDRLIAAFDAILTDLFA

SEQ ID NO: 26028 - protein, 358 aa, Rhodobacter sphaeroides 2.4.1
MDAQKIRTTEGRGRLYDSVLDTVGNTPVIRINNLSPEGVTIYVKAEFFNPAASVKDRLALNIIEAAERSGKLKPGMTVVEATSGNTGIGLAMVCAQKGYPLVITMSEAFSVERRRLMRLLGAKVVLTPRGGKGFGMYRKAQELAEANGWFLASQFETDANADIHEATTAREIVADFAGERLDWFVTGYGTGGTVTGVARVLRRERPEVKIVLSEPANAQLVASGVPQDRNADGTAASGHPAFEAHPIQGWTPDFIPKVLQEGLDAGAYDELIPVAGEDGMKWARELAAKEGILTGVSGGSTFAVARQVAERAPKGSVILAMLPDTGERYMSTPLFQAIGEDMNEEEKALSASTPSFQL

SEQ ID NO: 26029 - protein, 307 aa, Rhodobacter sphaeroides 2.4.1
MTVVWISHAASEAHATPEGHPERIERMAAVAAGIDRLPLERREAPLAEEADVLRCHPQAYLDRIRAAEPAEGIRGLDPDTWMSPGSFEAAMRAVGGTCAAVDLVLAGEASSAFVGCRPPGHHAERERPMGFCLFGSAAIAAKRALDHHGLDRVAVVDFDVHHGNGTQDLLWDESRALFVSSHQMPLYPGTGAADERGAHGQILNLPLAPGSGSAEMRAAWEEAFRRIEAWQPELILISAGFDAHAADPLANLNWREADFAWLTGRLCDLAAASCGGRVVSTLEGGYDLAALAASSAAHVGVLLERSA

SEQ ID NO: 26030 - protein, 472 aa, Rhodobacter sphaeroides 2.4.1
MATLGPASNDYATIRALFEAGADVFRLNMSHGSHDDIRARHQMLRQIEADTGTPVCILADLQGPKLRVGTFANGSEELVERGRFRLDLDPAPGTAERVNLPHPEIFAALEPGSSLLVNDGKIRLEVADCGPDFADCIVTVGGTISNRKGVNVPDVVLPLAALSEKDRRDLEFVCELGVDWLALSFVQRPEDVEEARSLARGRAAILSKIEKPAAVKAYDAILAVSDGIMVARGDLGVELPVQAVPPIQKRLVRGARAAAKPVIVATQMLESMIDSPMPTRAEVSDVATAIYEGADAVMLSAESAAGSYPIEAVMTMNNTAISVESDPVYRDIIEASRAAKRASVADAIVAAAREIAETTPIKAICCFTQTGKTVSLVARERPRVPILALTPLVETARRLSLTWGTHCVVTAPQERFKGAVICAARAALSDGFAQEHEQIAVVAGVPFNVRGTTNILRVAPCDERLIYSGDPE

SEQ ID NO: 26031 - protein, 469 aa, Rhizobium leguminosarum
MATASEILKQIKENDVKFVDLRFTDRRASLQHVTMDVVCVDEDMFADGVMFDGFSIGGWKAINESDMVLMPDTETVHMDPFFAQSTMVIVCDILDPVSGEAYNRDRRGTAKKAEAYLKASGIGDTVFVGREAEFFVFDDVKYKADPYNTGFKLDSTELPSNDDTDYETGNLGHRPRVKGGYFPVPPVDSAQDMRSEMLTVLSEMGVVVEKHHHEVAAAQHDTLVRNADELGIKFKMQIYKYVVHQVANAYGKTATFMPKPIFGDNGSGMHVHQSIWKGGKPTFAGDEYAGLSESCLFYIGGIIKHAKAINAFTNPSTNSYKRFVPGYEAPVLLAYSARNRSASCRIPFGSNPKAKRVEVRFPDPTANPYLAFAAMLMAGLDGIKNKIHPGKAMDKDLYDLPPKELKKIPTVCGSLRQALESLDKDRKFLTAGGVFDDDQIDAFIELKMAEVMRFEMTPHPVEYDMYYSA

SEQ ID NO: 26032 - protein, 234 aa, Rhodobacter sphaeroides 2.4.1
MLNADVSRRRTEAVSRGVGMQTQIYADRAVNAEIWDIEGRRYIDFAAGIAVVNTGHCHPKVMAAVAEQMGRFTHTCHQVLPYENYIRLAERLNAAAPGDFPKKTVFVTTGAESVENAIKIARIHTGRSAVVAFGGGFHGRTFMTMSLTGKVEPYKKGFGTMMPEVYHVPFPQALHGISTEGPWRPSPGSSRPTSTRAAWPRSSSSRCRARAASIPRRRIWCGRSGSSAMRTGSS

SEQ ID NO: 26033 - protein, 483 aa, Rhodobacter sphaeroides 2.4.1
MRAQPAASHFVDGRPLEDETGAPIPVIYPATGEEIARLHEATPAVIEAALASGARAQAAWAAMRPVERARILRRASDLIRAHNEELSLLETLDTGKPLQETLVADWASGADALEFFAGLAPVVTGETVPLGQDFVYTIREPLGLCVGIGAWNYPSQIACWKAAPALALGNAMVFKPSEVTPLGALKLAEILIEAGLPPGLFNVVQGRGAVGASLVTDSRVAKVSLTGSVPTGRRVYAAAAEGVRHVTMELGGKSPLIVFDDADLESAIGAAMLGNFYSAGQICSNGTRVFVQKGIKEAFLARLAERADAIRMGDPLDPEVQMGPLVSQAQLEKVLAYIEKARAEGGRLVCGGEASVSPGCYVQPTVFADVTDAMTLAREEVFGPVMAVLDFETEEEAIARANATDFGLAAGVFTADLTRAHRVVAQLQAGTCWINAYNLTPVEAPFGGVKLSGVGRENGRAAVQHYTQVKSVYVGMGPVDAPY

SEQ ID NO: 26034 - protein, 376 aa, Rhodobacter sphaeroides 2.4.1
MKDILQELENRRAIARAGGGQRRVEAQHKRGKLTARERIELLLDEGSFEEFDMFVRHRCTDFGMQDDRPAGDGVVTGWGTINGRMVYVFSQDFTVFGGSLSETHAQKICKIMDMAMQNGAPVIGLNDSGGARIQEGVASLAGYADVFQRNIMASGVIPQISVIMGPCAGGAVYSPAMTDFIFMVRDTSYMFVTGPDVVKTVTNEVVTAEELGGASTHTKKSSVADGAFENDVEALYEIRRLVDFLPLSNRTPAPVRPFFDDVARIEDSLDTLIPDNPNQPYDMKELILKIADEADFYEIQKDFAANIITGFIRLEGQTVGVVANQPMVLAGCLDIDSSRKAARFVRFCDAFNIPILTLVDVPGFLPGKGQDMAASS

SEQ ID NO: 26035 - protein, 242 aa, Rhodobacter sphaeroides 2.4.1
MLEIVALEKTFGELKVLRDINLRVATGEMVFVIGPSGSGKSTMLRCCNRLEEPTSGAILIDGKDIVGCSSSALNRMRLEVGMVFQGFHLYPHMTVVANVMLAQIKALKRSKDEARERALAMLDRVGLRHRAETMPTQLSGGQQQRVAIARALALDPKVMLFDEPTSALDPELVGSVLAVMKDLKDSGMTMLVVSHEMGFAREAADRVVFMDGGLVVEEGPPEEIFANPKAERTQAFLSRVRA

SEQ ID NO: 26036 - protein, 440 aa, Rhodobacter sphaeroides 2.4.1
MAKLGKSAQPVLTHAEGIYVHTEDGRRLIDGPAGMWCAQVGYGRREIVDAMAHQAMVLPYASPWYMATSPAARLAEKIATLTPGDLNRIFFTTGGSTAVDSALRFSEFYNNVLGRPQKKRIIVRYDGYHGSTALTAACTGRTGNWPNFDIAQDRISFLSSPNPRHAGNRSQEAFLDDLVQEFEDRIESLGPDTIAAFLAEPILASGGVIIPPAGYHARFKAICEKHDILYISDEVVTGFGRCGEWFASEKVFGVVPDIITFAKGVTSGYVPLGGLAISEAVLARISGENAKGSWFTNGYTYSNQPVACAAALANIELMEREGIVDQAREMADYFAAALASLRDLPGVAETRSVGLVGCVQCLLDPTRADGTAEDKAFTLKIDERCFELGLIVRPLGDLCVISPPLIISRAQIDEMVAIMRQAITEVSAAHGLTAKEPAAV

SEQ ID NO: 26037 - protein, 344 aa, Rhodobacter sphaeroides 2.4.1
MKTIFSDKHALQSVEREFYRGGWVEAFEIPRRAELVLAAVTRAGLGPVTAPQPFDLGPVLAVHDAAFVRFLEGAWESWVAEMGPVPAYPNLWPPRRSRTIPTVRPGAELGRYVVDMSSPVLTGTWEAARAGVDCALTGVALIESGEPAAFALSRPPGHHAGRDYFGGYCFLNNAAIAAQQFRSLGAERVAVLDIDYHHGNGTQDIFYDRGDVLTVSVHADPVQDYPYYIGFADETGEGEGAGANLNLPLPWGADFASYRSALAEGLARIRAFAPDRLVVSLGVDTFMDDPISQFRLESGDYPRIGAMIAALGLPTLFVMEGGYAIEAIGENVVQLLKGYEAERG

SEQ ID NO: 26038 - protein, 255 aa, Rhodobacter sphaeroides 2.4.1
MSLEACAALVERGDPDRHAAAMAAPPAARARLWPLYAFNLEVARAPWVTREPMIAEMRLQFWRDVVEEAPAGRSRAHEVAGPLAGLIREAALPVPLLEAMIEARRHDIWAEPFADEAAFTAHLEATAAGLMWASALALGAPAAAETAVRAVGWAAGLAAWLQAVPELEARGRQPLPDGRPEAVVALARAGLSRLESGRRVRLPRDARPALLPAWQAGALLRLAVDEPGRVAAGRLQLSEFARRGRLLRAAFTGRI

SEQ ID NO: 26039 - protein, 315 aa, Rhodobacter sphaeroides 2.4.1
MRLLITRPLPDRILEAARARFEVTVRNSTKPLSPEELRRALAEHDAVLPTLGDLFRAEVFADVPQPRARILANFGVGTNHIDVAAATAAGIAVTNTPGAVTDATADIALTLMLMTARRAGEGERLVRRGAWEGWHPTQMLGLHMTGKRLGILGMGRIGKAIARRAHHGFGMEITFFNRSPVADPGVPARQVGLAEALDADIVVVAVPATPATHHLVDAAALSQMRPGAILVNIARGDIVDETALIAALAEGRLAGAGLDVYEFEPEVPAALRAMENVTLLPHLGTAALEVREGMGLMAVENLLAFADGRPLPNAV

SEQ ID NO: 26040 - protein, 243 aa, Rhodobacter sphaeroides 2.4.1
MTKKLLAELLGTFILVFFGCGAAVLMGPQIGMLGISLAFGLSIVAAAYSLGAISGAHLNPAVSLGFLMAGRMPMAEFGGYVLAQIAGALLGSLVVFLIASGKAGYVLATDGLGQNGFGAGYLGEYSMGAALIFELIATFVFVSVILAATASHVSSASTALAGLAIGLTLTGIHLVGINVTGVSVNPARSLAPALFVGGKALSDLWVFIVAPLAGGAAAGLAHASGFFRPGGIEPAPATGAATL

SEQ ID NO: 26041 - protein, 233 aa, Rhodobacter sphaeroides 2.4.1
MMNSLSNSLAAADIAHSLHPYTNARAHERNGPLIITRGQGVHVYDSEGREYIEGLAGLWSVAVGFSEPRLAEAAARQMAELPYYHTFAGKAHEPQIRLAEKLVEMTPEALTRVFFTNSGSEANDTVVKLVWFMNNALGRPQKKKFLSRIKGYHGITIASGSLTGLPVNHRASICPPSRSCIWAARTTGASAPRARARPSSAPASCARPRRRSSPRGPRPSPPSSASRSWARAG

SEQ ID NO: 26042 - protein, 217 aa, Rhodobacter sphaeroides 2.4.1
MVNVILLGPPGAGKGTQAKRLEESRGMVQLSTGDMLREAKTSGSEMGRRAAEVMDRGELVTDEIVIGLIREKLQSPAAGGFIFDGFPRTLKQADALGELLAQMGQGLDAVIEMQVDDAALVARITGRYSCGSCGAVYHDDTKPTKVEGVCDVCGSTDLRRRADDTAEALSKRLMEYYKKTSPLIGYYYAKGQLSSVDGLAEMDAVSAAISKVLDKRG

SEQ ID NO: 26043 - protein, 482 aa, Rhodobacter sphaeroides 2.4.1
MEIREALTFDDVLLVPAASSVLPSDADTSTFVTKAIRMNIPLLSSAMDTVTEGRMAIAMAQAGGIGVIHRNLGIEEQAREVSRVKRFESGIVYAPITLRPDQTLADAKALQERYNVTGFPVVDESGRVVGIVTNRDMRFANDDRTPVKVMMTSDNLAILQEPADRDTAISLMKARRIEKLLVTDGQGKLTGLLTLKDTEKSVLNPNACKDELGRLRVAAASTVGEAGFERSQALIEAGVDMVVIDTAHGHSEGVSLAVERIKAFSNSVQVVAGNVATAEATRALIGAGADAVKVGIGPGSICTTRIVAGVGVPQLTAIMDAAGAAGDVPVIADGGIKFSGDFAKAIAAGASCAMVGSAIAGTDESPGEVILYQGRSFKSYRGMGSLGAMARGSADRYFQKDAASDKLVPEGIEGQVPYKGPAAAVIHQMVGGLRAAMGYTGNRTVAEMRQGCRFVRITGAGLKESHVHDVQITRESPNYRLG

SEQ ID NO: 26044 - protein, 357 aa, Rhodobacter sphaeroides 2.4.1
MIEFRDVHKYYGDYHALRGISATIRAGEFFSLLGPSGCGKTTLLRTIAGFEEISSGVVLIDGKDTRGVPANKRPTNMVFQSYAIFPHLTVAENVGFGLRRANLSKEETTRRVAEALEMVGLRGYGARAAHALSGGQRQRVALARALILKPKVLLLDEPLSALDKKMREQMQVELIKLQRQVGITFILVTHDQEEALVMSDRIAVMFEGEIAQLADPETLYRRPTSRKVADFIGTMNFLPARILSETQQGIEVEAQGLGRMLLDPMQAPGAASGTGVTVGFRPETATILFEGQKADREAMGTIEEVVYYGDMTYYDIRLDGTEAPIRLSMRNVFGRAVLEIGARARVAWSPGALVLFR

SEQ ID NO: 26045 - protein, 203 aa, Cucumis sativus
VLTGDSGVGKSNLLSRFSKNEFRFDSRPTIGVEFAYRNIKVADKLVKTQIWDTAGQERFRAITSSYYRGALGALLVYDITRVATFDNIKKWLRELREFGNPEMVIILVGNKCDLHQSREVQEEEARHLAELENLFFMETSAKDNLNVEEAFLEMVRRIHAIASQKTLDLHKKFEKLVAFPNGKEIISIHEVTPTKPNSNCCSL

SEQ ID NO: 26046 - protein, 493 aa, Thermus thermophilus HB27
MDEGKILYEGLTFDDVLLLPDYSEVLPKEVSVRTRLTKRLFLNIPILSAAMDTVTEAEMAIAMAREGGLGVIHKNLSIEAQAAMVRKVKRSEAGMIQDPVTLPPTATLEDAERLMREYRIGGLPVVDVYGRLLGLVTNRDLRFERDLKRPVTEVMTPVERLVTARPGTTLEEAEELLRRHKVEKLPLVDESGRLKGLITLKDIVKRRQYPNAVKDAQGRLLVGAAVGASKDLPERAQALVEAGVDVLVLDSAHGHSKGILEALAYLKETFGERVEVIAGNVATREGARALAERGADAVKVGIGPGSICTTRVVTGVGVPQITAILEAAAGVKDLDVPVIADGGIKYTGDVAKAIAAGAHAVMLGSMLAGTDEAPGEEVLKDGRRYKLYRGMGSLGAMKQGSADRYFQDPEKGETEAKKLVPEGIEGMVPYKGPVADVLYQIVGGLRSAMGYVGAPDIETFRKKARFVRMTMAGLIESHPHDVVVVKEAPNYSR

SEQ ID NO: 26047 - protein, 343 aa, Thermus thermophilus HB27
MRAVVMRARGGPEVLEVADLPVPEPGPKEVRVRLKAAALNHLDVWVRKGVASPKLPLPHVLGADGSGVVDAVGPGVEGFAPGDEVVINPGLSCGRCERCLAGEDNLCPRYQILGEHRHGTYAEYVVLPEANLAPKPKSLSFEEAAAIPLTFLTAWQMVVDKLGVRPGDDVLVMAAGSGVSVAAIQIAKLFGARVIATAGSEDKLRRAKALGADETVNYTHPDWPKEVRRLTGGKGADKVVDHTGALYFEGVIKATANGGRIAIAGASSGYEGTLPFAHVFYRQLSILGSTMASKSRLFPILRFVEEGKLKPVVGQVLPLEAAAEGHRLLEERRVFGKVVLQMG

SEQ ID NO: 26048 - protein, 423 aa, Thermus thermophilus HB27
MAKATYACVECGYRTPKPLGRCPSCGSWESFQEVAPAPASRRAKPSPLPLLALSQVDEAEERRFSSGLSEVDRVLGGGFVTGEVVLLGGEPGVGKSTLLLEMAKRMPQRVYYVAGEESPAQIKLRAQRLGVKDLLLVRETRLEPLLALLEEDPPEVLFVDSVQTLEAGGSPGSLVAVREATSALVRFAKESGAAVVLVGHVTKEGVVAGPKSVEHAVDATLYLETAGPYRVLRSAKNRFGPVGEIGVFRMEEAGLLEVENPSEAFLKERPLGVPGSAVALALAGERALALEVQALAAKTPFPAPRRVVQGLDSRRVDVVLAVLERRLGLPLANLDIYVNLAGGLKVQDPGLDLAVALAVYSAVVGRPLPADLALVGEVGLAGEVRRVAGLERRLREGERAGFGRFLHPGNLKRLQEAVEAYLA

SEQ ID NO: 26049 - protein, 506 aa, Thermus thermophilus HB27
MDPFGILYTDLYQLTMGQVYFRMGLHEKEALFEAFYRRNPDYGAHQAGYTVFAGLDPLLSWMEEARFGEEEIAALRSLKSRSGKPLFAEDYLRYLKAMGGFSGLTLRALPEGRVAHPQVPLVSVEGPLLQAQLLETALLNRLNYETLIATKASRVREAAGEAVVLEFGLRRAPAKGGESATRASLIGGANRSSAVSLSHLLGLPASGTHAHSLVQAFMALGYSEEDAFRAFAEVFPDDTILLLDTVDTLHSGLPHAIRVFEELRRKGHRPVGVRIDSGDLAHLAIQVARELDKAGFPEVLIVLSGDLDELVIWQIKSQVLEEAPRYGVDPDRLLKRLVYGVGTRMVVSWGAPALGGVYKLVAVRENGTWAPAMKVSNSLEKVLNPGHKRVYRVYDERGLATADLLALAEEEVREDAPLTLRHPTDPTKRRTLRPGSFRLEPLLEEVYRGRRLFPPLPLEELRKRRDRDVALLDPGVRRLVNPHVYHVSLTERLFALKEELVRRLEG

SEQ ID NO: 26050 - protein, 433 aa, Thermus thermophilus HB27
MDALARLERLPLGRPHYRLLLLLGFGWALDAMDVGLISFTLPALSRDFGLDPVGAGLLGSVGLLGMLFGALLGGRLADRFGRKAVVGYSLFLAGLGSLLTALAPSLSWVFLFRFLTGLGLGAELPVAASLMGEFSPKAHRGRMVVLLEAFWAVGWLLAALVGYLLVPSLGWRAAFLAGALPALYAAYLRLSLPESPRWLVARGRAAEAEALVASWERAFPGPLPEPRPEPAPRPLPYGALFRPPLLRRTLFLALAWFALNAGYYGAFIWLPSLLVAQGYTLVRSLEYVLLITLAQVPGYLVAAFLVERWGRRPVLVGFLGLSALFAWLLSQAASPGEVLLFGALLAFFNLGAWGAIYAYTPELFPTALRGSGAGFVAAVGRVGGILAPYATGALLPLWGPGGVLALHGGLLLLAGVFAFAVGVETRGKPLEEA

SEQ ID NO: 26051 - protein, 492 aa, Thermus thermophilus HB27
MLNPNWLGRLAAYHPDRPALWFRNTWLTYGELYLRARKAAGALRALGVAKGDRVGLIAWNHPAYLDLLFAGPLLGHILTPFNHRLSLPELQALHAYTEPKVLFYGEGFQEVARALDPKALPLEALLEGEEAPEEVRVDLEDPALLLFTGGTTGLPKGALLPYRQLLVNAVQTAFSWGLSREDRYILATPMFHAALNALATPLLYLGSQVVVEERFHAEEYLELVRLHRPTLLFLVPTMYQMLLEAQAFAETDLSSVRFAISGGAPCPAPVREAFRERGVRFKQGYGLTECGVNCFTFELEEAERYPESVGRPMPHLWARLVREDGKEAGVGEAGELWLSGSVVMKGYFRRPEENEKVFVWDGERLWLRTGDLAHRDEGGRFYIVGRRKEMFISGGENVYPVEVERALYDHPAVKEAAVVGVPDPRWGEVGAAFVVLREPLAAEALRAFLKARLAGYKVPKHLIFLEELPKTGPGKVQKEALKRLWEEQHGQA

SEQ ID NO: 26052 - protein, 421 aa, Thermus thermophilus HB27
MRFETLQLHAGYEPEPTTLSRQVPIYPTTSYVFKSPEHAANLFALKEFGNIYSRIMNPTVDVLEKRLAALEGGKAALATASGHAAQFLALTTLAQAGDNIVSTPNLYGGTFNQFKVTLKRLGIEVRFTSREERPEEFLALTDERTRAWWVESIGNPALNIPDLEALAQAAREKGVALIVDNTFGMGGYLLRPLAWGAALVTHSLTKWVGGHGAVIAGAIVDGGSFPWEGGRYPLLTEPQPGYHGLRLTEAFGELAFIVKARVDGLRDQGQALGPFEAWVVLLGMETLSLRAERHVENTLHLAHWLLEQPQVAWVNYPGLPHHPHHDRAQKYFKGKPGAVLTFGLKGGYEAAKRFISRLKLISHLANVGDTRTLAIHPASTTHSQLSPEEQAQAGVSPEMVRLSVGLEHVEDLKAELKEALA

SEQ ID NO: 26053 - protein, 338 aa, Thermus thermophilus HB27
MRPTGAPPWRWPSSPSPGRNPTPVKRGMKVFVTRTLPGKALDRLRERGLEVEVHRGLFLPKAELLKRVEGAVGLIPTVEDRIDAEVMDRAKGLKVIACYSVGVDHVDLEAARERGIRVTHTPGVLTEATADLTLALLLAVARRVVEGAAYARDGLWRAWHPELLLGLDLQGLTLGLVGMGRIGQAVAKRALAFGMRVVYHARTPKPLPYPFLSLEELLKEADVVSLHTPLTPETHRLLNRERLFAMKRGAILINTARGALVDTEALVEALRGHLFGAGLDVTDPEPLPQDHPLYRLPNAVITPHIGSAGRTTRERMAEVAVENLLAVLEGREPPNPVV

SEQ ID NO: 26054 - protein, 385 aa, Thermus thermophilus HB27
MLDFYALEDLLTPEEKEVQKAARRFLEKEALPHIRDWWEEGVFPTHLIPRFAELGFLGPTLPPEYGGAGVSSAAYGLICYELERVDSGLRSFVSVQSSLVMYPIYAYGSEEQKREFLPKLARGEMVGCFGLTEPDGGSDPYGNMKTRARREGDTWVLNGTKMWITNGNLAHLAVIWAKDEGGEVLGFLVPTDTPGFQAREVKRKMSLRASVTSELVLEEVRVPESLRLPKALGLKAPLSCLTQARFGIAWGAMGALEAVYEEAVAFAKSRQTFGEPLAKKQLVQAKLAEMLAWHTEGLLLAWRLARLKDEGKLTPAQVSLAKRQNVWKALQAARMARDILGGSGITLEYHAIRHMLNLETVYTYEGTHDVHTLVLGREITGLNAF

SEQ ID NO: 26055 - protein, 432 aa, Thermus thermophilus HB27
MKPSVRTPLPGPKAWALLERGERVLSPSYVRPYPFVPARGQGAFLEDVDGNLFLDFMSGIAVNTTGYAHPKVVEAVRAQAERFAHVCFSDFTHEPTLSLAERLVGKLGGGYRVFFGNSGTEGVEAAIKLVRYHTRRPYLLAFTGAFHGRSLGALSLTASKSAYRQGFAPFLPGVVHLPFPNPFRPPLGARPEEAGDAVLDHLEHLFQTVLPPEEVAALFLEPIQGEGGYVVPPPGFIPRLKEVLDRFGILLVADEVQTGAGRTGRFFALEHEGVQADVYVLAKGLASGYPISAVLFREELGSWPPGAHGTTFGGQAVAAAAAHATLDLLEGGLQENAARLGEFLLAELRALKRRFPFLGDVRGRGLMIGLDFGDPDHPQPDLRDKAVRLAFEKGLLLLPAGPSALRIAPPLVLTQEEAALGLEILEEVFRAL

SEQ ID NO: 26056 - protein, 390 aa, Thermus thermophilus HB27
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGKSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGRAIAALEGAFTVVGGGDSVAAVNRLGLKDRFGHVSTGGGASLEFLEKGTLPGLEVLEG

SEQ ID NO: 26057 - protein, 414 aa, Thermus thermophilus HB27
MDLDAFTLFERHINPGLAGLLRFTGLDRVESHAEGPYVWDTQGKRYLDFLGLYGTLNLGHRHPKVVEAVKRQLDRMPMSVRVLVSEPTARLAAKLAEITPEGLEMVFFGNSGAEAVEAAIKLARAYTGKPGIVTTQGGFHGKTMGALSLTPKPEYQDPARPLLPGVKVVPYGDLKALEAAIDEDTAAVIVEPIQGEGGIRVPPEGYLRGVRELTREKGVLMIADEVQTGLGRTGRLFGVDWEGVAPDLMTLAKALGGGVMPIGACVGRREVFEVFKNNPLFHSSTFGGNPLAAAAALAAIEVTLEEDLPGRALELGRHLMEGLKALKEEHPHLIEDVRGRGLMVGVEFTDADIGALVVAEMAERGVLTAFGLNNPKVVRLEPPLIIGKEHVDEALAVFAEALKATEKALEGLLG

SEQ ID NO: 26058 - protein, 499 aa, Thermus thermophilus HB27
MRSMWALLSVADKRGIVDFARGLAELGFRLLATGGTYRALREAGLPVTYISDFTGFPEILEGRVKTLHPKVHAALLARPDQEEELKALGLERIGVLAVNLYPFRETVARGASFAEALEQIDIGGPAMLRAAAKNHQAVLPVCDPEDYPRVLEALKAGPSPDFRQKLARKAFAHTALYDAAIAEWLSGEKFPEEKLLALRREASLRYGENPHQEAALYRVVGERGPLLEAQVLQGKAMSFNNYLDAEAAWNLVSEFAEPACVAVKHQNPCGVALGETPLEAYRKAYEADPVSIFGGIVAFNRPLDGPTAEALAEVFLEVVLAPSFSPEARAVLARKKNLRLLQVPFPAQGPYLDLRRLRGGVLLQDADTEDPAEPKVVTERAPTPEEWPDLRFAWKVVKHVRSNAIVVAKGGMTLGIGVGQTNRLAAARHALEAAGERAKGAVLASDAFFPFDDVVRLAASYGIAAIIQPGGSVRDQDSIRAAEEAGIAMVFTGVRHFRH

SEQ ID NO: 26059 - protein, 427 aa, Thermus thermophilus HB27
MEGMERPISEAYFQEAKRHIPGGVSSPVRAFKAVGGTPPFLVRGEGAYVWDADGNRYLDYVMSWGPLILGHAHPKVLARVRETLERGLTFGAPSPLEVALAKKVKRAYPFVDLVRFVNSGTEATMSALRLARGYTNRPYIVKFRGNYHGHADGLLVEAGSGALTLGVPSSAGVPEEYAKLTLVLEYNDPEGLREVLRRRGEEIAAIIFEPVVGNAGVLVPTEDFLKALHEAREFGVLLIADEVMTGFRLAFGGATELLGLKPDLVTLGKVLGGGLPAAAYAGRREIMEKVAPLGPVYQAGTLSGNPLAMAAGLATLELLEENPGYYRYLEDLGARLERGLKEVLAQKGIPHAVNRVGSMVTVFFTEGPVVTFQDAKRTDTELFKRFFHGLLDRGIYWPPSNFEAAFLSVAHTEEDVEKTLEALGEAL

SEQ ID NO: 26060 - protein, 250 aa, Thermus thermophilus HB27
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQEIRKALSERYGEAFASRVRILYGGSVNPKNFADLLSMPNVDGGLVGGASLELESFLALLRIAG

SEQ ID NO: 26061 - protein, 348 aa, Thermus thermophilus HB27
MAGIRVEKVSKRFGKVEALKGVDLEVRDQEFLVLLGPSGCGKTTLLRIVAGLEAPTSGEVYIGERRVTHLPPRLRGIAMVFQNYAIFPHLTVYENVAFGLRMKRRPEEEIRRKVGEVAALLHIEELLDRYPAQLSGGQRQRVAVARALAVEPEVLLMDEPLSNLDALLRLEMRAELKRLLKETRTTTLYVTHDQVEAMSLADRIAVMRQGEIVQLGTPTEIYHAPADTFVGGFIGNPPMNFLRAGALGGRVVLEGFAVPSPVEGEVLLGVRPEDLRVSKEQAEGAFRARVLVVEPLGPHLQLTLEREGETFRALADPDFSVAFGEEVWVRPNPGRVRLFHPKTGKALA

SEQ ID NO: 26062 - protein, 307 aa, Thermus thermophilus HB27
MVEKPAIALVGESLVDLVLEGESPLAFTGTLGGSVLNTATVLARLGYPVRFFSEVGEDWLSAWSEVEMARRGLNPKLQRHPGPMPLALVRLDPEGNARYSFHRPFQAPFLPESGALRGVGAFHFGSLFALEARTAKGVAALLEEAARAGALLSYDPNLRGLPSPEERARVEAYLGRVDLLKLSLEDARLLFPEAPLEAVRRLPPRLKVLTLGPEGALAFLGEGEVRVPGVRVRVVDTVGAGDTFTAGLLALLLRRGGGRGVLEGLDLEGLREALEAAVALSALACTVRGAGLPEEGLAAWRARWLAG

SEQ ID NO: 26063 - protein, 475 aa, Thermus thermophilus HB27
MEVKEAPTEALIGGAWRRLERRFPVVSPATGERVAEVADCGEEEAREALEEAVLAFPAWSRATAYERAQVLRRWYERILEHQEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYGEAAKTLKRVSLELGGGAPVLVFADADLDRAVEETLRAKFRNAGESCVAANRIFVQAEVAEAFAEAYARRVQALKVGDPLSEETDVGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSLGL

SEQ ID NO: 26064 - protein, 293 aa, Thermus thermophilus HB27
MRLVFGEKDAPYEEARVVVLPVPYDLSLSFLPGARRGPEAILLASRELEPFLLELGAAPEEVGIHAAEPVPWVAGMAEESHRLIREEALKHLRAGKWLVALGGDHSVTHPLVQAHREALGEFSLLHVDAHADLYPEWQGSVYSHASPFYRLLTEGFPLVQVGIRAMDRDSLRLARKRGVALFPAHRIHREGLPLDEILEALGKRVYISLDFDALDPSLMPSVGTPLPGGLSYRQVVDLLEAVFREKEVVGMDFVELSPNGQFHAEMTAAQLVYHAIGLKGLQAGWLSREVDHI

SEQ ID NO: 26065 - protein, 457 aa, Thermus thermophilus HB27
MTYDLLIVGSGSAGVAAALEASALGAKAAVVEAGVLGGTCVNVGCVPSKYLLRAADAFHRARHPAFPGLRTEALGVDWKALLAGKEGLIAALRKEKYQEVLEAAGVPVLRGRARFLDGERMEVEGREVLAGRYLLATGARPFLPPIPGLRESAPWTYLEALSAPALPESLLVVGGGPIGLELAQAFARLGSRVTVLEALPEVLPQEDRELARLLRGYLEEEGLRVHTGVRVEAVAREGAFRVRTDRGVFEAERLLVATGRRPDLEGLGLERAGVERDERGFLRLDPSLRTTNPRVYAAGDAAGLPQFVYVAAQSGRVAARNALGVKAPLDLAALPRVTFTDPALAAVGLTEEEARRRYGAGVRAATLPLSQVPKALTVRDARGAFKIVVDEEGTVLGLHVLAHEAGDVIQEGILAVKYGLGYRDLIDTFHPYLTLAEGIRLVAQALDADPKKLSCCA

SEQ ID NO: 26066 - protein, 412 aa, Thermus thermophilus HB27
MEYTTLAVLAGLPEDPHGAVGLPIYAVAAYGFKTLEEGQERFATGEGYVYARQKDPTAKALEERLKALEGALEAVVLASGQAATFAALLALLRPGDEVVAAKGLFGQTIGLFGQVLSLMGVTVRYVDPEPEAVREALSAKTRAVFVETVANPALLVPDLEALATLAEEAGVALVVDNTFGAAGALCRPLAWGAHVVVESLTKWASGHGSVLGGAVLSRETELWRNYPQFLQPDLKGQIPWEALRARCFPERVRTLGLSLCGMALSPFNAYLLFQGLETVALRVARMSETARFLAERLQGHPKVKALRYPGLPEDPAHRNARKYLASGGPILTLDLGDLERASRFLEAIRLLKAANLGDARTLLVHPWTTTHSRLKEEARLQAGVTPGLVRVSVGLEDPLDLLALFEEALEAV

SEQ ID NO: 26067 - protein, 244 aa, Thermus thermophilus HB27
MEPIIRIRNLHKWFGPLHVLKGIHLEVAPGEKLVIIGPSGSGKSTLIRTINRLEDFQEGEVVVDGLNVKDDRALREVRREVGMVFQQFNLFPHMTVLENVTLAPMRVRRWPREKAEKKALELLERVGILDQARKYPAQLSGGQQQRVAIARALAMEPKIMLFDEPTSALDPEMVGEVLDVMRDLAQGGMTMVVVTHEMGFAREVADRVVFMDGGQIVEEGRPEEIFTRPKEERTRSFLQRVLHH

SEQ ID NO: 26068 - protein, 367 aa, Thermus thermophilus HB27
MPPGAARPKLGVVAEVLVRLQGVRKRYGTTVALDGVDLEVHRGEFFSLLGPSGCGKTTLLRLLAGFETPDAGRIEIGGRDMARVPPYERPVNTVFQNYALFPHMTVEANIAFGLRMKGLPPEAIREKVAWALELVDLLGLEKRYPRELSGGQKQRVALARALVLEPQVLLLDEPLSALDARLRQDLRVELMQLQRRLGTTFIFVTHDQEEALVMSDRIAVMRSGRIEQVGLPDEVYERPKTRFVAAFLGRSNFLPARPHPLGAETPLGPLRLKAPLAREALLAIRPEKIRLYPAQGGVPARENLVRAVVEEIVYTGAENQYYLRAGEVRLLAYTLNQDLQEPGAEEFGYGEEVLCYLPPENLVVVHE

SEQ ID NO: 26069 - protein, 164 aa, Thermus thermophilus HB27
MEARTTDLSDLYPEGEALPMVFKSFGGRARFAGRVRTLRVFEDNALVRKVLEEEGAGQVLFVDGGGSLRTALLGGNLARLAWERGWAGVVVHGAVRDTEELRGVPIGLLALAATPKKSAKEGKGEVDVPLKVLGVEVLPGSFLLADEDGLLLLPEPPSGVRSGG

SEQ ID NO: 26070 - protein, 446 aa, Thermus thermophilus HB27
MGYTKAEILKALKGENVKFLRLQITDILGVVKNVEVPESQFEKALDGEIMFDGSSIEGFTRIEESDMLLRPDYNTFVILPDLVEDPKRGRVARLICDVYYPDGRPFEGDPRYVLKRQIERLKKLGFDNLYAGPEPEFFLFLRTPEGLPTTETHDRAGYFDLAPIDKGEEARRDMVNALVAMGFEIEAAHHEVAPGQHEIDFKYADALTTADNIATFKWVVKRIALNHGLHATFLPKPIRGINGSGMHTHLSLFKDGENAFYDPNAEYQLSQTALHFIAGLLEHAAGMVAVTNPLVNSYKRLTPGYEAPTNIAWSASNRSAMIRIPARRGVGTRAELRMPDPSCNPYLALAVMAAAGADGIERKLLPPPPIQRNIYQMTVRERRKHKIRELPGTLREALEALRKDPVIREALGEHVYTHFLQAKQMEWDDYRVTVHQWELDRYLATY

SEQ ID NO: 26071 - protein, 482 aa, Thermus thermophilus HB27
MRLFTPEAMREADRKAVERGYPSLLLMEWAGMKAARVYLELFGKAPALVLAGKGNNGGDGLVLARHLLLEGVGVRVYAAGGQTGDALLALQALLAHGVEVRPLEEASFREGEVMVDALFGTGLKGPLTDFYAELVERVNRAGLPVLALDLPSGLPFSPHVRATATVAFAALKTPHLLQREACGKLYLAEIGLPKPLLEREDLPEVASPEALRPLLPRRPLTAHKGSVGRVGVLGGYQGEGLRYAGAPLLAALGAYRMGAGLVHLVVPEGAPLEPLEAVFHPVPSPTLPPLKAEALAVGMGGGPWGRAWALKALEARLPTVLDADALHPEVAEAYRKAGVPAVLTPHAGEAGRLLGISPEEVAKDPLGAARALAERTGLAVVLKGNPTVVAEGERLSVNPTGNPALATGGTGDVLSGAIAALLAAGLSPFDAARLGVFLHGLAGDLLAEEKEVGLLAREVAEALPRARRLLQEGRVPPAFFPR

SEQ ID NO: 26072 - protein, 214 aa, Thermus thermophilus HB27
MDLSAVRFDEKGLVPVVVQDARTGEVLTLAYANREALEETLRTRRSTFFSRSRQALWRKGETSGHTQEVVEVLLDCDGDAVVYRVLPQGPACHTGERTCFHRALLEGEKDLGFVVGQVYATIKERLRTLPEGSYVARMHHAGLDRILKKIGEEAGEVILAAKNQNPEELRHEAADLLFHLLLTLAELGLTPEDLAKTLWERHRPRSPYDGSHGN

SEQ ID NO: 26073 - protein, 381 aa, Thermus thermophilus HB27
MMRNVLALLAVLWSLALAQQYRGLALGTAYPEIGVQPGESVSLTLTLKSYGLPPGVVRLSVPEVPAGWQAVLTGGGRLVRAVYLNPDQEASLTLRLQPPKEVKEGTYRFLVRAEGLGQTASLPITLMVGQGLPKRLSLEAELPVLKGPPTSSFRYRVTLRNESDQDLLVSLEYQAPQGFQVTFTPAFSSQQVTSLPVKAGESRDLDVEVSLPEDTPAGAYGVTLRAVAGDARADLALTLEVTGRPEVRLSTKEGRLSGSVTAGRENAVKLVVKNEGSAPAKNLSFSAFEPSGWEVKFEPERLEVLEPGKEAEVTARIKPSSKAVAGDYMVTLRVSGDEGVSESLDYRATVVTSTLWGLVGVALVAVAVLVLGFAVNRFGRR

SEQ ID NO: 26074 - protein, 280 aa, Thermus thermophilus HB27
MAAKKDYYAILGVPRNATQEEIKRAYKRLARQYHPDVNKSPEAEEKFKEINEAYAVLSDPEKRRIYDTYGTTEAPPPPPPGGYDFSGFDVEDFSEFFQELFGPGLFGGFGRRSRKGRDLRAELPLTLEEAFHGGERVVEVAGRRVSVRIPPGVREGSVIRVPGMGGQGNPPGDLLLVVRLLPHPVFRLEGQDLYATLDVPAPIAVVGGKVRAMTLEGPVEVTIPPRTQAGRKLRLRGKGFPGPAGRGDLYLEVRITIPERLTPEEEALWKKLAEAYYARA

SEQ ID NO: 26075 - protein, 300 aa, Thermus thermophilus HB27
MDVSATMPPMERVAVVGVPMDLGANRRGVDMGPSALRYARLLEQLEDLGYTVEDLGDVPVSLARASRRRGRGLAYLEEIRAAALVLKERLAALPEGVFPIVLGGDHSLSMGSVAGAARGRRVGVVWVDAHADFNTPETSPSGNVHGMPLAVLSGLGHPRLTEVFRAVDPKDVVLVGVRSLDPGEKRLLKEAGVRVYTMHEVDRLGVARIAEEVLKHLQGLPLHVSLDADVLDPTLAPGVGTPVPGGLTYREAHLLMEILAESGRVQSLDLVEVNPILDERNRTAEMLVGLALSLLGKRIF

SEQ ID NO: 26076 - protein, 350 aa, Thermus thermophilus HB27
MERAPLLELKGIRKRFGELAVLRGVDLALYPGEILALLGPSGCGKTTLLRVVAGLEVPDAGRVFLEGREITALPPEKRGIGFVFQDYALFPHLTALGNVAFGLKGKDRLARARKALERVGMTLFQDRRPGELSGGQQQRVALARALAPGPKLVLLDEPFSSLDAGLRAATREEVRKVLKETGTAALLVTHDQEEALSFADRLGVMRGGEILQVGTPEEVYLRPKTPFVAQFLGRTNLLPGEGRGRYAETCLGRVPLAEAREGPLLLSLRPEALRLTPPGQGPQGEVVAREFKGHDLTYRVRLHGVQPEREVLVQEGPTCPFKVGDRVGLEVVGEGVALEGTPPAPVRQEA

SEQ ID NO: 26077 - protein, 186 aa, Thermus thermophilus HB27
MDVGQAVIFLGPPGAGKGTQASRLAQELGFKKLSTGDILRDHVARGTPLGERVRPIMERGDLVPDDLILELIREELAERVIFDGFPRTLAQAEALDRLLSETGTRLLGVVLVEVPEEELVRRILRRAELEGRSDDNEETVRRRLEVYREKTEPLVGYYEARGVLKRVDGLGTPDEVYARIRAALGI

SEQ ID NO: 26078 - protein, 395 aa, Thermus thermophilus HB27
METRTLEDWRALLEAEKTLDSGVYNKHDLLIVRGQGARVWDAEGNEYIDCVGGYGVANLGHGNPEVVEAVKRQAETLMAMPQTLPTPMRGEFYRTLTAILPPELNRVFPVNSGTEANEAALKFARAHTGRKKFVAAMRGFSGRTMGSLSVTWEPKYREPFLPLVEPVEFIPYNDVEALKRAVDEETAAVILEPVQGEGGVRPATPEFLRAAREITQEKGALLILDEIQTGMGRTGKRFAFEHFGIVPDILTLAKALGGGVPLGVAVMREEVARSMPKGGHGTTFGGNPLAMAAGVAAIRYLERTRLWERAAELGPWFMEKLRAIPSPKIREVRGMGLMVGLELKEKAAPYIARLEKEHRVLALQAGPTVIRFLPPLVIEKEDLERVVEAVRAVLA

SEQ ID NO: 26079 - protein, 443 aa, Thermus thermophilus HB27
MGKRMVVVGGVAGGASAAAKAKRENPELEVVVYEKSGWVSYGACGLPYVLSGEIPRLERLVARTPEEFRKQGVLVHTRHEVVDVDYELRTLTVHDHAEGRTFQDRFDHLVLATGARPSLPPIPGTEQEGVYTLRTMEDGERLLKALPQARRAAILGAGYIGLEAAEAFRKRGLQVTLLEAKDRPLPHWDPEVGALLKEELERHGVEVWTGVKVEAFRGMGRVEAVETSEGVVPADLVLLATGIRPNTELAQAMGVALGPTGAIATDERMRTNLEGVYAAGDVAESFHRVLKRPYWLPLGDVANKHGRTAGSVIAGREARFLGVVGTAIFKAFDLAVATTGLSLEGALKEGFWAKKVFIQSRDGAHYYPGSGPLWVELVYEEGTGRLLGGAVVARGHGALRIDVLAALLHREGSVEDLLALDLAYAPPFSPVWDPLLIAAQQAR

SEQ ID NO: 26080 - protein, 422 aa, Thermus thermophilus HB27
MTTIVGVRAREVLDSRGFPTVEAEVELEGGARGRAMVPSGASTGTHEALELRDGGKRYLGKGVRRAVENVNERIAPELVGMDALDQEGVDRAMLELDGTPNKANLGANAVLAVSLAVARAAAEALGLPLYRYLGGVQGVTLPVPLMNVINGGKHADNRVDFQEFMLVPAGAGSFAEALRIGAEVFHTLKAVLKEKGYSTNVGDEGGFAPDLRSNEEAVELLLLAIERAGYTPGQEVSLALDPATSELYRDGKYHLEGEGKVLSSEEMVAFWEAWVEKYPIRSIEDGLAEDDWEGWRLLTERLGGKVQLVGDDLFVTNPERLRAGIERGVANAILVKVNQIGTLSETLEAIRLAQRSGYRAVISHRSGETEDSFIADLAVAVNAGQIKTGSLSRSDRLAKYNQLLRIEEELGRAARFLGYAAF

SEQ ID NO: 26081 - protein, 474 aa, Thermus thermophilus HB27
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMSRIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 26082 - protein, 304 aa, Thermus thermophilus HB27
MRVEGAIGKTPVVRLAKVVEPDMAEVWVKLEGLNPGGSIKDRPAWYMIKDAEERGILRPGSGQVIVEPTSGNTGIGLAMIAASRGYRLILTMPAQMSEERKRVLKAFGAELVLTDPERRMLAAREEALRLKEELGAFMPDQFKNPANVRAHYETTGPELYEALEGRIDAFVYGSGTGGTITGVGRYLKERIPHVKVIAVEPARSNVLSGGKMGPHQFQGMGPGFIPENLDLSLLDGVIQVWEEDAFPLARRLAREEGLFLGMSSGGIVWAALQVARELGPGKRVACISPDGGWKYLSTPLYAEP

SEQ ID NO: 26083 - protein, 376 aa, Thermus thermophilus HB27
MSRVPEPSVFLVVDEAKRKARERGVGLIDLSIGSTDLPPPEAPLKALAEALNDPTTYGYCLKSCTLPFLEEAARWYEGRYGVGLDPRREALALIGSQEGLAHLLLALTEPEDLLLLPEVAYPSYFGAARVASLRTFLIPLREDGLADLKAVPEGVWREAKVLLLNYPNNPTGAVADWGYFEEALGLARKHGLWLVHDNPYVDQVYEGEAPSPLALPGAKERVVELFSLSKSYNLAGFRLGFALGSEEALARLERVKGVIDFNQYAGILRMGVEALKTPKEVVRGYARVYRERALGMAEALKGALSLLPPRATMYLWGRLPEGVDDLEFGLRLVERGVALAPGRGFGPGGKGFVRIALVRPLEELLEAAKRIREALD

SEQ ID NO: 26084 - protein, 467 aa, Thermus thermophilus HB27
MRTRRGSFWRCSVYDLLVIGAGPGGYVAAIRAAQLGMKVGVVEKEKALGGTCLRVGCIPSKALLETTERIYEAKKGLLGAKVKGVELDLPALMAHKDKVVQANTQGVEFLFKKNGIARHQGTARFLSERKVLVEETGEELEARYILIATGSAPLIPPWAQVDYERVVTSTEALSFPEVPKRLIVVGGGVIGLELGVVWHRLGAEVIVLEYMDRILPTMDAEVSRAAERVFKKQGLTIRTGVRVTAVVPEAKGARVELEGGEVLEADRVLVAVGRRPYTEGLSLENAGLSTDERGRIPVDEHLRTRVPHIYAIGDVVRGPMLAHKASEEGIAAVEHMARGFGHVDYQAIPSVVYTHPEIAAVGYTEEELKAQGIPYKVGKFPYSASGRARAMGETEGFIKVLAHAKTDRILGVHGIGARVGDVLAEAALALFFKASAEDLGRAPHAHPSLSEILKEAALAAWERPIHL

SEQ ID NO: 26085 - protein, 480 aa, Thermus thermophilus HB27
MGQKKGPVAEGLPPGFPGGRRGRGKGLSPRESRTRRTSKGASKRAWARPQSSPPRGVWQGCKLHSMLRLDTRFLSGFPEALSRHGPLLEEARRRLLAKRGEPGSMLGWMDLPEDTETLREVRRYREANPWVEDFVLIGIGGSALGPKALEAAFNESGVRFHYLDHVEPEPTLRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVGGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 26086 - protein, 289 aa, Thermus thermophilus HB27
MEKVAFIGLGAMGYPMAGHLARRFPTLVWNRTFEKALRHQEEFGSEAVPLERVAEARVIFTCLPTTREVYEVAEALYPYLREGTYWVDATSGEPEASRRLAERLREKGVTYLDAPVSGGTSGAEAGTLTVMLGGPEEAVERVRPFLAYAKKVVHVGPVGAGHAVKAINNALLAVNLWAAGEGLLALVKQGVSAEKALEVINASSGRSNATENLIPQRVLTRAFPKTFALGLLVKDLGIAMGVLDGEKAPSPLLRLAREVYEMAKRELGPDADHVEALRLLERWGGVEIR

SEQ ID NO: 26087 - protein, 461 aa, Thermus thermophilus HB27
MKTYDLIVIGTGPGGYHAAIRAAQLGLKVLAVEASEVGGVCLNVGCIPTKALLHAAETLHHLKVAEGFGLKAKPELDLRKLGGWRDQVVKKLTGGVGTLLKGNGVELLRGFARLVGPKEVEVGGERYGAKSLILATGSEPLELKGFPFGEDVWDSTRALKVEEGLPKRLLVIGGGAVGLELGQVYRRLGAEVTLIEYMPEILPQGDPETAALLRRALEKEGIRVRTKTKAVGYEKKKDGLHVRLEPAEGGEGEEVVVDKVLVAVGRKPRTEGLGLEKAGVKVDERGFIRVNARMETSVPGVYAIGDAARPPLLAHKAMREGLIAAENAAGKDSAFDYQVPSVVYTSPEWAGVGLTEEEAKRAGYRVKVGKFPLAASGRALTLGGAEGMVKVVGDEETDLLLGVFIVGPQAGELIAEAALALEMGATLTDLALTIHPHPTLSESLMEAAEAFHKQAIHILNR

SEQ ID NO: 26088 - protein, 181 aa, Thermus thermophilus HB27
MKGMFTPGNGPVQISAEAIKKRVEELGREIARDYQGKTPHLICVLNGAFIFMADLVRAIPLPLTMDFIAISSYGNAFKSSGEVELLKDLRLPIHGRDVIVVEDIVDTGLTLSYLLDYLEARKPASVRVAALLSKPSRRQVEVPIHYLGFEIEDAYVYGYGLDRAQFDRNLPFITSIRPEEE

SEQ ID NO: 26089 - protein, 349 aa, Thermus thermophilus HB27
MGLLFTPLELRGLRLKNRLAMSPMCQYSATEGGEVTDWHLLHYPTRALGGVGLVIVEATAVLPEGRISPFDLGIWSEDHLPGLRELARRIREAGAVPGIQLAHAGRKAGTARPWEGGRPLGWKVVGPSPLPFAEGYPVPEALDEAGMARVLEAFVEGAKRALRAGFLVVELHMAHGYLLSSFLSPLANRREDAYGGSRENRMRFPLEVARAVREAIPPELLLFVRVSATDWAEGGWGLEDTLAFAERLKALGVDLLDLSSGGVVPGVRVPVAPGFQVPFADAVRKRVGMPTGAVGLLTTPEQAETVLQAGSADLVLLGRVLLRDPYFPLKAAKALGAEAPVPPQYQRAF

SEQ ID NO: 26090 - protein, 220 aa, Thermus thermophilus HB27
MGPVRFAPSILTADLARLGEAIREAEAAGVDWIHLDVMDGVFVPNLTFGPLLVEAVRRVTSLPLDVHLMIVKPERYLEDFAQAGADHITVHFEATYHPHRAVQKVKELGKKAGLAVNPGTPLEAFEPLLPDLDLALLMSVNPGFGGQRYLPTATERLRRLKAMRDRLNPACLIVVDGGINRDTVAEARRAGADVAVAGSALFNDKPVAENLKALRLALLG

SEQ ID NO: 26091 - protein, 1279 aa, Zea mays
MALSHNEKEVVLFNAFKNRLGTSQQTTMVFNLPALIQPIGNLSELEQPFSSREIDQIIACLPSNKSPGPDGFNIDFVKKYWPVIAPDFYDLFNKFFEGSLCMHSINGSYVTLIPKNGSPDSVGDYRPISLLNTSVKVLTKILANRLQLVITKLVHQNQYGFIKDRSIQDCLPWAFEYISLCHKSRKEMVILKLDFEKTFDKLEHAALLEILRHKGFGNKWIHWISMILGSGSSEVLLNGVPGKRFHCRRGVRQGDPLSPLLFVLAADLLQTIVNKACKGGILRLPLPNNCGPDFPIIQYVDDTILIMEACPRQLFFLKAMLNSFADSTGLHVNYHKSNIYPINVSDQKMEILANTFHCKIGSLSFTYLGLPLGIQRPKLGAFLPLIQKIEKRLASTSIFLSQAGRLEMVNAVFSSLPTYYMCTLKLPKMVIRHIDRLRRHCLWRELPPPGLILFGPITTVTLPSGKPVGSFWWRDVLKTLEPFKSIARVEIEDGKTTLLWHDNWDGIPKSTQYLELWSFSACKDITVLQARLVDSQELFHAPLSTEAFVQLQELNDCLDNLPHNNYKDKWCCSTPSGLFSSQKIYAHLMGNQWTHPIFSWLWKSKCQPKHKVFFWLLLKDRLNTRAFLRQRSMFLDSYSCDNCILQVEETTIHLFFRCNFAKRCWSLIGISPSHSADLLNTILRIRRRWQVPWKLEAIILLTWGIWKCRNNWVFNETPPTVEGCTDRLYLSYISAGKLSSDPFTSLMGSSSGHQRSKTRSRNRKPLGIQLLERVRGSPISFRSCQALVLVLTFLSYASYHATRKTTSVVKSVLDPKTKTNLGTSSAHYWPPSHLFYLHNLKDADNSSAGGSLSSGGGGGWVPFNEAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLVAAAMLRYGWCWSFVVPGVVIALVGLAVFLLLPVAPDVIGVQEDLCLKDAPLLERRRADVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 26092 - protein, 434 aa, Magnetospirillum magnetotacticum MS-1
MSHILRKFPNDPAKPRVVKAEGLYIHTEDGRKLLDMTAGTTTFGVLGYSHPEVLAAMQAQMGKFCHIDYNTWVDPNLEELAALLLSRAPRGLDKVYFPGNSGSEAMEAAMKLSYHVHHDSGKPGKTHYIARLQSFHGATLHGISISELPILAFYEPLLPDGRSKIAQHNPSLNRLPGESMEDYARRSAKELEDKILEIGPDKVGAFIGETMLGSLVGDVPPAPGYWKLIREVCDRYDVHLILDEIYCGLGRSGRIYCCDWDGIVPDFVCIGKNLAAGHAPLSAVVTNHRVEDIIAKGQGRIQHGHTHQGYSLGVAAALAVQRIVHTDAMLDHIQARGRQIVDTITTRLGGHPFFKEVRGRGLLQSFEYDCADKNGFGMTLAKRMLDEHATVINAKWHRVSFTPGYIITEAQLGRVLDDFVAVFESTASGWKTAG

SEQ ID NO: 26093 - protein, 453 aa, Magnetospirillum magnetotacticum MS-1
MTIAKAADAAPKGGRQFPKDFFWGASTAAYQIEGAYDTDGRGMTIWDKFTADGKIMDGSSAKVACDHYHRYPEDIALMKAAGFNAYRFSLAWPRIIPAGTGAINPKGLDFYDRLVDKILEAGIKPMACLYHWDLPQPLEDKGGWQGRDIVGPFAEYARIATKRLGDRVKDWYMLNEPNVVAIIGYGIGEHAPGYKLGEDGILKALHHQNLAQGTALRAIRAEHSDAVLGTVINLQPCRSEDDDPKNRAAAIRWDAVWNRVPLDGVMRGAIPDVLAEKMKHIVKPGDLETIKFPIDMLGINYYSRMTMKHEEGHPFDVFWGDAHCDRWTAMAWPVQPDGLYDLLREFKELYGNPAVFIAENGAAYDDVVAPDGQVHDAERVAFLKDHVSEVARAVKDGCNVKGYLAWSLLDNFEWAYGLSKRFGLVRVDYDTLKRTPKDSYKWFAEVIKSGRVD

SEQ ID NO: 26094 - protein, 277 aa, Magnetospirillum magnetotacticum MS-1
MEKRRIGPFNATALTLGCMNLSHAYGTPPGREAAEALLRRALEAGVDFFDTAALYGFGSNESLVGAVLKPHRQHITLASKCGMTGVDGKKVIDGRPETILRTCEESLTRLGTDVIDLYYLHRRDFQVPIEESVGALARLVEQGKVRTIGLSEVSAATLRRAHAEHPITAVQSEYSLWTRNPEIGVLDACRELGAAFVAFSPLARGFLTGNLTDPATQLEPKDIRCQMPRFEPENYARISLLDDYSHRLALHPRHWAWPVLPGDTFALFGPILPDDAG

SEQ ID NO: 26095 - protein, 386 aa, Magnetospirillum magnetotacticum MS-1
MVMPTYARSDLAFERGEGAYLFTMDGRRFLDFASGVAVNALGHCHPRLVKALAGQAAKVWHTSNLYRVPGQESVAAKLVGQSFADTVFFCNSGAEALECCIKMARRYHFAAGNPQRTRIICAEGAFHGRTLATVAAGGQKKHLEGFAPAVDGFDHVPFGNLNALRAAITEESAAILVEPVQGEGGIVPGDPDYLRRLRATADEFGLLLIFDEVQTGMGRTGTLFAHEQAGIAPDIMGLAKGLGGGFPVGACLATAKAASGMVPGTHGSTFGGNPLAMAVADEVMTIMAEPGFLDHVRAVAQKLRTGVEEAASRFPDVIEEVRGLGLMLGFKPRMPNTDMVARLAANGLLSVGAGDNMVRLLPPLIINDAQVDEAVGILARTFGEVK

SEQ ID NO: 26096 - protein, 508 aa, Magnetospirillum magnetotacticum MS-1
MSANLFELFRSRFPADRSRTFIEVPGGVTISYADLEAMSARYAHALVEAGVKPGDRVAVQVDKSAEAVVLYLACLRSGSVLLPLNTAYQAGELEYFLSDAAPAAVVCQPHRLAELEGLAAKAGITTCVMTLGASGDGTLPERAKGKAESFATVPRGGDDMGAILYSSGTTGRPKGAMMSHTNLGSNSQTLHRLWGFKPDDVLLHCLPIFHTHGLFVAINCVLLNGSAMIFCPKFDAEQAIGLLKRATVFMGVPTFYTRFLTSPNLTPQACSHMRLFISGSAPLLEETFNAFKDRTGFTILERYGMTEGGMFTSNPLDGDRRAGTVGFPLPDVELRITGEDGRILPQGEVGIIEVKGPNIFKGYWNMPEKTKSDFTPDGFFKSGDVGVIDERGYVSIVGRAKDLIISGGFNVYPKEVEDFIDRLPGVVESAVVGMPHPDFGEAGLAIVVAEKGAAVTPDGVIDALKGLLANFKVPKQAVVVSELPRNAMGKVQKNVLRDSYAEMWKANL

SEQ ID NO: 26097 - protein, 269 aa, Magnetospirillum magnetotacticum MS-1
MSRLEQRFAKLKAENRAALVTFITAGDPDRATSQALLDGMPAAGADIIELGMPFTDPMADGPVIELAAGRALKAGGSLKQTLEMVEVFRKTDSETPIILMGYYNPVYAWGAEKFSADAARAGVDGLIIVDLPPEEADELVPHLRRSGIDFIVLTTPTSDDARLPVVLSNASGFVYYVSIAGITGTASAAQSAIDDAVARIRRHTDLPVCVGFGIKAPAQAAQVARVADGAVVGSAIVSVLADNIGKPSAVSAPLALAKDLAEGVRGARK

SEQ ID NO: 26098 - protein, 443 aa, Magnetospirillum magnetotacticum MS-1
MGLKTACIEKRGSLGGTCLNVGCIPSKALLAASHHYHAASHDLGAFGIKVSKVEIDVAGMMGHKDKVVSDNTKGIEFLFKKNKVTYIIGAGAITAPGQIEVTAKDGAKSTVAAKHIVIATGSEVTPLPGVEIDEEVIISSTGALALPKTPKHIVVIGGGVIGLELGTVWGRLGAKVTVVEFLDRILPFNDGEVSKTMQRLLAKQGMEFKLGTKVTAITRKGKTATITVEPAAGGAAEKIEADCVLVAIGRRPFTEGLGLDKVGVAIDKRGFVTIDGHFRTNVPGIYAIGDVVGGAMLAHKAEEEGVALAEILAGQHGHVNYEAIPAVVYTWPEVASVGKTEEQLKAEGIAYKAGKFPFTANGRARSMNEVDGFVKILACATTDKVLGAHIVGPNAGDLIAEVVLAMEFGAASEDIARTCHAHPGLGEAVKEACLAVDGRPLHT

SEQ ID NO: 26099 - protein, 464 aa, Magnetospirillum magnetotacticum MS-1
MSGPIPVILSGGAGTRLWPLSRELMPKQLLKLTGERTLLQETALRLGAPPVVVCNFEHRFIVAEQLREEGIEPRAVVIEPVGRNTAPAAAVAALMLAESDPDALMLLMPSDHLIADTGAFRRAVDIAVPLARQGCMVTFGITPTGPNTGYGYIKRGAALDGGFMVERFVEKPDLATAESYVASGKYTWNSGIFLLPVGLFLAELDRFAPGIKTGSAEALAKGQRDLFFFRLDETTFAAIEGRSIDYAVMEPSDKVAVVPVDMGWSDIGSWSALWQESPRNADGNVILGDVLAVDSTDCYLRSQDHLVATVGVSNLVVIATDDAVLVADKSRDQEVKAVVEALKREGRPEATQGTRGWRPWGWYKTIEQGERFKVKQIHVDPGAKLSLQKHWHRSEHWVVVKGTALVTCGDTSFVLRENESTFIPAGTNHRLENPGKVPLRLIEVQSGEYVGEDDIVRVEDDYGR

SEQ ID NO: 26100 - protein, 432 aa, Magnetospirillum magnetotacticum MS-1
MLERLFHLSGHRTSLRTEALAGATTFLTMAYIIFVNPAMLAETGMDKGAVFVATCLAAALGSIAMGLLANYPIALAPGMGLNAYFTYGVVIGMGVPWPVALGAVFVSGVLFLILALTKVREAIINAVPQSLKLAISAGIGLFLGLIAFENAGLIEGHKATLITLGHLNRPEPLLAVCGFMVMVGLEARKVPGAIMIGILGTAAAGMALGVTPFGGIAAWPPSLAPTFLKMDVAGALNLGLVTIVFALLFVDLFDNAGTLIGLAHRAGMLDERGRLPRLGRALIADSLAAMAGGILGTSTTTSYIESASGINAGGRSGLAAVVTGLFFVAALFLAPLAAAIPAYATAPALLFVACLMARSLADIAWDDITEAVPALVTALAMPFTFSIAHGISFGFITYAAVKLLGGKARDVGPAVWLLAGAFVLKFVLLGSV

SEQ ID NO: 26101 - protein, 386 aa, Magnetospirillum magnetotacticum MS-1
MDRAPQNGVVILGSGLGGYTLARELRKLDAQVSITIVTADGGESYSKPMLSAAFAQGKDALSLMQKSPGQMAEDLKATILARHRVAAIRRDAKTVVIRRPDGDEMELGYGRLVLALGADPRPYVAEGSETAGLRTVNDLDDYAAWRAALSPGARVLLVGAGLIGSEFANDLAGAGFCVAVVDPAPWPLGRLLPQALGEEMAKALGEAGISFHLGRSVTRWSMGRAELDDGSAIAYDQALSAIGLIPRTRLASEAGLVVERGIKVDGSLATSDPAIFAMGDCAETPAGLLPFILPLMAEAKALAATLAGCETPLKLPALPVVVKTPALPMVVCPPAPGAVGDWVMEGAGRDRKALFVSPQGKALGFALSGARVNERQSLAKEMPDLL

SEQ ID NO: 26102 - protein, 451 aa, Magnetospirillum magnetotacticum MS-1
MPDYDYDLITLGAGSGGVRACRMAAAAGRKVAVVESSRVGGTCVMRGCVPKKLLVYGARFAEDLADSLGFGWSLEGADFDWARLVAAKNVELQRLEGVYMRLLKEPGVTVVEGKGHLLDAHTVQVGLQVLSAETILVATGGRPSLPDVPGIEHAVTSDQALDLMQLPERVVIVGGGYIAVEFAGIFNALGVGVTLVLRGDTLLRGFDADIRATLAEEMGKKGVELRTTTQVRAIERRGHGYCVLLSDGDSLEADLVMYATGRVPNTEGLGLEKAGVVLNSKGAVMVDALSRTSVRNIWAVGDVTDRVNLTPVAINEAMAFVRTAFLGQSTAMDYDNIPSAVFSLPPVGTVGLTEAEASKRYGAIDVYLSRFKLMRNILAGREERTMMKLVVDRASDRVLGVHMVGSDAPEIVQGFAVALKCGATKAQFDATVGIHPTAAEELVTMRDKRAD

SEQ ID NO: 26103 - protein, 411 aa, Magnetospirillum magnetotacticum MS-1
MMPEAKYLLVGSSHAALEALRAIRLVDPDGSMAMLTRDERLPYSPTILPYVVSGRSGSDKVLLRDPAFFAANNCAYVPNARAVSLDPKAKAVTLESGEVWRYQSLLVASGAAPAIPPVKGLDGVKYHVLRSLADAEGLRAAMGSAKSAVVLGAGLVGLHAAENLAEAGLAVTVVEMQDHVLPGYFDAKASTRIEEAFAKHGVDLKLGHRVTEASAGKLTLSDGTTIAADLLLVATGVRPVTDWLEGSGVLVDKGVVVDEAMRTNLDGVWAAGDVAQATDFATGGKALIGIIPTAVEQGKIAGQGMAGDSYRKDYAGGLPVNTYRFFGRVALSIGRAAATEGVEAVESEAGAYRRVVMEGNRLVGYASVDEPFDVGIMGELIRRRIDLTECKDAFLAHPVETGRRLMSEQWR

SEQ ID NO: 26104 - protein, 411 aa, Magnetospirillum magnetotacticum MS-1
MNSQHDFHRIKRLPPYVFAEVNAMKARARAAGEDIIDFGMGNPDQPTPTHIVDKLVEAARNPRAHRYSMSRGIPGLRKALSAYYQRRFAVDIDPEAECIVTLGSKEGLANLANAITSPGDIVLVPNPSYPIHPYGFIIAGGSCRFVPVTPDAEFLKALDRAVRHSVPKPIALVLNYPSNPTALLADLDFYGQVVEFCRHHGIWILSDLAYSEIYFDVAPPPSILQIPGAKDIAVEFTSMSKTYNMPGWRIGFAAGNKTLINALARIKSYLDYGAFTPIQVAATAALNGPQDCVDEIRALYKSRRDALIEGLAAAGWDIPSPPATMFAWAPIPKPFAHLGSLEFSKLLMREAQVAVAPGIGFGEYGDSHVRIGLVENVQRTRQAVRNIKTFLGSTGQVLEASEKQRAAGTEP

SEQ ID NO: 26105 - protein, 270 aa, Magnetospirillum magnetotacticum MS-1
MLMIMVKTVLGLGGVYLLLVGFVALMQRDMIYHPGKTRTRPDEAGLPEMVPVPIKSADGWIATSWYAAPRSPGRPTVVFFHGNSGTLADRAHKARAFLDAGMGVLLVEYRGYGGNAGRPSERGLYADAEAAMRWLIGQGVSSRRLVLYGESLGSGIAMEMAIRYEVMMVVLESPFTSLADLAPAYVLPPLAQLLTWDRYDNLIKAPSLRVPLLVVHGGKDTLVPVIMGHAVLNAADTIKEGLFLPEAGHNDLWEHGASKKILDFIARRAL

SEQ ID NO: 26106 - protein, 286 aa, Magnetospirillum magnetotacticum MS-1
MITQAALPLALAFIMFAMGLTLDAGDFRRVFAAPKAMVVGLAAKLVVLPVLALALVLVWRPEPDFAVGMILLAACPAGVTSALLTHHAGGRIALAATITALTSLAATLTVPLLVNLGLGLFAGYDRSVEIPVAKMTLGIFLVDTVPLALGLGLQRLRPRVAERLGRVARPVATLLFALIVVGAFVSQRQSLMDHVGDVVPAALLLNLAAMTGAWVLGTLARLDWADRIAVVMENGLQNGALGIFVAVTLLGSPAMMVPSIVYAFVMNLTAIAFIVAVRRRRRVVTG

SEQ ID NO: 26107 - protein, 485 aa, Magnetospirillum magnetotacticum MS-1
MIKHLINGKHVESASTIANLNPATNEVICQIAAGGEAEVARAVAAAKEAFPKWAGLAPAQRAKLLRKVGDLINQHVDEIAKLESLDTGQSYWRTKKMLVPRAADNFYFFADTCQHVDGETYPTNDHLNYTIYQPVGVVGLISPWNVPFMTATWKTAPCLAFGNTAVLKMSELSPLSADRLGQLILEAGIPAGVFNIVHGYGSAVGEALVKHPDVRGVSFTGSTATGNRIIQSGGLKKYSMELGGKSPNIVFDDCDFERAVDAAIVAVYGNNGESCTNGTRILVQDGIYDRFVAALAERTKKVVVGDPLDEATNVGPMITRDHWKKVTGYIELGIKEGARVVAGGLGEPEGLPAHLKNGNFVKPTVLADVDNSWRVAQEEIFGPVACVIRFKDEAEALKIANATTYGLASYVWTENGAKAIRMAEGIEAGLVFVNSQNVRDLRQPFGGIKGSGTGREGGHYSYEAFLEVKNVCVSKGNHHIPRWGV

SEQ ID NO: 26108 - protein, 251 aa, Magnetospirillum magnetotacticum MS-1
MTNRRKLIAGNWKMNGLKADGLALAKGLADKLASASPNCDMLVCPPFTLIAPVADALAGSKLAVGGQDCHAKTSGAHTGDTSPAMLADLGCKYAIVGHSERRTDHAETDNVVKAKAAAALSAGLVAIVCIGETLAQRDAGQTIEVNRSQLNGSLPEGANAANTVIAYEPVWAIGTGRVATPAQAQEVHAAIRAELVKLVGAAEAGKMRILYGGSMKPDNAKELLALPDVDGGLIGGAALKVADFWAIAESC

SEQ ID NO: 26109 - protein, 474 aa, Magnetospirillum magnetotacticum MS-1
MYRADALALAAGIAGARLMEAAGWAVARAARRLLPKGRIAILCGPGNNGGDGFVAARLLARDGWSVRVALLGAVERLKGDAAIMAGRWTGRVEPLTPDALHGCVGVIDALFGAGLARPLEGAAKAVVEEIGRLRLPVIAVDVPSGVHGDSGAVLGLAPDCLATVTFFRPKPGHCLLPGRLKCGELVVADIGIPAAVLDEIAPDLCRNGPGVWALPEIKAEGHKYSRGHVLILGGAEMTGAARLAARAARRVGAGLVSIAAPPEALGVYRAGDPGVLVASSEPFADLLEDGRRNALLLGPGGGVGEALAGKVLAALGTGRPCVLDADALSSFEGRSADLFRHLSDRVVLTPHDGEFRRLFGEMPGSRLERARHAARLSGAIVLLKGADTVVAHPKGGATITTDAPPWLATAGSGDVLAGLLAGLLAQGMEPFEAACAAVWLHGRAAAEFGPGLIAEDLSEAIPAILAERRWDPHD

SEQ ID NO: 26110 - protein, 454 aa, Magnetospirillum magnetotacticum MS-1
MIRTLWEAGADVFRLNFSHGSHDDHLERFKEIRRLEAELGRPIAILADLQGPKLRLGVFKAGKVVLKPGQTFRLDLSPEPGDTTRAPLPHPEILSALTPGSELLLDDGKVRLRVEACGSDFAETVVVVAGPLSDRKGVNVPDAVIPLSALTEKDRHDLAFALELGIDWIALSFVQRPEDVEEARALIGERARILSKLEKPSAIDRLDEIVALSDAVMVARGDLGVELPPEDVPGLQKRIIRSCRAAGKPVVVATQMLESMIEAPTPTRAEASDVATAVFAGADAVMLSAESASGRYPVEAVTMMSRIISRAESDPNYLDGLGSGCAKPEANDADAISAAVCQVTGIVSVAAIVAYTTSGFTTLRIARERPASPILSLTPNAATARHVALAWGVHSVHTEDAANVEDMVAKASGIATREGFTEDGKPLVIIAGMPFGTAGSTNLLRIVRVPRTSL

SEQ ID NO: 26111 - protein, 347 aa, Magnetospirillum magnetotacticum MS-1
MIEVENISKRFGNFAALDQVSLRVAQGKLVALLGPSGSGKTTLLRILAGLEQPDDGRVRLGGVDATGLGTRDRRVGFVFQHYALFRHMSVADNIAFGLRVRKGADRPSKAAITEKVHTLLELVQLEGLAGRYPSQLSGGQRQRVALARALAVEPRLLLLDEPFGALDAQVRKDLRRWLRHLHDEMGLTGVFVTHDQEEALEVADEVVVMNKGRIEQIGTPSEIYDSPATPFVYRFLGNVNALPCRVAGGHAQLGGLHVGESRADGPGTAFVRPHDVEVLELSPDAPQARIRQVMVLGPVVRAELELPDGTILEAEVSRDIKDKLGLRRGLEVSVFLRKARVFVGENV

SEQ ID NO: 26112 - protein, 452 aa, Magnetospirillum magnetotacticum MS-1
MADNTTSTALLDLRGVRKTFLTPDRRERTVLEGVDFKLEEGEIVALLGKSGSGKSTLLRIMAGLIKANGGEVKYRGHLMTGPAKGISMVFQSFALFPWLTVEENVELGLEAAGIPKAEREDRANEAIDLIGLGGYESAYPKELSGGMRQRVGFARALVMRPDVLLLDEPFSALDVLTSETLREDLLELWDERKIPTKGILLVSHNIEEAVSMADRVLVFSSDPGRVRAEIRVNLPRPRDTESAAFRQIVDEVYTLMTANVRGGGVGATEQLTLGYRLPDTTPGKMAGLLETVAEAPFNGRADLPQLAEETELEDDQLFHLFEGLRVLGLARIAAGDIFVTHSGQAFVEADDAHRKELFAEALVKNIPLAAHIRRVLDERKDHRAPEDRFLQELQDYLTDDEAERVLETTITWGRYAEIFDYDYNAGVLMLPEEVVEELEAGEETRDDPGARE

SEQ ID NO: 26113 - protein, 394 aa, Magnetospirillum magnetotacticum MS-1
MTVTSANPETIVLHAGYRADPATGAVAVPIYQTTSYQFRDTEHAANLFALKELGNIYTRLMNPTTDVLEQRLAALEGGVAALAVASGQAASTFAILNLAQAGDNFVTSTDLYGGTWNLFANTFKQLGIEARFVDPADPEAFVRATDDKTRAWYAETLPNPKLQVFPIAEVAKLAEKIGVPLIVDNTASPVIAKPLSLGAHIVVYSTTKYIGGHGTSIGGAIVDGGTFDWEKHAKRFPLLNEPDPSYHGAVWTQAVKPLGPIAYIIRARVTLLRDIGAAISPFNAFQALQGLETLPLRIREHSRNATAVAEFLAGHHKVAHVIHPSLQDGEYRRRADAVLKGGYGGLLGFELKGGADAGRRFIDALKLFYHVANIGDARSLAIHPAMHHALPVVG

SEQ ID NO: 26114 - protein, 313 aa, Magnetospirillum magnetotacticum MS-1
MEGGAQTLLFASGMAAATAVFQALEPGDHVLIPEVMYWALRGWLHGFATRWGLRVEAVDTSDLDEVRRALRPGLTRLIWVESPANPLWVISDIAALAQLAHEAGARLAVDSTIATPVLTRPLELGADLVMHSATKYLNGHSDVVAGTLTTKVKDDPWARIKAVQTQIGGVLGPFEAWLLQRGLRTLFARVRWQCTSALDLAQRLSAHPNVAEVLYPGLPGFAGHETASRQMKGGFGGMLSIRVKGGREAAIATAAATQVWTRATSLGGVESLIEHRASMEGADSPVPDDLLRLSVGLEAVDDLYNDLSQALGL

SEQ ID NO: 26115 - protein, 448 aa, Magnetospirillum magnetotacticum MS-1
MGAGKKRISLRPDFVWGVSTSAFQVEGATKEDGRGPSIWDTRCRLAGGVWTGANADVACDHYHRWPEDVRLIKDLGVDAYRFSIAWPRLLPKGKGAVNQKGLDFYDRLIDGVLEAGITPWVCLYHWDLPQALDDLGGWTNRDCAGWFADYAVLAAKRYGDRVKHFATFNEFSVFTMFGYAIDWAAPGVTDRAAHMKAIHHVNLAHGMGVDVLRDHVPGVSIGAIHNRQIVRPEGGLAENQAAADLLDAHWNGVFCDPQHLGHYPEIMARDVEPYVQAGDLARICRPTDWMGLNHYGPIYAKADPATTWGYGWGAPPESANHPEVGWPIFPEVFKDELLTLTRRYGLPIYVTENGCGGGAGSDTPDENGEVKDTHRLAYFREYQQAMLDAVAEGADLRGYFVWALLDNFEWGSGYGPRFGLYHVDFETQKRTLKNSGKWYRDMIKGHRT

SEQ ID NO: 26116 - protein, 132 aa, Magnetospirillum magnetotacticum MS-1
MSAIDAAAVLAKLKFNADGLVPAIAQQHDTGEVLMMAWMNKESVAETLETGRVCYFSRSRGGLWRKGESSGQQQRLKDFLIDCDGDTILLKVDQDGVACHTGRRTCFYTAARPEGLTEVAKVLVSPEELYKK

SEQ ID NO: 26117 - protein, 415 aa, Magnetospirillum magnetotacticum MS-1
MFILLGAVMVLAMHSGFAFLEVGTVRKKNQVNALVKIISDFAVSTIAYFFVGYGVAYGTNFLVGADVLIGKTGNAFAASGYDLVKFFFLATFAAAIPAIVSGGIAERAKFTTQLMATAILVGLVYPLFEGMVWGTRFGFQELMKGWFGAAFHDFAGSVVVHAVGGWIGLGAVLMLGTRLGRYRKDGRLVAFPPSNIPFLALGAWILSVGWFGFNVMSAQVIADISGLVAMNSLMAMVGGILTSLVVGRNDPGFIHNGALAGLVAVCAGSDVMHPIGALVTGGIAGALFVWLFNLCQIKWKIDDVLGVWALHGMCGFLGGVACGVFGQEALGGLGGVSFGGQIAGTVIGAAFGLAGGLAVYGGLKAAFGIRLSDEEEFAGADLSIHQIGAYPEDATTVHDDGLAMSVHSANKRKAG

SEQ ID NO: 26118 - protein, 189 aa, Magnetospirillum magnetotacticum MS-1
MSDLSPIRRALFSVSDKTGLVEFGRFLAGKGVEILSTGGTCKALRDAGIKVTEVADHTGFPEMLDGRVKTLHPKVHGGLLGIRGNAEHEKAMAEHGIAPIDLLVVNLYPFESTVAKGAEYDDCVENIDIGGPAMIRAASKNHAAVAVVVDVEDYAVVQAEMEANNGATTLGGALRKAFGRHGLCPHRRL

SEQ ID NO: 26119 - protein, 351 aa, Magnetospirillum magnetotacticum MS-1
MAATAYARTGAYDAAISQWFARELGDTFPRRVVVAGELKQSLRYGENPHQAAAFYVTGHQRPGVSSARQLQGKELSYNNLNDTDAAYELVAEFDEPAVAIIKHANPCGVAVGKDIVSAYKAALATDPVSAFGGIVAINRKLDGATAEEIAKLFTEVVIAPEADDAAVAAFAAKKNLRLLVTGGMPDPSEAGMTLRPVAGGYLFQTKDNGRIMLPDLKVVTKRAPTEQELKDLLLAFRICKHVKSNAIIYVKDGATVGIGAGQMSRVDSSRIAAWKSQEAATAAGLAQPGTIGSVVASDAFFPFADGLLAAAAAGATAVIQPGGSMRDAEVIAAADEKGLAMVFTGMRHFRH

SEQ ID NO: 26120 - protein, 291 aa, Magnetospirillum magnetotacticum MS-1
MSSYYEASARERIVGLLDGGSFREILPPGERILSPHLLQLDTPAAFDDGIVVGEGALGGRKVLIAAQEGGFMGGAVGEVHGAKLVGLLERALDQRPAGVLLLVESGGVRLHEANAGLIGVSEIMRAVLKLRGAGIPVIVLDGGQFGCFGGMGIVSRLCDAVIISEEGRLGLSGPEVIETTCGVEEFDSRDRALVWRTVGGKHRYLLGEAAHLVADDIAAFRAQAIAALDLRPDLSLEALEREHAVLGQRLDRFGTCRDGIDIWRNLGIDQPERLPLLEAEAFIAITAGKRA

SEQ ID NO: 26121 - protein, 307 aa, Magnetospirillum magnetotacticum MS-1
MLFGIPDEHYLATSEEFLALEHLPHRIVLVGGGYIAAEFSRIAARAGAQVTVLQRGERMLQRFDPDLVGWLMEAFDGMGVHVRTRTAVTAIQRAGDIFRVEAYSDAGQETFEADLVVHAAGRRPALDKLDLAAAKVAVEERRLKLNDFLQSVTNPAVYAAGDAALVGPPLTPVSSHDAKVVAANLLEGNHAKPNYAGVPSVAFTSPPIAAVGMSEVEARESGLRVSIKSERTSGWFTARREAERVYGYKTVVKEGSGRILGAHLVGPHVDEVINIFALSIRHGLTADDLKSTIFAYPTGASDIGSML

SEQ ID NO: 26122 - protein, 330 aa, Magnetospirillum magnetotacticum MS-1
MAKIQQTFVCQSCGAVYNRWRGRCEACNGWNTIQEEVASAGPQSGPASTRASRARGRVFPLEGLTGEAKEAPRTASGIDELDRVTGGGFVRGSVILLGGDPGIGKSTLLMQASAAMAKRGERVAYISGEEAVGQVRLRAERLGLAKHPVELAAQTNVEDIVETLSQGHPPALTIIDSIQTMWTETVESAPGTVTQVRSSAQALIRFAKTTGTAVILVGHVTKDGQIAGPRVVEHMVDAVASFEGDQGHHFRILRAVKNRFGPTDEIGVFEMTDAGLSEVPNPSALFLAGRDHAAPGTAVFAGMEGTRPLLVEIQALVAPSSLGMPRRAVV

SEQ ID NO: 26123 - protein, 483 aa, Magnetospirillum magnetotacticum MS-1
MRDLACDVAVIGAGTAGIAAHRAALSAGAKAVLIEQGPGGTTCARVGCMPSKLLITAAEAAEDARAAHRLGIHVGAVRVDGPAVLARMRHWRDRFVGSVFEGLEQLPDESRLTGRAVFEGPDCLRVDDHTRLRFKAAVLATGSSPSVPEPLRDLGERVLTTDTVFDIEDLPASLAVLGAGPVGLELAQAMARLGVRTSVFDPGDSLGSLSEPDLKAAAREIFSQAFDLHLGAKVEHAAPDGDGARLGWNGEGGAGEGRFTRVLAAAGRPPNVRGLGLERTGVSLDETGSPSYDSRSLLCEGAPILIAGDANADRPVLHEASRQGRIAGRNAARLAAGEGPERPERWVALAMVFSQPQIAVIGGGFSPGSGRIVGRADFCDQGRAQVMDRAQGRHPPLCRAGRAAHRSRTGRPGGGASRPSSGLCRPGRARRTAFPRPSLLSSDPGGGARHGPVRSRGSAGLKRSVSGWRQPRSDADPTSDART

SEQ ID NO: 26124 - protein, 347 aa, Magnetospirillum magnetotacticum MS-1
MPTEVDVATRLTRTIRLNLPIIASAMDTVTEAPMAIAMAQNGGLGVIHRNLEPAEQAEQVRLVKKYESGMVLNPITIHPDETLADAFEVMKSNRISGIPVVERGPNGSRGKLVGILTNRDVRFATNTGQPVAELMTRDRLITVREGVTQDEAKRLLHQFRIEKLLVVDDHYRCIGLITVKDIEKQVAYPHAVKDEQGRLRVAAATTTGDSGFERAERLIDAGCDVIVVDTAHGHSRKVLDSVARVKQLSNAVQVIAGNIATAEGARALIDAGADAIKVGIGPGSICTTRIVAGVGVPQLTALMEAVEAAHEADVPVIADGGIKFSGELGEAIAAGASVGMLGSLSPD

SEQ ID NO: 26125 - protein, 298 aa, Magnetospirillum magnetotacticum MS-1
MTRPETRSETSPEIGDGGLAFAFRHCEELAREGDPDRYFAALFAPAAFRPHLFALIAFSLTIARVREAASNPMAGEIRLQWWRDALQGEARGDVRANPVAAALDDAIVTRRLGRQPFVDLIDARVFDLYDDPMPRVNDLEGYCGETASSLIRLSALVLADGAEPGGAAAAGHAGVAYGITGLLRALPWHARQGQVYLPGDLLRQNGVTREDIVSGRGGPGLIRTCAELRALARRHLASCEAARATIAPAARPAFLPLTLVEPYLAAMERPGYDPLNSQIEIPRWRRLWRLWRGARASA

SEQ ID NO: 26126 - protein, 277 aa, Magnetospirillum magnetotacticum MS-1
MAHTVPGARPPSPEVDAIIRVRDLVVGFGHRTVMKGLDLDIRRGEILGFVGPSGQGKSVLTRTILGLVPKRSGTIEIFGEDVDGLTLARRRQLEQRWGVLFQQGALFSGLTVKQNIQMPMREHLKLSERLLDEFARLKIEMVGLKPDAADKYPSELSGGMIKRAALARSLALDPEILFLDEPTSGLDPIGAGEFDDLVSTLKKTLGLTVFMVTHDLDSLYTACDRIAALGDGRIIAEGTIDEMLASDHPWLRSYFHGKRARAIATPAAAAAPNYAHA

SEQ ID NO: 26127 - protein, 327 aa, Magnetospirillum magnetotacticum MS-1
MPSLFDPITLGALTLPNRILMAPLTRGRATRTHVPTPMMAEYYAQRASAGLIISEATGISQEGLGWPYAPGIWSDEQVEAWKPVVKAVHDAGGRIVSQLWHMGYLVHSDFLGGEPPVAPSVATAPDQAHTYEGKKPYSQARALREDEIPRLIADYERAARNALAAGFDGVQIHAANGYLLDEFIRDGSNKRSDRYGGSVENRVRLVTKVAQAVAGVVGPERTGIRFSPNGPIQGVDDSNPHETFGLAAEMMERVGLAFIELREPGPNGTFGKATVAPVAPVIKERFGGPVILNCDYDGERAKAAVASGEADAIAFGRPYIANPDLPE

SEQ ID NO: 26128 - protein, 219 aa, Magnetospirillum magnetotacticum MS-1
MGVAGIAEAGLFEAATVAMGTFGTVPLAAHAITLQIAATCFMVPNGIGQAATVRVGRAFGAADQAGLRRAGAVALWLGFGFMVACALVQTLAPHALIGLFLDAEAPGAADVFPVAAGFLIFSALFAISDGVQSVALGALRGLQDTRVPMVIALIGYWGIGVPLGAVLAWGAGMGGRGIWAGFCAGLLAVSVSLVLRWRRLSAAPPRVASAQAEAGRNRA

SEQ ID NO: 26129 - protein, 305 aa, Magnetospirillum magnetotacticum MS-1
MSHTLPETMRQIRFQGAGGPEVIAVETVPLPKPGAGQVLVEVVAAGVNRPDIMQRQGSYPPPKGATEIPGLEIAGRIAALGEGVTGFSVGDEVCALVISGGYAEFAVAEIGQVLRKPESLSLVEAAGLPETVFTVYSTVIQRGRLQKGETFLVHGGSSGIGTTAIQIAKQHGARVLTTAGSAEKCRFCEELGADAAINYREADFAEEVKRLTDGKGVDVILDMVGAAYLSRNIASLAVEGRLVQIAFMQGYKAESLTLTPIMLKRLTITGATLRAQAKEAKAAIAEGLKRDVWPLVEAGKIRPIV

SEQ ID NO: 26130 - protein, 421 aa, Magnetospirillum magnetotacticum MS-1
MKRSRRTKIVATLGPASDTPEMIEKLFHAGVDVFRINMSHLAREKLPERIEVIRTIEREAKRPIGILVDLQGPKLRLGTFLGDAAHIENGQTFVLDSDPTPGNANRVYLPHPEILTALEPDHAVLIDDGKLRLVVTEVSEGRAVTRVEVGGRISNRKGVSLPHTVLPLPAMTDKDRGDLEAGLAAGADWIAVSFVQRPEDVAEVKKVAAGRAQVMAKIEKPQALSRLDEIIEISDGIMVARGDLGVEMPLEQVPGVQKRITRGARRLGKPVVVATQMLESMITSPVPTRAEVSDVATAVYEGADAVMLSAESAAGEFPVEAIATMNRIAEQVERDALYWSILMAQRSEPEPTASDAIAAAAHQIVDALGLRAIMAWTHSGSTVLRLARARPNASVIALTPKRETARRITMAWGVHPITQST

SEQ ID NO: 26131 - protein, 408 aa, Magnetospirillum magnetotacticum MS-1
MLGAAFLAVTGGEAMYADLGHFGARAIRVAWFALVLPALAIHYFGQGAILLVDPSAAENPFYRLAPAFAHYPLIALATLAAVIASQAVISGVFSLTQQAIQLGFLPPLHIVHTAPDERGQIYVPTVNWLLAAATLSAVLIFRSSDALAGAYGIAVSLLMAITTLLAGLVARKWGYGLIPVLAVNGFFLLIDLIFLSANSVKLFEGGWFPLLLAGAVAFLMLTWRKGNACLEEARIALRQPEARFLEGLRDTPPTTLPGSAAFLSSALEGIPLPMMRFVERLGALHARVLIVTALFEETPTVPPDKRARVTEITPDIRRVVLRYGFMQSASIPEGLACAVQAGLLPAAFTEDLTVFVGHETIIPVSDRRGMSDWREAVFAVMQNNAERTGAHFCVPTRQVIEIGTEIEI

SEQ ID NO: 26132 - protein, 136 aa, Magnetospirillum magnetotacticum MS-1
MTDQPTLPTASGSFGEKPTLTFPETDAPSGLQVVVLTEGDGPAVTSGRNIVVHYLGQTWGGHVFDNSYDRGDTIAFPIGVGAVIGGWDKGLVGQNVGSRVLLSIPPEHGYGQRGVPQAGIGGTDTLVFVVDVVDVQ

SEQ ID NO: 26133 - protein, 342 aa, Magnetospirillum magnetotacticum MS-1
  misc_feature (45)..(45): Xaa can be any naturally occurring amino acid
  misc_feature (52)..(53): Xaa can be any naturally occurring amino acid
  misc_feature (57)..(57): Xaa can be any naturally occurring amino acid
  misc_feature (60)..(60): Xaa can be any naturally occurring amino acid
  misc_feature (62)..(62): Xaa can be any naturally occurring amino acid
  misc_feature (68)..(68): Xaa can be any naturally occurring amino acid
  misc_feature (70)..(70): Xaa can be any naturally occurring amino acid
MVVVFAVINLWGVRQFGELEFWFAFVKVAAIVGFLVVGVLLVLGXAAPGRSXXSARXEPXLXGPRGGXSXPEGWGGIAAGLLVVVFAFGGIEIVTIAAAEAREPRTAVARATRSIVWRILVFYLGSVAIMVLVLPWDSPLLAESPFVAVLDLAGLPGAARVMEVVVVVALLSAFNANVYGTSRMAYSLAGRGDGPRALRRVSRRDVPWVSVLVSVFFALVAVGLNWLLPEALLGILLNAVGAALLVVWVLVAVSQLRLRRRIEAQARASGEPMTLRMWGFPWLTWAVLVGLAALAVLMLTDAAARAQLVSTAGLVVVILAVYLVTRRGRARRGAAAGARADG

SEQ ID NO: 26134 - protein, 209 aa, Magnetospirillum magnetotacticum MS-1
MGDLIQAERDQLSRNEHIKEASGYLRGKLAEALLMPASGAVSDDDGQLVKFHGMYLQDDRDLRPERMRKKLDRAYAFMIRLRIPGGVLTSKQWLVLDEIARSYANGSLRATTRQTFQYHGVIKSNLKRTMKAIDGALLDTIAACGDVNRNVLSASNPYQSKAHAAAYDLAKAISDHLLPRTGAWREIWLDGEKVVGGEDETVEPIYGKT

SEQ ID NO: 26135 - protein, 288 aa, Magnetospirillum magnetotacticum MS-1
MANVAFLGLGVMGSPMAGHLAKKGHDVTVYNRTRAKADAWVAAHGGRAASTPREAAAGREIVFACVGNDDDLRSVVLGEEGAFAGMEKGSVFVDHTTASAEVARELAAAADAAGLRFIDAPVSGGQAGAENGVLTVMCGGEEATYMRVEPVVMAYAKSCRLLGPSGSGQLTKMVNQIAIAGVVQGLSEAIHFAKRAGLDVEAVLDVISKGAAGSWQMENRGRTMNAEKFDFGFAVEWMRKDLGILLAESRRNGARLPVTALVDQFYAEVEAMGGKRWDTSSLIARLER

SEQ ID NO: 26136 - protein, 412 aa, Magnetospirillum magnetotacticum MS-1
MDAPSGIGVDDGTVPGPVLRADRTVTFGAAKPGLLLPPATHLAGHGAVVDIGLRLGAPVPDAPVPDAPGLGAPGPGVAGPDAPAPDRGKTTPVVRRLEPADVAALWSVPGATDHKYTRGVVGVVAGTPTFPGAAVLVTTAAVRTGPGMVRYGGPDDATRAVLAARPEVVHAAGRVQSWVLGPGVPAVPGPGDDPVDDGGQHERVRTALAAATATAATATAATATDATTTDATTTTTGATTTGATPERVPAVVDAGALSLLPERCPPSVVLTPHAGELARLLRARGDDVARTDVEAEPLRWARRAHEATGATVLLKGSATVVVGPEGAWSQADAPAWLATAGAGDVLAGILGTLLAAHAERVVREPGLAARLAAAAAVVHGLAAERANPGGPVAALDVADAVPGVVAELLAAR

SEQ ID NO: 26137 - protein, 437 aa, Magnetospirillum magnetotacticum MS-1
GHRCPSHQIRLDDLVPVGLGGALAHPHSTNHFAEFTGRVCPAPCEEACTLNLENQPVAIKTIEQAIADRAWNMGWVKPEPSATRTGKRVAVIGSGPAGMAAAQQLARVGHDVHVYEREPKAGGLLRYGIPDFKMEKRHIDRRVKQMEAEGVVFHYKSHVGVNVPLEELTSQFDAVLFCGGAEEPRNPQLPGQELDGVHYAMPYLVQSNRRVGAEPMPGNGELPILAAGKNVVVIGGGDTASDCVGTAFRQGALSVTQLDIRPRPPEREDKLTVWPYWPTKMRTSSSQAEGAEREFQAATLRLEGNSKGRLTGVVCARVDEKRQPIEGSEFVLPADLVFMAIGFAGSVRKGLLDESGVAVGQAQQRRRRRSDLPDLQSEDLRRRECAGAVLVVWAIREGVRAARDREGLMARPCAGSPVYRTSGAIAKGMGFCGPRGG

SEQ ID NO: 26138 - protein, 222 aa, Magnetospirillum magnetotacticum MS-1
MAALIAPSILSADFANLERDLNAIATADYAHVDVMDNHFVPNLTLGLPVFERLAQVSPVPIDAHLMIEDPDRWAPAYAEAGAASVTFHAEAAAAPVRLARELRRLGARAGVALRPATPVEPFLDLLTEVDMILVMTVEPGFGGQSFIEGTLPKIRRAREAVSESGLDVWIQVDGGVSRSTIERAADAGANVFVAGSAVYGAENVPEEIQALRELAEASAHAH

SEQ ID NO: 26139 - protein, 239 aa, Magnetospirillum magnetotacticum MS-1
MVPYKGGKANEGHSCVKGRFAYGYATHKDRITKPMIREKITDPWREVSWEEAINHAASEFKRIQAKYGKDSVGGITSSRCTNEEAYLVQKLVRAAFGNNNVDTCARVCHSPTGYGLMSTLGTSAGTQDFKSVEESDVILVIGANPTDGHPVFGSRMKKRLREGARLIVADPRKIDLVKSPHIKADHHLPLKPGPTSLITLRPRIVTRADCEDNSGKRELANLVWAGMPKRNSKRETTGN

SEQ ID NO: 26140 - protein, 362 aa, Magnetospirillum magnetotacticum MS-1
MSDCCSTPRGNNGSGPYDLVVVGAGSAGFSAAITAAEQGAQVALIGHGTLGGSCVNVGCVPSKALIRAAETVHHANTAGGRFAGIQAQARVTDWRAQVAQKDALVQGLRQAKYADLLPAYNNVSYHEGRARLVAGGVEAGGRHFAANRILIATGTRPAMPNIPGLADASPLDSTAALALTELPRSMIVLGGGYIGAELAQTFARVGVAVTLVCRSRLLPAAEPEIGEALAGYLAGEGIAVLGGLSYEAVDRTEGGVSLTFWRDGRRETVTAERILAATGRTANTEDLGLADAGVAQTPTGAIVVDDRMRTSKPGIYAAGDVTGNDQFVYIGGYGAKMVAKNASTGTAVLEHRANRRGVPTLG

SEQ ID NO: 26141 - protein, 282 aa, Magnetospirillum magnetotacticum MS-1
MAPQTRRLNCAARFAAGLFAYLPVGFPTLERSVETALALVDSGVDVLELGIPYTDPVMDGPVIQAAAQAALDGGARVADVFRVVAAVAERTGGRVPVLVMTYWNPVLRYGVDAFARDLAAAGGAGLITADLVPDEGRAWLDAAEAHGLDRVFLVAPSSTPERLRLTARASRGFVYAASTMGVTGVRAAVGPQAARLVADTRAAGAELVCVGLGVSTAEQAAEVARYADGVIVGSAFVRPLLGDAPWDERLAALRTVAASLAAGVRSARQEQPGTTTPGGVVA

SEQ ID NO: 26142 - protein, 305 aa, Magnetospirillum magnetotacticum MS-1
  misc_feature (3)..(3): Xaa can be any naturally occurring amino acid
  misc_feature (22)..(22): Xaa can be any naturally occurring amino acid
MAXISPAGSTCTGPPRRERALXEPARPAPVPRRVLYVTGEESAGQVRLRAERVGALAPGLLLAAETDLATVLGHIEATEPDLLVVDSVQTIASAQVEGAPGGVSQVREVAASLIAAAKARDLPVILVGHVTKDGSVAGPRTLEHLVDVVCQFEGDRHSRLRLVRAVKNRYGPTDEVGCFDLTENGIVGLADPSGLFLSHTGAGVPGTCVTVTLEGRRPLALEIQSLVVPSSLTNPRRTTSGVDSSRLAMILAVMHRHAGVRLVDQDVYASTVGGAQGDRCQSARPLDRALRPVRSESTRPSRRHR

SEQ ID NO: 26143 - protein, 414 aa, Magnetospirillum magnetotacticum MS-1
MLGINQPPVTIKNVEVSIIDEAFERGYVTPQVPQRLTGFTVAVVGSGPAGLAAAQQLTRAGHTVAVYERDDAVGGLLRYGIPDFKLEKHHIDRRVAQMEAEGTRFRPGVEIGVDITWDDLRARYDAVVVATGATVPRDLSVPGRELDGIHFAMDFLHQANAVVAGHEVPDQITATGKHVIVIGGGDTGSDCLGTSLRQGAASVTTLAIGKQPPLERSATQPWPTDPIVFEVSSSHEEGGEREFLASTVAFLGDENGAVRALRVAETEYLPDGRRVPKEGTEREIPADLVLVAMGFTGPETAALTTQTGADLTGRGLVARGDDFASSLPGVFVAGDAGRGQSLIVWAIAEGRAAAASVDAYLQGRDRAARARAREHRVLARLTCTPTSDVRRRDDERGILGRGTPRRPAPGRSED

SEQ ID NO: 26144 - protein, 371 aa, Magnetospirillum magnetotacticum MS-1
MLLPETSVPSPIDSKEASVAATTLHELIQTGADAAPALSSPGGVPLTFQALRALTERTITDLNARGIGRGDRVAIVLPNGPEMAAAFIAVAAGTTSAPLNPSYKADEFEFYMSDLGAKLLLVADGSESPAVGVADKLGVPVARLRPTPEEGAGSFTLHFADDGAAPAEKGGPANSEEIALVLHTSGTTSRPKIVPLTQGNVCASARNIRTALAFTAEDRGLNIMPLFHIHGLIAGILAPLSVGGQVSCTPGFNALKFFSWMEEVHPTWYTGVPTMHQAILGRAARNKEIIAKNPLRFIRSSSSSLPPQVMKELEETFGAPVIEAYGMTEAAHQMASNPLPPRPHYAGSVGLPPAPRSRCRSRREPLPGPSV

SEQ ID NO: 26145 - protein, 334 aa, Magnetospirillum magnetotacticum MS-1
MGKRRLPSSASRRPWPRGGSGGIVIAQVERIVDGGYVLPKDVRVPGILVDCVVVAEPEMHRMNDGVMYDAALAGEIRVPVTGIKRMALDERKIIARRAAFELPPNGVVDLGVGAPEGISSVANEEKITPYISLTTEAGAVGGVLASGSSFGAATNADCIIDQNQMFDFYDGGGLDMTCLGMAECDRAGNVNTSKFGGKLNGCGGFINISQNARSVVFAGTFTAGGLEIAVQDGQVKIVTEGRARKFVTEVQQNTFSGPYAVERSQPVIYVTERCVFQLTKEGLELIEVAPGIDIERDILAHMDFAPIVRNPVPMDPRIFRDEPMELLSDLLNLD

SEQ ID NO: 26146 - protein, 269 aa, Magnetospirillum magnetotacticum MS-1
VRALGIARSSTSSRTTSRPSTSGSARPRGGPGSPERERFWFHPGRGEDGSQVPTHWVSEFQGGTWTRTTNPDGTPGEWYLHVFAPEQPDLNWDHPDVRREHEDILRFWFDRGAAGIRIDSAAQLVKDPALPEVPDHPGPGEHPHVDRDELHDIYRGWRAVADAYDEPRVLVGEVWLADRERFARYLRPDEMHTAFNFDFMARPWDAKALRESVQTTLDAHAPVAAPATWVLSNHDVTRPVTRYGREDSSFAFATKRFGTPTTCERRVGR

SEQ ID NO: 26147 - protein, 238 aa, Magnetospirillum magnetotacticum MS-1
MFYVPTSTIARDSSVVMPTFAGPEIGVASTKAFSCQLTVLLCLALAAGRARGTLDAARERAVVDALITAPGLMAEAVKMEHAVETLAREIAKARDVLYLGRGTSYPMALEGALKLKEISYIHAEGYAAGELKHGPIALIDESVPVIVIAPHDAIFEKTVSNMQEVAARGGRIILVGDAKGAANAGLETMATLTMPDVDPVVAPIVYAVPIQLIAYHTAVFMGKDVDQPRNLAKSVTVE

SEQ ID NO: 26148 - protein, 226 aa, Magnetospirillum magnetotacticum MS-1
ASVRTNYWGYSTLGFFAPHAAYATRAAQDAGPAAVLDEVRGMVHLLHEAGIEVLLDVVHNHTCEGGADGYHLSWRGLDNAGYYLHDGGTPARLADVTGTGNSLDYRRPAVVRAALDSLRYWAEVVGVDGFRFDLAVTLGRGATGFDPDHPFLVALQTDPVLCGLKLVAEPWDVGPGGWRTGQFPPPLAEWNDRFRDAARQFWLADAREASHGRPGHGVRDLATRLA

SEQ ID NO: 26149 - protein, 169 aa, Magnetospirillum magnetotacticum MS-1
MVMTSQPVPPPIDPTSTPSWTALTVHRDTVEPDLRTWFAADPDRARRLTHQAADLTVDLSKNLVTDETLELLVRLAEEVHLDDRLEAMFTGEHINVTEDRAVLHTALRRPTPLGDDEHLVVDGQDVDADVHAELAKVYAFADKVRSGEWTGVTGERVRTVVTSASRSTS

SEQ ID NO: 26150 - protein, 266 aa, Magnetospirillum magnetotacticum MS-1
  misc_feature (186)..(186): Xaa can be any naturally occurring amino acid
MSSDDALSWTNWARTASATPRRRASPRDEAELGGLVARAAAEGMPVRAVGAGHSFTPAAVTDGLLLDLDRLNLVERIARGGADGTDGDAILVTVGAGIRLHRLNEALAAAGLAMRNLGDIDRQSVAGAISTGTHGTGARLGGLATQVRGVRVVGADGEVREASPGHEPGLFEVSRLGLGVTGHLCXAVTLEVVPAFLLRAQEEPWPLDRVLERLGTPDDPDGLVGGNDHFEFYWFPHTRRALTKRNNRLAPEREGRRAGTPAHHRR

SEQ ID NO: 26151 - protein, 194 aa, Magnetospirillum magnetotacticum MS-1
MRCHAPKAEASVAELVHPASYVESLVAASPVEGWFQIDSDTLMSPGTLDTCLHAVGGSVHAVDAVMKGECANAFVAMRPPGHHAEVARAMGFCLFNHAAIAVQHARKAFGASRVALVDWDVHHGNGSQDIFWAERDVLYASTHQMPLFPGTGAVGRARRPRHHRQRAAQGLRRWRGVSRGVRAADPAAARCLRP

SEQ ID NO: 26152 - protein, 193 aa, Magnetospirillum magnetotacticum MS-1
MKNSVLFDSVGLGPYTLRNRIVLPPLTRSRSSQPGNIPNDLMAAYYRQRTGAGFMVTEGTQIEPRGQGYAWTPGIHSPEQIAGWRKVTDTVHAEGGIIFLQLWHVGRVSHTSLQPGGAAPVAPSAIAANAVKVFIETGPGEGALAEPSIPRALTTAEVQGAGAALCAGGTQCARSRFRWRRDPLRERYLVNQF

SEQ ID NO: 26153 - protein, 250 aa, Magnetospirillum magnetotacticum MS-1
MAVPPSNEVDIFAHDLGFIAILDKKNKVTGWNVTVGGGMGMTHGETDTFPRTADVMGFCKPEDALKVAEAVMTVQRDWGNRKNRKNARLKYTIERFGLDAFRAEVEKRIGKTLAEPKPFTFDGNGDRYGWVEGEDGRHHLTLYVPSGRIKDIEGGPQFLSGLRRIAEVHEGDFRLTGNQNVIIANVPAGKRDQIEALVDEYGLTKGASALRRSSLACVALPTCGLALAESERYLPDLLTELEESLARHGL

SEQ ID NO: 26154 - protein, 153 aa, Magnetospirillum magnetotacticum MS-1
MAIIKHANPCGVAEGSSLLDAYERALACDPTSAFGGIVALNRTLDAEAARKIVEIFTEVIIAPDASDEAKAIIAAKKNLRLLLAGGLPDPRAKGEVIRTVAGGFLVQGRDAASVDEMTLNVVTKRAPSEAELADMRFAYRVAKHVKSNAIVYA

SEQ ID NO: 26155 - protein, 292 aa, Magnetospirillum magnetotacticum MS-1
MLDVIAGMRAVLRAYGERVLIGEIYLPIERLVTYYGPDLTGADLPFNFQLIQTPWRADAVAALVEEYEAALPEGGWPNWVLGNHDQPRIAARVGEAQARVAAMLLLTLRGTPTLYYGDEIGLGHVPVPPERAQDPWERNEPGHGRDPARTPMQWDAGPHAGFTVGTPWLPQSADADRRNVDEMRDDSRSILTLYRRLLSLRRDWRALSVGGYRGLPLPPSLAEAVFAYERFSDGETLRILLNFGNTDCRVPLDGQETWTVLLSTRPGRSGEPVQGEIILAPDEGTILAPALR

SEQ ID NO: 26156 - protein, 110 aa, Magnetospirillum magnetotacticum MS-1
  misc_feature (90)..(90): Xaa can be any naturally occurring amino acid
MTDFRTLDDAGPLAGKRVLLRVDLNVPMEGGRVTDATRIERVVPTIREIADQGGRVILLAHFGRPKGKPDPKDSLKPILPTLSEKLGRPXSPSVRIGRRRRAPPPPPSRR

SEQ ID NO: 26157 - protein, 246 aa, Magnetospirillum magnetotacticum MS-1
MDHDTLRRTTAEFFGTFWLTFGGCGAAVLSAAFPELGIGFLGVAFAFGFTVLTMAYAVGHISGGHFNPAVTLGLWSARRCANRHVLPYIVAQVIGAIVAAFALYTIASGKAGWVPNGFASNGYGALSPGKYGLAACLLTEVLTTFIFLFIIVGTTSKGAATGFAGIPIGLALVLIHLISIPVTNTSVNPARSTGPALFAGGEYVAQLWMFWLAPIVGAIAAGAMARWLYEPADVVDTTIVERRAEV

SEQ ID NO: 26158 - protein, 272 aa, Magnetospirillum magnetotacticum MS-1
MTRTRTFRRDQRAPRAHLAWTELAAVGAIEDTDESRQAAVAQHFVAVSTALDKVAAFGIDPANAFGFWDWVGGRYSVDSAIGTSLAIAIGPDRFAELLAGFHAIDEHVRRTPFERNVPVLMGLLNVWYVNFLDAHTHAVLPYAQYLHRFPAYLQQLTMESNGKRVRWDGSPVTTETGEIFWGEPGTNGQHAFYQLIHQGTRLIPADFIAVANPAHPLVDAVGDGGAVQPGADVHGLFLANFFAQTKALAFGKTADESGPRAPRKPRGGSSRV

SEQ ID NO: 26159 - protein, 274 aa, Magnetospirillum magnetotacticum MS-1
LVARKVKGGLLIGLVATTVVAIVAESVLHLGPASETNPGGWHLTVPAMPSSLVSVPDLSLFGQLSFGAFDRIGALAATMLVFTLFFTNFFDAMGTMTGLAKQGGLADADGNFPRIKSALVVEGVGAVVGGATSSSSNTVFVDSAAGVGEGARTGLASVVTGGLFLVAMFLTPLTAVVPIEVASAVLVVVGAMMMGQIKEIDLTDFTVTLPVFLTIVTMPLTYSIANGIGIGFVTWVLLRTACGRARDVHPLLWVVAAGFVVYFVRGPLTAAVGG

SEQ ID NO: 26160 - protein, 220 aa, Magnetospirillum magnetotacticum MS-1
MLFTHPVCLQHDTGDYHPECADRIKAVLAALESEEFMMLLRDEAPHATMEQLMRAHPLSHIDYVLDSVPTSDSHHHLDPDTILSRYSGEAALRSAGAGIAAVDAVAKGEVRNCFCAVRPPGHHAERDNAMGFCFFSNAAIAALHARDAHGYKRVAVVDIDVHHGNGTQHILWDEPGMLYASNHQEHAFPYTGLMAENGGEGFMVNVPLSAGTNSTITAWL

SEQ ID NO: 26161 - protein, 362 aa, Pichia angusta
MKVVLVLYDAGKHAQDEERLYGCTENALGIRDWLEKQGHDVVVTSDKEGQNSVLEKNISDADVIISTPFHPAYITKERIDKAKKLKLLVVAGVGSDHIDLDYINQSGRDISVLEVTGSNVVSVAEHVVMTMLVLVRNFVPAHEQIISGGWNVAEIAKDSFDIEGKVIATIGAGRIGYRVLERLVAFNPKELLYYDYQSLSKEAEEKVGARRVHDIKELVAQADIVTINCPLHAGSKGLVNAELLKHFKKGAWLVNTARGAICVAEDVAAAVKSGQLRGYGGDVWFPQPAPKDHPWRSMANKYGAGNAMTPHYSGSVIDAQVRYAQGTKNILESFFTQKFDYRPQDIILLNGKYKTKSYGADK

SEQ ID NO: 26162 - protein, 380 aa, Pichia methanolica
MSTAGKTITCKAAVAWEAGKDLSIETIEVAPPKAHEVRVKIAYTGVCHTDAFTLSGKDAEGEFPVIFGHEGAGIVESIGEGVTSVKVGDHVVCLYTPECKECKFCKSGKTNLCGKIRATQGKGLMPDGTSRFTCKGKKLLHYMGCSTFSQYTVLADISVVAVDPKAPMDRTCLLGCGITTGYGAATNTAKISPGDNIAIFGAGCIGLSVIQGAVERKAGKIIVVDINDDKKEWADKFGATDFVNPTKLPAGVTIVDKLVEMTDGGCDFTFDCTGNVGVMRNALEACHKGWGESIVIGVAPAGAEISTRPFQLVTGRVWKGCAFGGVKGRSQMPGLVQDYLQGKIKVDEFITHRHPLEDINDAFHDMHAGDCIRAVITMDE

SEQ ID NO: 26163 - protein, 480 aa, Azospirillum brasilense
MTNASQNSRIHPVILSGGAGVRLWPMSREQYPKQFLPLCSERSMLQDTAGRVSDAARFADPLIVCNQEHRFVIAEQMRQTGRGTARIVLEPVGRNTAPAAAVAALIVAEQDPDGQILLLPADHAIQDQDAFLQAVATAAAAAASGHLATFGIVPTAPETGYGYIRRGGAVEGHGGAFRVAAFVEKPPREQAERYLAEKDFFWNSGMFLLPVRQYLAELERWAPAVLEACRTALARGRSDLDFFRLDEEAFAASPNISIDYAVMERTEAAAVVPCSIGWTDVGAWSALWEIGVKDQGGNVCHGDAVAWDSRGCYVRSEDGALVALLGMEDTVVVATEDAILVAAKDRAQDIKPLVEHLKTQGRSEPLLHRRVHRPWGFYQSLHAGDRFQVKRLTVSPGARLSLQKHYHRAEHWVVVNGTALVTRGDEQILLRENESVYIPLGTPHRLENPGKVPLNLIEVQSGSYLGEDDIVRFDDHYGRS

SEQ ID NO: 26164 - protein, 475 aa, Toxicodendron vernicifluum
MSPQTETKASVGFKAGVKDYKLTYYTPDYITKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRVPTAYTKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMLKRAVFARELGVPIVMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26165 - protein, 475 aa, Toxicodendron trichocarpum
MSPQTETKASVGFKAGVKDYKLTYYTPDYITKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRVPTAYTKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMLKRAVFARELGVPIVMHDYLTGGFTANTTLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26166 - protein, 475 aa, Toxicodendron succedaneum
MSPQTETKASVGFKAGVKDYKLTYYTPDYITKDTDILAAFRVTPQPGVPPEEAGAAVAAESSTGTWTTVWTDGLTNLDRYKGRCYNIEPVAGEENQYICYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26167 - protein, 475 aa, Toxicodendron sylvestre
MSPQTETKASVGFKAGVKDYKLTYYTPDYITKDTDILAAFRVTPQPGVPPEEAGAAVAAESSTGTWTTVWTDGLTNLDRYKGRCYNIEPVAGEENQYICYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMLKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26168 - protein, 475 aa, Brucea javanica
MSPQTETKASVGFKAGVKDYKLTYYTPDYITKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26169 - protein, 475 aa, Rhus ambigua
MSPQTETKASVGFKAGVKDYKLTYYTPEYETKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRSPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26170 - protein, 475 aa, Cotinus coggygria
MSPQTETKASVGFKAGVKDYKLTYYTPDYITKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMLKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 26171 - protein, 309 aa, Thermus thermophilus HB27
MLEVVTAGEPLVALVPQEPGHLRGKRLLEVYVGGAEVNVAVALARLGVKVGFVGRVGEDELGAMVEERLRAEGVDLTHFRRAPGFTGLYLREYLPLGQGRVFYYRKGSAGSALAPGAFDPDYLEGVRFLHLSGITPALSPEARAFSLWAMEEAKRRGVRVSLDVNYRQTLWPPEEARGFLERALPGVDLLFLSEEEAELLFGRVEEALRALSAPEVVLKRGAKGAWAFVDGRRAEGSAFVVEAVDPVGAGDAFAAGYLAGAVWGLPVEERLRLANLLGASVAASRGDHEGAPYREDLEVLLKATQTFMR

SEQ ID NO: 26172 - protein, 431 aa, Thermus thermophilus HB27
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 26173 - protein, 1042 aa, Thermus thermophilus HB27
MAWLNPFWSSPKAYVRPPKRGLAPELWASRIPFTHLENFYEVFRALWENRDNLPYAWRILKDGVCDGCALGTSGLEDWTLHGVHLCNVRLRLLRLNTLPPLDPKVLEDVEALKGRKSRELRRLGRLPYPMLRRKGERGFRRVSWDEALGLAAEYLRRHLPEGAFFYLTSRGVPNETYYVVQKAVRALGCNHVDNAARICHSPSTVVLKEALGVAATTCSYTDLIGTDLVVFLGSNVANNQPVMMKYLYHAKKAGTKVAVVNPYREPGMERYFVPSDLESALFGTRIADRFFQILPGGDIAFLHGAAKWMLEEGWVDPGFIRAHTAGFEAYKALLEAIPFAELEKAAGVSREEMRAFAEMVGRAERAVFVWGMGITQHTHGEDNVRAIVNLALLKGFVGREGCGLMPIRGHSGVQGGAEMGAYATAFPGGLPVNPENARRLAELWGFPVPDRPGLTTPEALDRALEGRLGVLWAIGGDFREVMPDPEAVEEALRRVPLRVHQDIVLSSQMLLEPGECVLLLPATTRYEVPGGVTETSTERRVIFSPEIPGPRPPEARPEWEVFQELVHRLRPELKDRFRFASTAEVREEIARVIPLYEGIQRLKAKGDQFQYGGRHLCEGWRFPTPDGKAHFRPVPPAPKGGPRGGLPRGHPPGEAVQLHRPRGPGPPHRGLPGRGLHEPQGRRPPGPEAWGSGGAGKRLRPLRRPGLPGGGQRGHPGGPLARGERPGRPQGPLPPGPHPGLQGGPRPPAAGGGGGPFPAPAMRGKARVRVARLEGGRWREVRDEVAAEAPLEIRLRYRDEVASLGVVLRTPGQDAELAAGLLYTEGLLQDPKEVLAIAPCADGSLPPEAREGVIQVFLRHPLPPPPKRHLALTAACGACGREALPDLGKLGLSPPPPLAVDPDLLLALPERLGEAQRLFRATGGLHAAALFDREGRLVALREDVGRHNALDKLIGWAFLQGKLPLHDHILLVSGRAGYELLVKAVAAGIPVFCAVSAPTSLAVALAQAYGLTLVGFLRPGRMNVYAGRERVGPPRGLPNPCG

SEQ ID NO: 26174 - protein, 259 aa, Thermus thermophilus HB27
MLKVQNLGYRVGERWLLRGVDLAVGEGEFLAVLGPNGSGKTTLLRLLAGELRPTEGEVFLLGESLAVYGPQALARQRAVLSQVREMAFPYTAYEVAFLGRLPHLVGRERPLDHRKTLEALERVRALSLKERLFPSLSGGEAMRVEVARLLNQEARLLLLDEPTNHLDPRYALELLCLFRALAYEGKGVVAVLHDLNLAGLFADRVLLLKEGRAVAYGPPQAVLHPGLLEEVYEVAFSVLGQPGGPTFWVPLPREVVRGA

SEQ ID NO: 26175 - protein, 430 aa, Amycolatopsis balhimycina
MEEIRTEFIRPLLTSLSAHAADRPAYSDDRRTLTYGGLAHAAAELAAGLGVARGDRVLVHVGSRVEFAVALLAVLRAAAVGVPVSVRSTDAELAHLAADSGATLLVTEARHAAAAERLRRDRPGLRVLFVDDPPPARVGEPRDDLGLDEPAWLLYTSGTTGRPKGVLLSQRAMLWSTAAYYVPMLGLDAEDTVLWPLPTHHAYALSLAFVTTIALGAHTRLADGCTPDLLARYPGSVLAGVPALYLRLRQESGGPLAAPRLCLSGGAPCTPATRAAVRDLFGLPVADGYGSTETGGKVAAELPGEAGLVPVPGLEIRIDAGEVLVRGPGLMLGYHGRTESPLRDGWYRTGDAGRFEGGRLVLEGRVDDVIVCGGQNVHPAEIEAVLEESPSVRDVLVLGRPDDVLGEVPVAFVVAGPGGFDAEELRGRCL

SEQ ID NO: 26176 - protein, 282 aa, Lycopersicon esculentum
MTGGKEIIDKIKEKVGLSSSDTGRGKSKMSKNITHGYHMVEGKSHHTMEDYVFAQFKQVDENELGLFAIFDGHLSHEIPEYLRSHLFNNILNEPNFWAEPESAIRKAYRITDTTILDKAADLGKGGSTAVTAILINGQKLVVANVGDSRAVIYKNGVAKQLSIDHEPGREREIIEGKGGFVSNFPGDVPRVDGQLAVARAFGDKSLKMHLSSEPDVVVELIDDDTEFLILASDGVWKVLSNQEAADCIKDIKDARSAAKHLNEHALARGSTDDISCVVVRFQ

SEQ ID NO: 26177 - protein, 266 aa, Ehrlichia canis str. Jake
MLNYTLNYLNTNLNAIPLIGIELEFYFDNVEPNDISLLITNIKKKIFHFNCNIIKEQDNLQYEIQTSTTTNILNLILEINLIKEVLEDSINHFGGSINFAAKPYLDKPGSAFHIHINLLDANHNNLFYNQNNKMSNYLLYSIGGLCSLMKKHMIFFAPNNNSYLRYIHADIDTPTTISWGGNNRSTSIRIPSTSTDPTKCRIEHRVPGADCNYKQAITSILQGIIYGIENKIQPPPKTYGISSDIQYNLEKLPLSLNEAIKYNITD

SEQ ID NO: 26178 - protein, 469 aa, Ehrlichia canis str. Jake
MTKHEFLIIGSGPGGYIAAIRAAQLGYDVAIVEKENSLGGVCLNWGCIPTKSLLQSASVYHNIKKADIFGITVKDVKFDFNKIIERSRNVVEKLANGISGLMKKNNIKVYHGTAKLLGNATVEITDHSNKRISITSTHIVLATGSQAKNIPGIDFDNNIVWNAKNAMTPNKFPESILIIGSGAIGIEFASFYNTFGTQVTMVELKDNILPLEDHEVSKCMHNILSNKGIKIHTSSSITKLEKCNNYAKVQISDTIDLQVDNVILAVGIIPNSSNIGLENTKIKTDNAGFIITDKHCCTDEPGIYAIGDVAGFPCLAHKASHEAILCIENIAATENKIPQHKIHTINKNNIPSCIFSIPQIASIGLTEHQAKHQGYNFKVGKFNANCSGKAVAIDEVEGFVKVIIDKSTGELLGAHMIGAEVTEMINGYIIGKQVEITDQDITSAIFPHPTLSEMLHEAVLSSNNESLNS

SEQ ID NO: 26179 - protein, 504 aa, Ehrlichia canis str. Jake
MKVKRAIISVYNKTNIIELAKFLIAQKVEIIATSSTYQTLLGAELQVTEVSDYTNFPEIMGGRVKTLHPKIHGGILSNRNNHATECSNLGIYDIDLVIVNLYPFFQVASLKTSTESEIIEKIDIGGITLLRAAAKNFHNVTVVSDINDYETLKAEMTNNQNTTTLTYRKHLAKKAFAITSSYDSNIYNWMNKDSNDTLPKTFIIHGNKVQTLRCGENPHQQGAFYSSAKNKYPLEQLHGKELSYNNIVDIESAINIVSEFTQPAATIIKHSNPCGTAIADNITSAYNNAFSCDTKSSFGGIVALNREINEDIAEEINKIFIEVIVGTSITDKALEIIQKKKNVRVILSTQYNSPKYTIKNVSDGFLLQESNTNQLSAKDLIQVTNFPVSDDTISNLLFAWKVCKHVKSNAIVIAKDHRTIGVGAGQMSRVDSLEIAIKKAQDCTGAVLASDAFFPFTDSILLSASVNISAIIQPGGSLKDKEVIEEANNQKIAMFFTNIRNFYH

SEQ ID NO: 26180 - protein, 255 aa, Ehrlichia canis str. Jake
MSSSLIAGTLFLVIFMSLLIVANWKMYGDFITFSSFTKELSINLTNVKADLEVVLCPPFIALPKVVDCISCIKFGAQNCFYETEGKYTGEVSAKMLYDCGCSYVIVGHSERRSIFHESDYHVQLKASAAIKSGLIPIVCVGETLLDRENGMLKDSLLNQCYNSFPKSGKFIIAYEPVWAIGSNTIPSIDMITEALEVIRSYDSTSDIIYGGAVNQDNIRDVIAINQLSGVLVGSASLKLDSFYNIIHGAVNVRQN

SEQ ID NO: 26181 - protein, 423 aa, Ehrlichia canis str. Jake
MYINTCAWFNKGYQNIWMPYTQMKNSPLPLSVKSASGCYIILEDGKRLLDGISSWWSVCHGYSHPHIVQKVQDQVAKLSHVMFSGLAHEQSYVLASRLVKISPEQKKVFFSDSGSTAVEVAMKMAVQYHQNLGNKNKYNFVSFVNGYHGDTMGCMSISDPTKIHGTKFKKYHPSQFILPLPSTEEEIKNFANTIYSIRDQVAAVILEPILQAAGGMLIHSANILKKIYDIAKANNILFIADEVATGFGRTGTMFGCNQANIVPDIIVIGKALTGGFCTLAATLTTQEVYDAFLSDNIDDAFMHGPTFMANALACAAANASLDIFESQDLIRNIGLIENQLKSELGVFKQLDCVTDIRVKGATGVIELKDGLIDKHDIINKGVELNIWIRPLNNVIYVMPPFIINSNELTQLITSIYKILKSNI

SEQ ID NO: 26182 - protein, 1049 aa, Ehrlichia canis str. Jake
MGDIGMISALQAPNEIRKRMQMLYRTEENSYARYLTEKTEVSQDSKIRIYSVAKQIIEKIRVDRNLGIIDAFMQEYGLSNEEGIALMCLAESLLRIPDDCTINDLIKDKIGNSMWSNHIGSSSSMFVNAATWGLFIGGIVLKESNDSAKWFGTINNLLKTMGEPIIRKAIQQAMCTLGKHFIKGRDITEALNNRKEGELYSFDILGEAAKTRKDAERYFSEYMQAVDSIGKSKGSDDTGRLVDYDEISVKISALHSRYEFSQIDDVLDEIVDKLLQICRLAKEYNIRVCIDAEEASRLEISLMILEKLRFESSLNGWEGLGLAVQAYQKRAFSVLDFVEDISVRSCHKMMVRLVKGAYWDYEIKNSQELGLSSYPVFTRKVYTDVSYLACANKILSKPNTFYPCFATHNAYTLAAILEMANKDHPGFEFQRLHGMGASLYEYVTQELAANIKCRVYAPVGGYQDLLPYLIRRLLENGANSSFINQLNDSNISLEQLIQDPLEKAKELEYLPHPNIPLPKDIFGPERLNSSGIDITDSVTLANFNDEMKNYQNCKFKASSIVNGEEFDGDFIEILSPSNSEDLVGEVLFASSTQALSALDIAYSAFKDWSNVPVSTRASILEKAANLIEENKAKLIMLLIREGGKVISDAIAEIREAVDFLRYYAVLGRQELEGSNRLPGPVGEDNYLYFRSRGVFVCISPWNFPLAIFIGPIAAALVTGNTVIAKPAEQTSIIAYEAVKLLYDAGIPKGVLHLLLGDGKELGEVLLKNEKIGGVAFTGSTETARIINQSIAEKEGGIIPFIAETGGLNTMITDTSALVEQVTNDVITSAFKSAGQRCSALRVLFVQEEVADKQIEMICGAMEDLVIGDPMLLKTDIGPVIDKASQEMLIAHADRMSQEGKLLCQVKLGEECQKGYFFAPCAYEIQNISQLQREVFGPILHIIRYKKGDLHKILSEINDTGYGLTFAVQSRVQSNIDNIIDNINVGNVYVNRNQVGAVVGVQPFGGQGLSGTGPKAGGPYYLHRFLTEKVVSINTTALGGNTSLMCLTDQ

SEQ ID NO: 26183 - protein, 398 aa, Ehrlichia canis str. Jake
MSLIAGRMDCIKPSPTLEIASQAQKLKMSGVDVISLSAGEPDFDTPQHVKQAAIDAINAGKTKYTAVDGIIELKKAIVDRFKQDHDLTYDVNQVSVGNGAKQCIYNLLMATINDGDEVIIPAPYWVSYPDVVKISGGNPVIVDCSETFKLTPDLLESVITEKTKWLIINSPNNPTGLMYTYEELQCIAEVLLKYPNIYIMTDDIYSKIVYDGFKFFTIAQVEPRLYDRVFTVNGVSKAYAMTGWRIGYVAGDSKVISAISVIQSQSTTNPNSIAQFASVHALTGDQEFLKERNKIFAERRDMMMNMVNNTSVLSVKKPQGAFYVFISCKELIGKSAKNGLVINSGIDFTRYLLEDYNVAAVPGEAFGVQGFFRISYATSTEQLSKACDRILDACNKLL

SEQ ID NO: 26184 - protein, 466 aa, Ehrlichia canis str. Jake
MVVLNSQQVISYEKSCGIVVDELICRAGKAITDSISKLFPKQFVTVIAGPGNNGKDGVTAARMLKAQGWPVILMLYNCNVDIDEDWVIPLTYNSIVNCQSCLIIDAIFGIGLSRNIPEDLSCIFKYINNDSNNVIVAVDIPSGINCDTGQIMGCAIHADVTITFSVLKIGHILFPGCDYSGKVHVVDIGINIDYSRVAIRNNTPVLWKHEIPKLDYTVNKYKRGYTLVCSVGNKSIGASKLVAMAALRTGSGIVSIACDSNAVAFYASCLTSIMYKLYDDVINDDRVTSVVIGPGCGISDITKQRTVDVLSKKNCVLDADSISVFADSCETLFSEIKHNVIMTPHEGEFKRIFPFLTGSKIEVVQKAANLSKAVIVLKGPDTVIADPIGNVVVNNAPFNLATAGSGDVLSGIIGGLLSCGMTPLSAACCGVWIHAECARNYGIGLIADDIILQIPQILGKLFYSNY

SEQ ID NO: 26185 - protein, 316 aa, Ehrlichia canis str. Jake
MSNSPLLPVYSPSSVTFSHGKGVYLYGYDGRKYLDFHAGIATSSLGHAHPVLVNALKTQGEKLWHLSNLHTIPEAIKLAQKLVDISFADKVFFNNSGAESVDCCIKIARSYQCGKGNNQRYRFITMKGSFHGRTYAACSANEPSKFSPLLKPYVEWFDSVNPDITSIKNAINEHTGAILLEPIQGEGGINVLDSSFLKELRAICDQNDILLIFDCVQCGAGRTGKFFAYEHVGVTPDICCIAKGLGGGFPISASLSTNNAAQFMSVGMHGSTFGGNPLATTIGMVVVEEILKDGFLENVTKNGHYLYKKLKDLANK

SEQ ID NO: 26186 - protein, 509 aa, Ehrlichia canis str. Jake
MNFSGLQDLHDRKLKSFYGGGVSRIEKQHIKGKLTARERLTVLLDDNSFEEYGTFVEHRSVNFSMDKSKIPGDGVVVGYGTINGRKVCVYSQDFTVFGGSLSESNAKKICNIMDKAASLGLPIIGINDSGGARIQEGVDSLAGYGEIFQRNVNLSGVVPQISIIMGPCAGGAVYSPALTDFIFMVRNTSYMFVTGPDVIKKVMYEDVSQEDLGGAKVHSNKTGIADLVFNDEIEALLYVRKFMDFITSNNTELSKSQLVSCLDTEDLSLNTLIPKNSSTPYDMNELLEKVCDERLFYEIKPDFARNIIVGFGKIGGYKVGLIANQPLHLAGCLDIDASRKGARFIRFCDAFNIPIITFIDVPGFMPGVNQEHSGIIAHGAKLLYAYAEATVPKISIIVRKAYGGAYIVMNSKHLCGDINYAWPDAEIAVMGAEGAVEIIFRNETDKEKIQNIIDEYRTKIVNPYVAASRGYIDDIIIPSRTREYLFKSLQLLEKKKVNKIMRKHDNLPL

SEQ ID NO: 26187 - protein, 421 aa, Ehrlichia canis str. Jake
MSNITINKILARQILDSRGYPTIEAEVILSNNTKAKACVPSGASVGKFEAVELRDNDKNYYNGYGVTKAVNIINSEIAPQIIGMNTLNQEKIDNTLIKIDGTDNKSRIGANSTLAVSLAIAKAAASTLNIPLYQYIGGINAKVLPTPLINVINGGMHADNNLDFQEFMIIPNGANKFEDAMRMSAEVFFKLKQILKSKQYNTSVGDEGGFAPNIKTNNEVFEIIIDAIEKSGYKMYKDFSLGLDVAASTFYKDQKYKFADYEFNTQELVEYYKNITSQYPIISLEDPIAEEDTNGWKLITQELGNKIQIVGDDLFVTNCKLIQNGIQNNLANAVLIKPNQIGTLTETFNAIRLAQKNNYNTIISHRSGETEDTTISHIAVAANCGQIKTGSLSRSERLAKYNELLYIEKQLDISAIYYGAL

SEQ ID NO: 26188 - protein, 466 aa, Ehrlichia canis str. Jake
MQNYDIVIIGGGPGGYKCAIRASQLGLKVACIDKNKILGGTCLRVGCIPSKALLHFSHEYYHLKNNLSEVGITFDNLNFDLNKIMSFKDKNIAELGSGISQLFSSYKIDYLCGAGKIKSVGSNDFIIAINGDNAEQQITSKNIVIATGSDVSSFPGITIDEENIVSSTAALSFKEPPKRLVVIGAGAIGLEMSSVWSRFGSEVTVVEFLDKIAPSMDGDISKALLTSLKKQCINFKLSTKVVSIDNKGSNLTVHLESVKDGKSEVIEADKVLVSIGRVPYTKGLIDNNLIECDSRGFIKVNSRYETNIPGIFAIGDVIGGAMLAHKAEEEGIAVAELISGHIPHVDYEIIPSVIYTHPAVASIGKTEESLKNANYSYSVGKSNFAANGRSRITNNAVGFVKVLTSKVNNAILGVHIIGTYADTMINEAAIAMAYRASSEDVFRICHSHPDVNEAFRDACEAAFLNH

SEQ ID NO: 26189 - protein, 501 aa, Ehrlichia canis str. Jake
MTNHSVILCILDGWGNGENNQFNAIAQAYKPCWDNITLQYPKSHLITHGSSVGLPDGQIGNSEVGHVNLGSGRIVLQDLCKINNEIKYIKDNVYLLEFINKIKKNNGICHIAGLLSDGGVHSSYTHILDIINTLSDFQIQVAVHIFLDGRDTPPISATKYISILCEHIKHLNNINIATLSGRYYAMDRDNRLDRTTKAYNAIAFANAKRYEDPLTAVQDSYNLGITDEFILPCIIGNYQGMKPQDGFIMTNFRSDRVIQIIKMIIGDIKTDNHITLDNTIGMVKYSDKINIPCLFPNNNITNTLGEVIANNQLHQLRIAETEKYAHVTFFFNGGKEDMFENEDRIIIPSPSVATYNLTPEMSAEKVTDTIIEKIKLQKYSLIIVNYANADMVGHTGNIDATKQAITTIDQCLSKILNCIQNTNYVLVITSDHGNAEEMFDVKNNMPYTAHTLNPVPFIICNYNKKIRLKNGRLCDVAPTILEILNLAKPKEMTGVSLIEQV

SEQ ID NO: 26190 - protein, 221 aa, Ehrlichia canis str. Jake
MENKINILIFGPPGSGKGTQCHILSETYSSISIISTGDLLRNEAKLDTDDGKRIKKIIESGDLVDDDLVCKMFAKSISKIKNGFLLDGFPRNLSQAEFLTKILAEYDSQIDIVIQLQLDLEVIKSRLSSRILCKNCGQVSNLSFFGKKIDEITCSFCNSNKLDCRYDDKLEVIVKRVDKYNEEIKKLEDYYCDKIVCIDAGKSIEGVACDIKEKIAPLIIG

SEQ ID NO: 26191 - protein, 324 aa, Ehrlichia canis str. Jake
MVKIIVIDKTGGTEVFKYVDHNIGEPKDDEVLIQHTVIGLNRYDLECRNGMRKTRKLPTVLGIEAVGVVERLGKDVEVFNVGDRVGYCTVSGGAYSEKRIVNQKYLVRIPDDVTDQVAAAVLFKGMTAHYLTHIVYAIRPKTFALVHGATGGVGQILCQWASYKGCKVIGVISSDDRANIALRSGCSYIVNCNSKNFVEQVMEITQGTGVNVVYDSVGALTSKESFASLGMFGIYVSYGQISGAVSNVSASMLSSRSLFFTAPSVFHYKRSSFDLAMTSMELFEVIRRNHIKVSINKIYKFDDIVTAHQDLENRKLTGSNIIVL

SEQ ID NO: 26192 - protein, 450 aa, Ehrlichia canis str. Jake
MSTKVLYICQVCGNQTHRWTGKCNSCGSWDSITGETATEHLINTQHNSEIKLSSLSDKNVEISSRFITKISELDRVFGGGIVLGSSTLVGGEPGVGKSTLLLQLTSILDKNFSKCLYVSGEESIDQIKIRADRLQITQSNIQLLSTSSLSDIILSLKKNKDFKCVVIDSIQTIYDSRISSSPGTVVQIRMCTHELITFTKQHNIILFILGQITKDGQIAGPKTLEHMVDTVLYFEGENNSQLRILRTVKNRFGPTNEIGVFEMSDKGLIPVKNPSYLFLAKSQNNNIVGSAVFAGIEGSRPILMEIQSLIANTNMVTPRRAVVGWDVNRLAMIIAVLTAKCNIFLGDKEVYLNIAGGLKICEPAADLAIAASLISSFINVAIPSSIIILGEIALSGEVRNISSIDSRLKEAHKLGFTKAIIPLNNKHVFTDINTVEIGHIKMLKKYLIEL

SEQ ID NO: 26193 - protein, 485 aa, Ehrlichia canis str. Jake
MELSYAFDDILIIPSASNVLPSETDVTTYITNEIELKIPLISAAMDTVTEAKLAIALAQHGGIGCIHKNLPIDKQLLEVRKVKKYESWIVYNPIAVSPDDSLAVALSIMEEYSYSGIPVVTDTENGKLLVGILTNRDVRFIEDKGCKVADIMTKDHLITVPEGIERADAIKLLHQYRKERLIVVDNNYCCVGLITVKDIEKFNQFPNSCKDSGARLRVAAAVGTGTKDGIERAEALIAEDVDIIVVDTAHGHSERVLTTVKEIRSLFPHAQIIGGNVATAEGAQALIEAGVDSVKVGIGPGSICTTRIVTGVGVPQFSAILNVANACKNKKIKVIADGGIKYSGDIAKSIAAGADVVMIGSIFAGTDESPGEIIIYNGRAYKSYRGMGSVGAMKHGSASRYFQENNHKFIPEGIEGRVPLKGPVAGVIHQLVGGLKSAMGYTGNRNISDMKTKCKFTSITSAGLRESHVHDVIITREASNYDPLT

SEQ ID NO: 26194 - protein, 490 aa, Ehrlichia canis str. Jake
MLQKHKKLDILSVFKLGNLIMFLSTEDTLNYIKKNAINFIDLRFTDSNGRWHHITRSAETTDAQVLLTGINFDSSSISGWQSIEKSDMILLPDISTAFVDPFSAQSTLVIICNIVDPYNQSQYAKDPRYTAQKAYEYMLSTGIADKCYFGPEVEFFVFDNVQFYTGMYDSYFKIESAEHDISYQRREFSNNNHRPRVKGGYMPTPPIDSLHDIRSEMLTMFKEVGITPLIHHHEVAASQCEVGFQYDELLASADNVQKCKYIVHGVTSSYGKTATFMPKPVIKDNGSGMHCHQSLWKDNVNLFVNSDGNISDTCLYYIGGIIKYGKAINAFTNPSTNSYKRLVPHFEAPTWLTYSYENRSAAIRIPYVPQNDVNAKRIEVRFPDPLANPYLCFSAQLMAGLYGIQNKIHPGPAIDKNLYSLNKAELQQLSSVANSLEDSLESLDKDREFLLAGNVFTNDQIDSYINLKTLEVKDLQLHPHPIEFINYYSS

SEQ ID NO: 26195 - protein, 238 aa, Ehrlichia canis str. Jake
MHYISLSDLHIDFRGHQVLKGISLDIAYGESLVIVGESGSGKSVLTKTILGLIAPTSGKVVISGVDIRHDKSLIKNFGVLFQNCALFDSLTVCENIAFNLHYRFNRDRSLSRKIAASGLNLVGLGDDVLDRYPIELSGGMKKRIALARAIVSEPKIMILDEPTSGLDPIMSDVVNEIIIKCHKEFNLTVITITHDISSAFKIASKIAVLYNGKIIACESVQDIRNIDNQYVKNFICRN

SEQ ID NO: 26196 - protein, 222 aa, Ehrlichia canis str. Jake
MLKKKRIVEVSSSILSADFANLSKSIEVLENASVDYIHIDVMDGNFVPNITIGPVVVSAIRECTKIPFDVHLMINSPSNYIETFVNAGADMITVHAESEVHLDRVIKKIKSYGKDAGLSLVPTSHYSILEYIIFELDLVLIMTVNPGFSGQQFIVSQLDKISRVRSMIEKYSLKTKIAVDGGVNIDNAKSVIEAGADILVVGSAIFKAKNVLDYVQKLKSFL

SEQ ID NO: 26197 - protein, 394 aa, Ehrlichia canis str. Jake
MLRSHDFTFCNMKKIQDFSCSGKTVLLRADLNVPMDNGVVLDDTRIVRLTTTIKYLLSNDAKIVIMSHYGRPKSYDKEFSLKFLIEYLNKIFTTNVIFIDGVIGDYVEQTIQSASLGSILLLENLRFYAEEETNDLAFAKQLALLADIYVNDAFSCLHRKHASIDAITRLIPSFIGFNFQEEMKYLNCVVSNSEKPVAVIVGGSKISTKIHMLKNLTKKVDFLIVGGAIANNFLLSQGLKIGRSLYEELEKDLVKEIMDLAKRHECKIIVPVDYVVAKNSIYGKSSIKDNDTIESDDVILDIGPQTINIVTATVNKCRTILWNGPCGMFEKEQFSKGTFSVANLLAKLTKAGKLKSIVGGGDSICAIKLSGLSNDDFTYISTGGGALLHFLSIA

SEQ ID NO: 26198 - protein, 382 aa, Ehrlichia canis str. Jake
MSKSDYYELLGVSKNATSEEIKKAYRKMALKYHPDTNPGNKEAEEKFKELSEAYDVLIDQDKRAAYDKYGHNAFDGAAGRGGFDFNSGFSGDFSDIFNDLFGGGFGSRGGRGSSRRSEGAAGSDLRFDVEITLEDSFNGKKVPISYVTYVKCSSCSGSGSEGSAKSVQCNTCHGAGSVRTQQGFFTIERTCHVCNGEGEIIQNKCKKCSGSGRVRDEVNLLVTIPKGIESGNKIRLNGKGEAGYRGARSGDLYVYSNIQKHKFFTRSGPDLYCTVPIKMTLAALGGHIEMPSIDGTWTKVKVPEGSQSGDKLRLKEKGMPVINSSKRGDMYIQITVETPVKLTKKQKELLQKFDDEPNVDCNPQSTGFFQKVKSFWKDIRSN

SEQ ID NO: 26199 - protein, 138 aa, Burkholderia cepacia R18194
MNTETNALPAWLDKVRWDDNGLVPVIAQEASTNDVLMFAWMNREALAKTIETQRAVYYSRSRKRLWFKGEESGHVQHVHEVRLDCDEDVVLLKVEQVSGIACHTGRHSCFFQKFEGTVDNGDWVAVEPVLKDPEHIYK

SEQ ID NO: 26200 - protein, 476 aa, Burkholderia cepacia R18194
MSKEFDVVVIGAGPGGYIAAIRAAQLGKTVACIEKWKNPAGALKLGGTCLNVGCIPSKALLASSEEFENTSHHLADHGITVDGVKIDVAKMLGRKDAIVEKMTSGIEFLFKKNKITWLKGHGKFTGKTDAGVQIEVSGEGETEVVTAKNVIIATGSKARHLPGIPVDNKIVSDNEGALTFDAVPKKLAVIGAGVIGLELGSVWRRLGAEVTVLEALPAFLGAADEALAKEAAKLFKKQGLDINLGVQIGEVKATANGVSIAYTDKDGNAQTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIAANASDLIAEAVVAMEFKAASEDIARICHPHPSMSEVMREAALAVDKRSLNS

SEQ ID NO: 26201 - protein, 311 aa, Burkholderia cepacia R18194
MTKTFPRLIVFGEALTDFIRDDAQHWHSVAGGSCWNVARVGARLGVPTAFAGTVSRDTFGDELMRKSADAGLDLRFIRQVDRAPLLAMVVSKQPPHYFFIGENSADLAFDPADLPAGALDAAEIVHVGSLGVVREPLASRLIEVAHAARAAGKRISFDPNFRAPMAAPSYRDTLRKLAGLADWIKVSDEDLRGLFPELDEAAALAQLRTWAPDATMLVTRGASGMQLLHRDTVLFQPAFPTAVADTVGCGDASIGGWLASQLARPDASDAEHLRYAAACAAVACAHAGAYAPTAAEVTDMIDRSADAAVSQ

SEQ ID NO: 26202 - protein, 230 aa, Burkholderia cepacia R18194
MLGGCGSAVLAAAFPGLGIGFAGVALAFGLTVLTMAFAIGHISGCHLNPAVSVGLTVAGRFPARDLVPYIVAQVVGATLGAFVLYLIATGKPGFDVVGSGFATNGFGERSPGHYSLSASFICEVVMTGFFLFVILGATDKRGVPAGFAPIAIGLCLTLIHLISIPVTNTSVNPARSTGPALFVGGDAIGQLWLFWVAPIIGAVLAGIIYPLVAGRDDAVDLLPASARTSE

SEQ ID NO: 26203 - protein, 296 aa, Burkholderia cepacia R18194
MEIAFIGLGNMGGPMAANLLKAGHALTVFDLDAHAVDVAVRAGATAAGSPREAAARGAIVITMLPAAQHVRAVYLGDDGVLAGARAGAALIDCSTIDPGTVRAVAEAAAQRDFPLADAPVSGGTGGALAGTLTFMVGADAALFERIRPVLLDMGKNVVQCGGTGTGQIAKICNNLLLGISMMGVSEAMALGAALGIDPAVLAGIINTSTGRCWSSDAYNPYPGVSDTAPAARGYAGGFAANLMLKDLGLATEAARSAHQPVWMGALAQQLYQSMSQQGLGTLDFSACVKLYEAQPA

SEQ ID NO: 26204 - protein, 350 aa, Burkholderia cepacia R18194
MSTTYAYAATDSQSPLAPFEFQRRALRDLDVQIDVLYCGVCHSDLHQARNEWRNTIYPVVPGHEIVGRVTATGPQVSRFKVGELVGVGCLVDSCRTCPSCADGLEQYCENGFVGTYNGQDRVTGDITFGGYSTQLVVDEAFVLRVPDTLDPAGAAPLLCAGITTYSPLRQWNVGPGKKVGIVGLGGLGHMGVKLARAMGAHVVLFTTSPSKIEDGKRVGAHEVVISKDEAQMNAHLNSFDFILNTVAAQHDLNPFLHLLKRDGTMTLVGAPEHDHPSPQVFNLIFKRRRLAGSLIGGIAETQEMLDFCAEHGITSDIETIPMQQINAAYERMLKSDVKYRFVIDMASIKH

SEQ ID NO: 26205 - protein, 480 aa, Burkholderia cepacia R18194
MKNDLPELAPQALPSVDALTALLRDQRAAYLRAPYPAWETRVQHLRALRTMLIDHADALAEAISADFGHRAKQEVLLSEIWMAKEEIDDALKHGKRWMKPIRKPMNKWLRPARAKVIPQPLGVIGIVVPWNYPVLLAAGPLICALAAGNRAIIKMSELTPRTSALFEQLIAKTFTRDHVAVVNGDAEVGAAFSGLPFDHLLFTGSTHVGRHVMRAAADNLTPVTLELGGKSPAIVGPNARFDAAVDAIVAGKTLNAGQTCIAPDYVLLPRGMEAAFIERARARFAKMYPDLSANGDYTTIVSPRHYARLQQLASDAQSAGAQLHPLSDAQSDPASRRFVPCAVTQVPAASQLMQEEIFGPLLPLVPYERLDEAIAYVNARPRPLALYLFDEDGGTIDRVMRETISGGVSINETLMHIACGSLPFGGVGASGMGAYHGYDGFVTFSKMKPVLTQPRLNARNLLAPPYGKRFAALIKLMLKF

SEQ ID NO: 26206 - protein, 234 aa, Burkholderia cepacia R18194
MNKVYPSAAAALEGIVRDGQTFAVGGFGLCGIPEALIAALRDTAVKGITCISNNAGVDGFGLGLLLETRQIKKMISSYVGENKEFERQYLAGELELEFTPQGTLAEKLRAGGAGIPAFFTNTGYGTVIAEGKETRQFGDRHYVLEPSLTADVALVKAWKADKSGNLIFRRTARNFNPMCAMAGKITVAEVEEIVENGALDPDHIHTPGIFVQRIVLNATPEKRIEQRVVRAKGD

SEQ ID NO: 26207 - protein, 506 aa, Burkholderia cepacia R18194
MNPVPAYTSDADVGHYVDGAPVAGRSGRFQDVLNPALGRAVRRVALADDNEVQQAVASANAAFPAWAATPPIRRARVMHRFLQLMNEHRDALAAIITAEHGKVFSDAQGEVARGIDIIEFACGVPQLLKGDFTDQVSTGIDNWTMRQPLGVVAGITPFNFPCMVPCWMFPVAIATGNTFVLKPSERDPSAALFIADLLTQAGLPAGVFNVVQGDKGAVDALLDHPDVQAVSFVGSTPIAAYVQQRAVQSGKRVQALGGAKNHLVVMPDANLEQAVDALIGAAYGSAGERCMAISVAVLVGDIADKIVPLVAERARKLVIGDGMSPEVEMGPIVTGEALKRIEGYIEQGVNEGAQLVVDGRGLRVPGREAGFFTGGTLFDHVTPDMRIYKEEIFGPVLGCVRVKDFGEAVDLINAHEFGNGVSCFTSDGGIAREFSRRIQVGMVGINVPIPVPMAWHGFGGWKKSLFGDMHAYGEEGVRFYTRQKSVMQRWSSSIGKGAEFAMPTAK

SEQ ID NO: 26208 - protein, 488 aa, Burkholderia cepacia R18194
MGKATGFLEFERRHEAYEAPLTRVKHYKEFVAALTDADAKVQGARCMDCGIPFCNNGCPVNNIIPDFNDLVYRQDWQQAIEVLHSTNNFPEFTGRICPAPCEAACTLGINNDPVGIKSIEHAIIDKAWAEGWVKPLPAEHKTGKKVAVVGSGPAGLAAAQQLARAGHDVTVFEKNDRVGGLLRYGIPDFKLEKWLIDRRMRQMEAEGVTFRTSVFIGKDPLPESIGSLAKETISPETLKEEFDAVVIAGGSETPRDLPVPGRELAGVHYAMDFLPQQNRVNAGDKLVDQLLAKGKHVIVIGGGDTGSDCVGTSNRHGAKQVTQFELLPQPPEEENKPLVWPYWPIKLRTSSSHDEGCERDWAVATKRLEGKNGKVEKLIAVRVEWKDGKMQEVPGSEFEMKADLVLLAMGFTQPAAPVLEAFGVAKDARGNARAATEGDRSYYTSVDKVFAAGDMRRGQSLVVWAIREGRQCARSVDAYLMGHSNLPR

SEQ ID NO: 26209 - protein, 273 aa, Burkholderia cepacia R18194
MSPTPTETLLELRDVDFGYGDRLVLSNLNLRFGRGQVVAVMGGSGCGKTTVLRLIGGLVRARRGQVLFDGADVGAQTRDGLYALRRKMGMLFQFGALFTDMSVFENVAFALREHTDLPEDLIRDLVLMKLNAVGLRGARDLMPSEVSGGMARRIALARAIALDPQLIMYDEPFAGLDPISLGITANLIRTLNQALGATSILVTHDVPESFAIADYVYFLANGGVLAQGTPDELRASTDPSVRQFIDGAPDGPFKFHYQSPPLAADFGLGGGRA

SEQ ID NO: 26210 - protein, 304 aa, Burkholderia cepacia R18194
MNYQTILERIHTELAPWIGQGRVADYIPELAKVPADKFGMAVVTLDGNVCTVGDAYERFSIQSISKLFACTLAFQLLGDELWERVGREPSGNAFNSLVQLESERGKPRNPFINAGALVVTDVLCRRFVKAETALVEFVRRLIGANDIDYDSRVAQSELQHAERNRAMAHFMASFGNMQMPPDTVIDAYCRQCAITMNCVELARAALFLANGGVAPVTGERIVDSSSAKRLSALMLTCGTYDAAGDFVYRVGLPAKSGVGGGIVAVLPGEMAVCVWAPGLDANGNSLAGTLALEWLTTYSGRSIF

SEQ ID NO: 26211 - protein, 289 aa, Burkholderia cepacia R18194
MGAPMALNLLKAGHEVHAFDLSADALRALQDAGAQVAASPRDAASGATFVITMLPAAPHVRSVLSGENGVLAGLGAGATVIDSSTIDPASAQAFGALVREHGGAFVDAPVSGGTGGAAAGTLTFMVGGSDADFERVKPVLAGMGKNIVHCGATGMGQVAKVCNNLVLGISMAAVSEAMSLGVALGIDPKVLAGIVNTSTGRCWSSDTYNPYPGVIDTAPSSRGYSGGFGTDLMLKDLGLANDAAKQARQPVYLGALAQQLYQTMSSRGDGQLDFSAVIRLYQPATKKDA

SEQ ID NO: 26212 - protein, 339 aa, Burkholderia cepacia R18194
MKAIEITEFGAPDVLKLAERPRPEPKRGEVLIKVAASGVNRPDVFQRKGAYAPPPGASDLPGLEVAGEIVGGDLSDAALNPFGLKLGDRVCALLAGGGYAEYAVAPLPQCLPVPDGLTDIEAASLPETFFTVWSNVFDRAQLGAGEGGEQETLLVQGGSSGIGVTAIQIAHALGFRVFATAGTADKCRACEALGAERAINYKTEDFVEVVKSLTHDRGVDVILDMVAGSYVPRELSALVDGGRLVLIALLGGAKADVNLGEILRRRLTITGSTLRPRPVEFKAQIAAQLKSRVWPLLADGRIKPVIYRVLPAADAAQAHALMESSEHTGKIVLDWGTNA

SEQ ID NO: 26213 - protein, 243 aa, Burkholderia cepacia R18194
MIGNWKMHGRLAGNQALLNEVVQGAGAVAAETSIGVCVPFPYLAQVQAQLDGGRVAWGAQDVSAHEQGAFTGEVAAAMVAEFGARYAIVGHSERRAYHGERNETVAAKTQRALAAGLTPVVCVGETLDERESGATEQVVGAQLDAVLAVLTADEATRIVVAYEPVWAIGTGKSATSAQAQDVHAFLRARLAAKGAADVSVLYGGSVKPDNAEELFAQPDIDGGLIGGASLKAEDFLAICRAAR

SEQ ID NO: 26214 - protein, 431 aa, Burkholderia cepacia R18194
MGALNRAGSRVIVKADGVYLWDSDGNKIIDGMAGLWCVSVGYGCKALADAAYRQIQELPFYNTFFKTTHPPVIELSAMLAEVSPKGFNHFFYCNSGSEGNDTVLRLVHQYWRVQGQPQKKYVISRKNGYHGSTIAGGTLGGMGYMHEQMPSKVENIVHIDQPYFFGEAAAGETPEAFGLARAQQLEAKILELGAENVAAFIGEPFQGAGGVIFPPSTYWPEIQRICRKYDILLAADEVIGGFGRTGEWFAHQHFGFEPDLITMAKGLTSGYVPMGAVGIHERVARPIIDNGEFNHGLTYSGHPVAAAVAVANLKLLRDEGIVERVKNDIGPYFQRRLRDALGDHPIVGEIAGAGLVAGVQLARDRDRRERFGASVDIGTICRDFCFNGNLIMRATGDRMLLSPPLVIREAEVDEIVDKAKRAFDATAERVG

SEQ ID NO: 26215 - protein, 487 aa, Burkholderia cepacia R18194
MNSHSLDLGGNAGGPASARPPAAAAGVDADASALPARRVTLGDFMDDLPVGALHRFVVWVIGIGLFFDMYEIFLVSTIGSALQNEYGLSRQSTDFKLLLASAFIGMFVGAMCLGSLADRIGRRKAFLLTLTWYSAFSLVGAFSVNADMLVACRFLTGIGVGAIYPVADSFLSEILPKEKRGRLAAWAYTTSYVAVPLVGFLALWLNPLHVGGVAGWRIILAIGSLGAVYVMLVQHRLPESPRWLLAQGRTADAHAALRRFAEGTGVRVPEQFAEPVEPQRPLGLGERIALLRREPYGARYLMLAIFHLFQGFGYYGFGTLAGTVVKSRGFDVTDSTLFIALSFIGYPVGSLLSIPLLNRIERRTLVIVSILSIAVFGLCFAYSGNTVLIVGFGFLTTCASNVFSNAYHVYQAEIFPARVRSTAIGSTYALSRIVSGVLPFVLLPVLASYGAGAMFGVISVALGIVAVTLRVLGPLTTRRSQDEINPV

SEQ ID NO: 26216 - protein, 242 aa, Burkholderia cepacia R18194
MLTRSVPRDDADYIESGNVLLDNLFNARVHDLPASADAMAYAIARADELRAAGHRVYVCPFGGSSPVGCLAYAACAAEIVQQSQALGTRFDRIIVPNGSGGTHAGLVAGFAALGTGTVEVDAYTVYAPAADAYRATLDKAQQTANIIHPDTEISPDAVRVDASQLGPGYGIPTDAMRRAVRLLASQEGLLLDPVYSGKAFAGLIEGVASGRYASDQSILFVMTGGLPGLFAYRREFQMALDG

SEQ ID NO: 26217 - protein, 228 aa, Burkholderia cepacia R18194
MTQFRIAPSILSADFARLGEEVRNVVAAGADWIHFDVMDNHYVPNLTIGPLVCEAIRPHVQVPIDVHLMVRPVDRIVPDFAKAGANLISFHPEGSDHIDRTLSLIRDHGCKAGLVFNPATPLNYLDHVMDRLDFVLLMSVNPGFGGQSFIPETLNKLREARARIDAYTERTGREILLEVDGGVKTDNIAEIAAAGADTFVAGSAIFGKPDYRTVIDEMRAALATVERS

SEQ ID NO: 26218 - protein, 463 aa, Burkholderia cepacia R18194
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWAFALGITLVLTVTNLFSVKNYGEFEFWFALIKVVAIVVFLCIGGAAIVGIIPAPAVSGVSNLFVHDGFMPHGAGAVLAAMLTTMFSFLGTEIVTIAAAESDNPQRQIVRATNSVIWRITLFYLGSILVVAAIVPWNDPLLPKHGSYQRAMELIGIPNAKAIIDVIVLVSVASCLNSALYTASRMLFSLSKRKDAPAFLHRTDSTGTPRAAVLASTAFGFVTVIANYLMPEQVFGFLLATSGAIALLVYLVIAISQLRMRKTLESTGADLTLRMWLFPWLTWLVIVFICGTLTVMLVSEDHRMEVGATAVLALIVLLASWLNKRGRDAQASEGRRASAM

SEQ ID NO: 26219 - protein, 287 aa, Burkholderia cepacia R18194
MGAPMIRHLLAAGHRVSVWNRSRDKAEALVKDGAQVVGTPRELAERVDTVFVCVLDGRAVGDVVFGEHGLLSGDAAARRLQRIVDHSSIPPAATRDYAARATALGVGWVDAPVSGGVPGAQAGTLAVMAGGRAADLDAVRPLIDTYASRITHMGDAGAGQTAKLCNQAIVTATVTAIAEAVGLAQASGIDAARLAEALAGGWADSVLLQTFVPRMTSGGHPPIGALSTFQKDVDAIADAARDTGAVMPVSATVQQVLRLGAAQGLAGADFAAFIDIVRPGNGRQQAS

SEQ ID NO: 26220 - protein, 486 aa, Burkholderia cepacia R18194
MRLIQKALTFDDVLLVPAFSDVLPRDTSLKTKLTRNISLNMPLVSAAMDTVTEGRLAIAMAQQGGVGIVHKNLTPAEQAREVAKVKRFESGVVRDPITVPPQMKVRDVIALSRQHGISGFPVVEGPQLVGIVTNRDLRFETRLDEPVKSIMTPRERLVTVKEGTPLAEAKALMHSHRLERVLVVNDAFELRGLMTVKDITKQTEHPDACKDEHGKLRAGAAVGVGPDNEERVELLVQAGVDVIVVDTAHGHSKGVLERVRWVKQNFPHVEVIGGNIATAAAAKALVEYGADAVKVGIGPGSICTTRIVAGVGVPQISAIANVAEALKGTGVPCIADGGVRFSGDVSKALAAGANAVMMGSMFAGTEEAPGDVFLYQGRQYKSYRGMGSVGAMKDGAADRYFQDNSANIDKLVPEGIEGRVAYKGSVNAILFQLVGGVRASMGYCGCKTIDELHDKAEFVQITAAGMRESHVHDVQITKEAPNYHVD

SEQ ID NO: 26221 - protein, 410 aa, Burkholderia cepacia R18194
MAASPVNPRLDSLQPYPFEKLRALFKDVTPSGALKPISFGIGEPKHATPALIRDAVVAALDGLASYPATAGSDALRTSIAHWLERRYGLPAIDPATQVLPVSGSREALFSLAQTVIDARPSEQGEKAIVLCPNPFYQIYEGAALLAGAEPYFANSDPARNFACDYASVPDAVWARTQLLYVCSPGNPTGAVLTLDDWRELFALSDRHGFVIASDECYSEIYFDEAAPPLGGLEAAHRLGRGFERLVMLSSLSKRSNVPGMRSGFVAGDAALLKKFLLYRTYHGAALSPVWQHASIAAWNDEAHVRENRALYLQKFNTVTPLLADVIDVKLPDAAFYLWANVSRTGLSDTEFARRLYADYNVTVLPGSYLARDAHGTNPGRDFIRIALVAGTPECVEGAQRIVDFCRSLAR

SEQ ID NO: 26222 - protein, 159 aa, Burkholderia cepacia R18194
MSTLYSFSAETLAGAPASLDAYRGKVLLIVNTASECGFTPQYAGLQKLYDQYAARGFYVLGFPCNQFGKQEPGDAAQIGAFCERNYGVTFPMFAKIDVKGDHAHPLYRYLTDEAPGILGLKAIKWNFTKFLVDREGRIVKRYAPSTKPDEIAADIDKLL

SEQ ID NO: 26223 - protein, 458 aa, Burkholderia cepacia R18194
MAKQKTVYVCSECGGQTPKWQGQCPSCQAWNTLVESVAEAPAAHRFQSLAKRAPVQRLVDIEAADVPRFSTGIGEFDRVLGGGLVPGGVVLIGGDPGIGKSTLLLQSLADIASERRALYISGEESAAQIALRAQRLALLDGGAVADELKLLAEIQLEKIQAAIDAERPDVAVIDSIQTVYSEALTSAPGSVAQVRECAAQLTRIAKQSGTAIIMVGHVTKEGNLAGPRVLEHIVDTVLYFEGDTHSSFRLVRAFKNRFGAVNELGVFAMTERGLRGVANPSALFLSQHEQVVPGSCVLVTQEGTRPLLVEVQALVDTAHVPNPRRLAVGLEQNRLAMLLAVLHRHAGIACFDQDVFLNAVGGVKITEPAADLAVLLAIHSSMRNKALPKGLIVFGEVGLAGEIRPSPRGQERLREAAKLGFTSALIPKANAPKQPIEGLNVMAVDRLEQAIDRVRDLE

SEQ ID NO: 26224 - protein, 427 aa, Burkholderia cepacia R18194
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSAEFTDYLATLADKFPIVSIEDGMHESDWEGWKLLTDRLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 26225 - protein, 175 aa, Burkholderia cepacia R18194
MVSLKDSHFDLFHLPAQFALDETVLDAAYRTVQTQVHPDRFAAAGDAQKRIAMQWATRANEAYRTLRDPLKRASYLLSLRGVDIGAENNTAMEPAFLMQQMEWREGIEDAAAARNVDALDALLAELREERRVRVERLGTLLDSGADQAAAEAVRQLMFIERVASEVGAQIERLET

SEQ ID NO: 26226 - protein, 470 aa, Burkholderia cepacia R18194
MGKQAIGVIGLAVMGRNLALNIESRGYAVSVYNRSREKTDELIAEFPGRNLVPTYTLEEFVASLETPRRILMMVKAGEATDATIASLKPLLEKGDVLIDGGNTHFTDTIRRNQELAQSGLHFIGTGVSGGEEGALRGPSIMPGGQRDAYDLVEPILKQIAAKAPSDGEPCVAYMGPDGAGHYVKMVHNGIEYGDMQLIAESYAVLKDVAGLTNDELGAVYTEWNQGELDSYLMEITSKIFGKKDEETGKHLVDVILDRAAQKGTGKWTSQNALDLGVPLPLITESVFARVLSSLKTERVAASKVLSGPAAAPFDGDRAAFVEAVRRALYLSKVISYAQGFAQLRTASEEYGWNLDLGTIAKIFRAGCIIRARFLQKITDAYAKDPALANLLLDPYFKDIAANYQASLRDVVVAAVKAGVPVPAFASAVAYFDSYRSERLPANLVQAQRDFFGAHTFERTDKPGSFHANWS

SEQ ID NO: 26227 - protein, 483 aa, Burkholderia cepacia R18194
MQPVILAGGSGTRLWPMSRERFPKQLIGLLGEHSLLQSTALRLDGLTADHPLNDDVLIVCGEDHRFTTAEQLRLTGKPASIMLEPIGRDTAPALTLAALRLVAGGNDAVMTVMPADHAVADLPRFHAAVAAGVHCAMQGKIATMGIVPTHAETGYGYIRVGAPLGDAATGKLDVRRLDRFVEKPHLELAQQYVASGEYWWNSGIFIVRASVWLKAIRQLEPAIYAACEQAVAQGKADGDFFRVDRDAFAASPSNSIDYAVMEPIASLPQLCESVVVPLDAGWSDVGSWDAIWQISPKDDADNVGRGHVLFEGAESTFAHSESRLVACLGTQNLVVVETPDAVLVADKSRVQDVKKIVGHIKAQRGAEATDHRKVHRPWGHYDSIDMGERFQVKRIVVKPGARLSLQMHHHRAEHWIVVRGTARITRGDETFLLSENESTYIPLGVSHRLENPGMMPLELIEVQSGAYLGEDDIVRFDDTYGRQ

SEQ ID NO: 26228 - protein, 491 aa, Burkholderia cepacia R18194
MADWQDKAASLKIEGRAFIDGASRDAHGGKTFDCVSPIDGRVLAKVADCGEADVNAAVAAARRAFDAGVWAGLNPRARKAVLLRWAALMREHLDELSLLETLDAGKPIGDTTTVDVPGAAYCVEWFAEAIDKVGGEVAPADHHLVGLVTREPVGVVAAVVPWNFPILMAAWKFGPALAAGNSVVLKPSEKSPLTAIRVAQLAYEAGIPAGVFNVVPGAGEPGKLLALHRDVDCIAFTGSTAVGKLIMQYAAQSNLKRAWLELGGKSPNIVLADCPDLDRAAQTAAGAIFYNMGEMCTAGSRLLVHRDIKDAFIEKLVAAARAYVPGNPLDPSVSMGAIVDGIQLERVLGYIEAGRSEGKLVTGGARVKEETGGFYVEPTVFEVKPDAKIAREEIFGPVLSVIVFDDVDEAVRIANDTEYGLAAAVWTSNLTTAHDVSRRLRAGTVWVNCYDEGGDMNFPFGGYKQSGNGRDKSLHALEKYTELKSTLIRLR

SEQ ID NO: 26229 - protein, 480 aa, Burkholderia cepacia R18194
MTYRNESAWIQPAAPSATAAAPRATQARTTAEYRALDAAHHIHPFSDMGALNRAGSRVIVKADGVYLWDSDGNKVIDGMAGLWCVNVGYGRKELADAAYRQIQELPFYNTFFKTTHPPVIELSAMLAEVTPKGFNHFFYCNSGSEGNDTVLRLVHQYWRVQGQPQKKFVISRKNGYHGSTIAGGTLGGMGYMHEQMPSKVENIVHIDQPYFFGEAAAGETPEAFGLARAQQLEAKILELGAENVAAFIGEPFQGAGGVIFPPSTYWPEIQRICRKYDILLVADEVIGGFGRTGEWFAHQHFGFEPDLITMAKGLTSGYVPMGAVGIHERVARPIIDNGEFNHGLTYSGHPVAAAVAVANLKLLRDEGIVERVKNDTGPYFQALMRETFARHPIVGEVHGHGLVASLQLAESPAERRRFANGGDVGTICRDFCFNGNLIMRATGDRMLLSPPLVISRPEIDELVSKAKKAVDATAQQLGIS

SEQ ID NO: 26230 - protein, 452 aa, Burkholderia cepacia R18194
MDFDYDLFVIGAGSGGVRLARMSASYGARVGIAEEEQIGGTCVLRGCIPKKLLVYASHYPHEVEDAKGFGWRFGAGTLDWPALIAAKDREINRLSDIYINLLRQSGVEMHAGRATLVDAHTVAIGDRTIRARHIAIATGSRPSMPARPGIEHAITSREALSLAALPKRIAVVGGGYIAVEFAGIFNGFGSHVDLFYRGEKILRGFDDDVRQFLTDEMTKQGVTIHARSVVESIERADDGTLSVRVGDARHGPYDQVLYATGRVPNVDGLGLEQAGVALDARGAIAVDAYSATSVPSIHAIGDVTSRPQLTPVATRDGALLARTLFGGSRVAADHEWVPSAVFSQPEVATVGLTESTARDLYDGDVDIYRTSFKALRHTLSGRDERTLMKLVVARDSQRVVGAHMVGRDAGEIIQGIAIAIRAGATKAQFDDTIGIHPTAAEEFVTMRQKVAD

SEQ ID NO: 26231 - protein, 135 aa, Burkholderia cepacia R18194
MYSLGDGAKNAQPSIIHIEGDPDHPVNRGTLCPKGASLIDFIHSPSRLTHPEYRAPGSDKWEPISWNDALDRIAKLMKADRDANFVETAEDGAKVNRWLTTGMLAASAGSNEVGYLTHKTVRSLGMLAFDNQARV

SEQ ID NO: 26232 - protein, 396 aa, Burkholderia cepacia R18194
MDDSLNFDTLAVRAGTLRSDFNEHSEALFLTSSFCFQSAADAAERFANSEDYFTYSRFTNPTVTMFQERLAALEGGEACIATASGMAAIMSVVMAALQAGDHLVSSRSLFGSTLGMFSQIFSKFGITTTFVDPTDLNAWKEAVRPETKMFFLETPSNPLTELADIEAIGKIAKASNALFVVDNCFCSPVLQQPLKLGADVVMHSATKFLDGQGRVLGGALVGSKEFIMGKVFPFVRSAGPTLSAFNAWVLLKGMETLSLRVEKQSANALEIARWLDSHPAVARVFHPGLESHPQHELAKRQQKAGGSILSFELKGDTPEQQRANAWRVIDNTKLISITGNLGDTRTTITHPATTTHGRITPEARAAAGISEGLIRLSVGLEDVGDLRKDLARGLEG

SEQ ID NO: 26233 - protein, 271 aa, Burkholderia cepacia R18194
MNRIQQTFAALAEQGRKGLIPFITAGDPDPAKTVEFMHALAEGGADVIELGVPFSDPMADGPVIQRSSERALARGVTLKSVLADVKRFRETDPKTPVVLMGYANPIERMGVDTFAAEAQAAGVDGVLVVDYPPEEAGVFAEKMRAAQIDPIFLLAPTSTDERIADVGKIASGYVYYVSLKGVTGAGNLDVSSIAGKIPAIKSRVPVPVGVGFGIRDAETARAVAEVSDAVVIGSRLVQLLESAAPEGAAAALKTFIAELRAALDGAGKTAR

SEQ ID NO: 26234 - protein, 510 aa, Burkholderia cepacia R18194
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 26235 - protein, 370 aa, Burkholderia cepacia R18194
MTALFSPFTLRGVTLPNRIVISPMCQYSAERGEATDWHMIHLGHLALSGAGLLCIEATAVEPDGRITHGDLGLWDDVTEAALKPVLAAIRKHSPVRVAMQLSHAGRKASSNVPWQGGQLVSVADGGWLPHAPSAVPHKDGETPPLALDAAGLNRIREAFAASAKRAARLGIDAIEVHAAHGYLLHQFLSPLANQRTDEYGGSLENRMRFPLEIFEIVRAAFPEGRPVGVRVSATDWVEGGWELDDTIAFAHELKRRGCDWIDVSSGGVSPLQKIPLSAGYQVPFAQAVKRAVGMPTIAVGLINEPAHANRLIEAGDADFVAMARAMLYDPRWPWHAAAELGAQVTAPPQYWRSQPREHKALFGDIAFGQR

SEQ ID NO: 26236 - protein, 1310 aa, Burkholderia cepacia R18194
MASTTLGVKVDDLLRSRLKDAAARLERTPHWLIKQAIFAYLERIEHGQLPPELSGHSGVTELADGQVADGDDDNSPHPFLEFAQNVQPQSVLRAAITAAYRRPEPECVPFLLGQARLPANLQADVQALATKLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDAQRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDTEIKRAQVDGLEGYPVYTRKIYTDVSYLACAKKLLAAPDAVYPQFATHNAHTLAAIYQLAGQNYYPGQYEFQCLHGMGEPLYEEVTGRDKLNRPCRVYAPVGTHETLLAYLVRRLLENGANTSFVNRIADKTVAVKELVADPVDEASKVVPLGAPHAKIPLPRNLYGDERPNSMGLDLSNEHRLASLSSALLASAHFPWRAAPMLADDALADAPARDVRNPADQRDLVGTVSEATAEHVSAALAHAVAAAPIWQATPVDARADCLVRAADLLEAQMHTLMGLIVREAGKSLPNAIAEIREAVDFLRYYAAQIRDEFSNDTHRPLGPVVCISPWNFPLAIFMGQVAAALAAGNTVLAKPAEQTPLIAAQAVRLLREAGVPAGAVQLLPGTGETVGAALVADARTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDGEAKQTIDTHVAAMKDKGHGVTQLPAPEACAHGTFVPPTLIEIGSIDELKREVFGPVLHVVRYRRSQLDKLLEQIRATGYGLTLGIHTRIDETIAHVISNAHVGNIYVNRNVIGAVVGVQPFGGEGLSGTGPKAGGALYLQRLLATRPSGLPRSLAQTLIADGAVEGDARGNPAAALTTLRDWLIEQREPVLAARCDGYLAQVPAGATAVLSGPTGERNTYTLGPRGTVLCVAATPGGARAQFAAVLATGNRALFAGAAGEALVAALPASLKAHAVVRKQADAPFDAVLFEGDSDELQTLVKDVAQRPGPIVSVQGVSVGAFENGDAEDYALERLLTERSVSVNTAAAGGNANLMTIG

SEQ ID NO: 26237 - protein, 502 aa, Burkholderia cepacia R18194
MNLVAALDRAARATPDKPFLVSESATITYAAARERSHRAAAVLSALGIAAGDRVAAMCFNTPAFVDLMFGAWRLGATFVPINHKLQAPEVDYVLEHSRSKALLFDVALAPVVERLVHPARRLVTEGELDGVPCFDTLCATMDGLAGIDPADGDIAQILYTSGTTGHPKGCVHSHRTVTLAAMQAALATGIGRHERTLMAMPIWHSSPLNNWFGGTLYAGGTVVLLREYHPLRFLQTVERERVTLYFGAPVSYLLPLDTIDGFAAFDLSSVRAWLYGGGPIGPAQAERLARAYRSDAFFQVYGMTEAGPAGTTLYPDEQIAKAGSIGRTGGPGVDLRVVRMDGIDAQPGETGEIWLKTDSMMLGYLDDAAATRAAFAPDGWYRTGDIARIDQDGYLFIVDRLKDMIVTGGENVYSKEVEDVLGAHPDIAEAAVVGVPHPDWGETVVAHVVLRAGTVPDADALRAFCGERLAAYKIPREFTFAQALPRTPTGKLQKFLLRVRRE

SEQ ID NO: 26238 - protein, 508 aa, Burkholderia cepacia R18194
MNPFDLKQLGLDVEYPYRQQYDNYIGGKWVPPVKGEYFENVSPINGQPFCRIPRSGTDDIELALDAAHAARRKWGKTSVAERANLLLAAADRMEKNLKLLAVAETIDNGKPLRETMAADLPLAVDHFRYFAGCIRAQEGGISEIDDNTVAYHFHEPLGVVGQIIPWNFPLLMAAWKLAPALAAGCCVVMKPAEQTPASVLVLMELIGDLFPAGTINIVNGFGKEAGEALATSKRIAKIAFTGSTPVGKHILRAAADSLIPSTVELGGKSPNIFFADVLDQDDAFLDKALEGLAMFALNQGEVCTCPSRILIQESIYEKFIEKAVARVERIKAGHPLDLQTMIGAQASQQQLDKILSYIDIGRGEGAQCLTGGERTAPAAELGTGYYVKPTMLLGNNKMRVFQEEIFGPVASVMTFKDEQDAIELANDTFYGLGAGVWTRNGTRAYRMGREVEAGRVWTNCYHLYPAHAAFGGYKQSGIGRETHKMALSNYQQTKCLLVSYQAEALGFF

SEQ ID NO: 26239 - protein, 458 aa, Burkholderia cepacia R18194
MTEETMASVISASKVDADAAVAAARRAFDHGPWPRMSLHQRMEVMARLRELLIEHESLIAHLVTEEMGCPISISRWMQAGGPISMLGMFLEVAPHYPFSQIRRTVTGNGLVLREPLGVVAAVVPWNAPLQIAVLKLAPALLAGNTAILKPAPETPLDACLLAELAEKAGLPKGVLNVLPADREVSEYLCLHPAVDKVSFTGSSAAGQRLGALCGNDIKRITLELGGKSPAIVLDDADIGKAVESLRMGSLRNSGQVCSNKTRLLVSKHRKDELIDAFVEMVRSMPVGDPFDPLTQIGPLVSARQRDRVEGYIAKGKQEARLVLGGGRPKGLTRGWFVEPTIFADVDPDAVIAQEEIFGPVISILSFDTDDDAVAIANNSAYGLHGAVFSADTERAVNVARRVRTGAIDINGASAGYHSPLGGRKKSGIGREAGIEGFDGYVEIKSIGIPVSYAEQLSS

SEQ ID NO: 26240 - protein, 322 aa, Burkholderia cepacia R18194
MTELLHGDGAIRRTTPYGSSIENTYAGVLSFMRRNYSRELDGVDVAISGVPLDLATTYRSGARLGPAAIRAASVQLAELHPYPWGFNPFDDLAAVDYGDCWFDAHNPLSIKPAIVEHARTILGSGAKMLTLGGDHYITYPLLVAHAERYGKPLSLIHFDAHCDTWADDDPDSLNHGTMFYKAVKEGLIDPATSVQVGIRTWNDDFLGIERLDAAWVHDHGARAAVERIVDIVGARPTYLTFDIDCLDPAFAPGTGTPVAGGLSSAQALAIVRALGAVNLVGADVVEVAPAYDHADITAIAAAHVACDLLCLWRQKKVAGALK

SEQ ID NO: 26241 - protein, 466 aa, Burkholderia cepacia R18194
MSTFDNVVAGRATMEAAASTPGAIIARLERLPANAMQIRARVLIGAATFFDGFDVITIAATLPLLIHKWGLSPTQIGLLIASGAIGQLIGAFLFPALAEKHGRVKAIAWSSAVIGITSIACGFAPTFEIFVLLRILQGLGLGGELPVAATYINEITRAHGRGRFVLLYEIVFPIGLLVSMGLGAWLVPRFGWEIMYFVGGLPLILSLVLTRLVPESPRWLASRGRLPEAGRAVGVFEASVRGELPPVTQAAAFDEMVRQHPKRKMSDLFSAAYRKRTLAVATLWATCGFIQYGLSTWLPTIYKNFYHAPLQLALNLAVIGSVMGVLGSLASALLVDKLGRKPVIVWSFVLCAVSLAFAGIYHASSVYVVSIFCSLSLGLMASGFITAYVYTPEQYPTSIRASGCGLGSAWLKIASFVAPMVVPHAIIGGNLAPAFYLIGIVPLIAAVTVHFVGIETKGKVLEALEA

SEQ ID NO: 26242 - protein, 414 aa, Burkholderia cepacia R18194
MSEETAQEQAAPGTVVVIGGGQAAGWVLKTLRAEGFAGRLVMIADEPHLPYERPPLSKAVLAGDADIETVRVVRPDEFDALNVEAWQPERAASIDRARRVVTTESGREIEYDRLVIATGGTSRRLPDALVKTQNLHYLRTLDEAAALGEKLRASQRVLVIGGGWIGLEVAATARKLGVDAVVVEGAPRLCGRSVPRIVSDFLLDLHRANGVDVRLGAALASLDAQPDDASKVRATLADGTTIDADFAVAGIGLALNASLASDAGLAIDDGIVVDEFGATSDPAIFACGDVANHHNGWLKRRVRLESWANAQNQAIAAGKAVLGVRAPYAEIPWFWSDQYDVNLQILGDLPADAQLVVRGDLAARRATLFFVGEGHVRGVIAVNNARELKLARKWMNQGRAVDTEALADTTKTLA

SEQ ID NO: 26243 - protein, 496 aa, Burkholderia cepacia R18194
MTPFDTSLVPDGNILIGGEWRRGRGTPFASIYPADQSVNMEVSTANAEDAAEAVVAADAAWRRADWAGLKPHQRAQVLYRIADLIMQRHEALANLQRRDNGKPIGETRVLVASAANTFRYFAACLETLDEELTPSRGDYLTMSVYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAAEKLMPVSLELGGKSPTIVCDDADLDHAVNGVLYGIFSSSGEACIAGSRLFVQRAVYDEFMTRLVAGARKLRVGDPTRPDTQMGPLITAKHRESVERYVALGLEEGGRLLCGGERPSGDGRENGFFYQPTILEGLPNSARICQEEIFGPVLVAMPFDDEASLIAQANDSVFGLAAGIWTRDYKRAWRIARALETGTVWINTYKLFSISTPFSGWKESGMGREKGRLGIREYMQQKSLYWGLNDAPLPWAN

SEQ ID NO: 26244 - protein, 373 aa, Burkholderia cepacia R18194
MTTDSFLSPPRAPARPTLFDPIELGRITLRNRIVMAPMTRSRAGAGDAPGPMNATYYAQRASAGLIVTEGTQISPPGKGYPFTPGIYSDAQIAGWKQVTDAVHREGGRIFVQLAHVGRIGHPDLQPDGALPVAPSPIRPDGDAYTPTGPQPYPVPRALETAELPAIVGQYVLATRAAFQAGFDGVEIHAGNGYLLDQFLRDGTNRRTDDYGGTIDNRLRLPLEVARAVSLVSGPDRLGIRISPVTPHFGGIADSDPQALFERFADRLSGLAVYLHVVEGIPQVAPDAAPAFDYDALRHAFAGHYIANNGYTKTRAETALSDGHADLVSFGYPFIANPDFAERLRHDRPLAHADMSMAYGGGEAGYTDYPPFRA

SEQ ID NO: 26245 - protein, 357 aa, Burkholderia cepacia R18194
MSQLFTPVRVGRYTLENRLVMAPMTRSRAAFDGTPGEWAAEYYAQRSSLGLIVSEGTQPSDDGQGYLTTPGIYTDAHVAGWKAISDRVHARGGRLFIQLMHVGRMSHPDNTPHHRQAVAPSAIAPNAPMFTMKGMLDIPAPRALTLDEVRETVNDFRIAARRAIEAGADGVEIHGANGYLIQQFFAPNANTRTDAYGGSIDNRARFAIEVATAIADEIGADRTALRVSPGNTLGGLDEGTEGPDLYRHLATELDRLGLAYLHVMHQGDEALLADLRSRWNGTLILNRPGRARDAIGDDLKSGLADLEAYGQMVLANPDFVTRVKTGAPMNDARRETFFGGDARGYVDYPALGGVAAA

SEQ ID NO: 26246 - protein, 443 aa, Burkholderia cepacia R18194
MPARAPANWLERRFALAARGTSVRTETIAGVTSFLAAAYLLVVIPSLLATGGMERGAATTATILVFVLFTTLMGLYANLPFLVGPGIGGSVIIGVTLATTEHVGWQTGLGIACVSGVLFFLLTILGARGVVVRLIPVQIKLGLGASIGLFVTMLGLRNAGMVVANAKTNAFALGDFSRPGALVALIGLAVAIVLQARKVPGAILIAILVAAAAGVPLGVTHLPASFVSLPHSIAPIAFKLDIGSALSLAAAPYLFAFFAAEFFSTLGTALAVGAKANLLDEQGNLPNINRPFLVDSLAATIGPVFGIPALTALIESAAGVEAGGRSGLSSLAAAVLFAAMLLFVPVALAIPKEATAPALILIGLSMFATIRHTHFDDFTDALPVMSMVLLTLMSNSFGTGIAGGLLCYVLVKLLAGRWRDVSWGLVVLALPLGYYFWTVVKPH

SEQ ID NO: 26247 - protein, 472 aa, Burkholderia cepacia R18194
MASTDSLSKAPAQSSPVDPGSISARLDRLPPTRTVWKLVVLLSLGFFFELYDLLYSGYVAPGLVKSGILSATTHGLFGTTGVASFIAALFSGLFIGTIACGFLADRFGRRAIFTWSLLWYTAANVVMAFQDTAAGLNFWRFVVGLGLGVEMVTIGTYISELVPKQIRGRAFACEQAVGFVAVPVVAFLAYLLVPHAPFGLDGWRWVVLIGAHGALFVWWIRRELPESPRWLAQQGRVDEADRIMRALEAKVEAEYGRPLPPPAPAEPVPPRGSFRDMWVPPYRSRTIMMTIFNVFQTVGFYGFANWVPTLLIKQGITITSSLMYSSVIALAAPIGPLIGLVIADRFERKSVIVAMAAAIVVCGLLFSQTTVGAFLIVLGIGLTLASNIMSYSFHAYQAELFPTSIRARAVGFVYSWSRFSAIFSSFVIAAVLKGFGTFGVFAFIAGAMVIVMAAIGFMGPRTKGIALETISK

SEQ ID NO: 26248 - protein, 494 aa, Burkholderia cepacia R18194
MIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 26249 - protein, 318 aa, Burkholderia cepacia R18194
MNDHTHFQPLGGNEMPRCGGIATMMRLPHVASAEGLDACFVGVPFDLGTSNRTGARFGPRQIRTESVLLRPYNMATRAAPFDSLQIADIGDVAINPYNLHDSIARIEAAYDAILEHDCKPITLGGDHTIALPILRAIHRKHGKVALIHVDAHADVNDTMMGEKIAHGTPFRRAVEEGLLHGDKVTQIGLRGTGYAAEDFDWCREQGFRVVQAEECWNKSLAPLMEEVRARVGDTPVYISFDIDGIDPAYAPGTGTPEIAGLTVPQALEIIRGAKGLNIVGCDLVEVAPPYDPFGTTALLGANLAYELLCVLPGVAYRD

SEQ ID NO: 26250 - protein, 432 aa, Burkholderia cepacia R18194
MPVAVAGDGIEIIDSTGKRYIDACGGAAVSCLGHSNQRVIDAIKRQAQQLAYAHTSFFTTDVAEELADRLVAAAPAGLEHVYFVSGGSEAVEAALKLARQYFVEKGEPQRRHFIARRQSYHGNTLGALAIGGNAWRREPFLPLLIEAHHVSPCFAYRDQQAGETDEAYAQRLADELEQKIVELGADNVAAFVAETVVGATAGAVPPVRTYLKKIRAVCDKYGVLLILDEIMSGMGRTGYLYACDEDGVAPDLLTIAKGLGAGYQPIGATLVSDRIYRTIVDGSGFFQHGHTYLGHATACAAALEVQRVIAEEKLLDNVKARGEQLRASLRDHYGAHPHIGDVRGRGLFVGVELVRDRDSKATFDPALKLHAAVKREAMQRGLMVYPMGGTIDGVHGDHILVAPPFICTAQQIDTIVERLSGAIGAALASAGA

SEQ ID NO: 26251 - protein, 503 aa, Burkholderia cepacia R18194
MTHNSERPADPAGGADSRHADPDAMFASHEAGYAKQLKPRHVQMIAMGGAIGTGLFLGAGGRLQHAGPALALVYLVCGVFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLAVFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGAPYGGILITVAINAIGVPLNYIVPAQAFEIVLNMASLGIITTWGFIVMCQILFRRAVDRGELKAVSFRMPGAPFTSWLTLAFLVGVLVLMAFDYPGGTWTIATIPVVVLALVVGWKLAKRGAAREQVADARASAATHAVADPARGA

SEQ ID NO: 26252 - protein, 456 aa, Burkholderia cepacia R18194
MTMIALGGVIGAGLFVGSGVVIQQTGPAAILSFLITGGLVVLVMRMLGEMACAMPAVGSFYEYARLAFGNWRGPGKMAGFLTGWMYWYFWVIVVALEAVAGAKLIQFWLPDTPAWIISLALLVVLTLTNLISVGSYGEFEFWFSSIKVGAIIVFLFLGGLYVLGLWPASMHTTSVLPTLLGHGGFMPLGIGPVMSGAVAATGFYFGAEIVTIAAAEAKEPAKAVAKATNSVITRVLVFYVGSVALVVALVPWNSHQMATPYVSALEVMGLPAAANVMNAIVLTAVLSALNSGLYAASRMLFALTRHGDAPAALAKVNKRGVPVRAILLGTVFGYVSVVMSYVSPDTVFAFLVNSYGTVALFVYVLIAFSQLRLRKRLDPVAASKLRVKMWAYPYLTWVAIIGMVGILVAMAFIPDQRKPLWLGVASLGVLVVAYGLTRRSRREHLDDSELLAYPPR

SEQ ID NO: 26253 - protein, 487 aa, Burkholderia cepacia R18194
MHIKQLYIDGAWQPAAAGGQRAIIDPATGEAIARVAYGSAADAGHAIRAARAAFDAGEWPHLPAEERAACLRRLANALRDEAPALARIETANTGKTLAESSSDVHDAASAFDYFASLAVTETGSMNAAKPHVISVTLREPVGVCGLITPWNYPLLQAAWKLAPALVAGNTVVVKPASLTPLSTHRLVELAHDAGLPRGVLNLVTGGADVGDALAASPQVDLISLTGSNAAGASVMRAAAGNFKRVSLELGGKNPNLVFADADVDTALDYALNAAFFNAGQMCSAGSRLLVERTLHDAFVDALAARIAAIRVGRGDDDATRMGPVISAQQRDRVLALIGEAARDGARIVCGGRAPAGDAFATGFWVEPTLIAGVRTTMAIAREEVFGPVLTVEAFDSEDEAVALANDTPFGLAGAVWTRDFARANRVMRRLRAATVWINDYNVTLPGAPWGGYKASGIGRELSRSGLDEYTELKHAYLNFEASPQRWF

SEQ ID NO: 26254 - protein, 473 aa, Burkholderia cepacia R18194
MPAATAPASAAARLERLPFSGYHKRIFFIIAIAFFFDSVDLGTMTFVLGSIRKEFGLSTAAAGLVASASFFGMVLGAAVAGLLADRFGRRPVFQWSMVLWGAASYLCSTAQSVDALIVYRVLLGIGMGMEFPVAQTLLSEFVPTEKRGRLIALMDGFWPLGFITAGIVAYFVLPQFGWRTVFALLAIPAVFVLVVRRIVPESPRWLEHAGRHAEADTVMHTIEAKVMRSAGVTTLPAPSRLAEPVVARGRGALREIWSGAYRRRTVMVWLLWFFALLGFYGLTSWLGALLQQAGFEVTKSVFYTVLISLGGVPGFLCAAWLVERWGRKPTCIASLIGGGVMAFAYGQSALYGGSMALLIGTGLAMQFFLFGMWAALYTYTPELYGTGARATGSGFASAIGRVGSLIGPYVVGVVLPVFGQGGVFTLGALSFVAAAVAVWTLGIETKGLALEQLAAGDEAGGGGRYAAAADKVS

SEQ ID NO: 26255 - protein, 489 aa, Burkholderia cepacia R18194
MSVFGLQRLYIGGGYVDATSGKTFDTFDPATGELLAQVQQASAADVDRAVASAQEGQREWAAMTAMQRSRILRRAVDLLRERNDELAALETRDTGKPIGETLAVDIVTGADVIEYYAGLATAIEGLQVPLRAESFVYTRREPLGVCAGIGAWNYPIQIACWKTAPALAAGNAMVFKPSEVTPLTALKLAEIYTEAGVPAGVFNVVQGDGSVGALLTGHPDIAKVSFTGGVETGKKVMSLAGASSLKEVTMELGGKSPLIVFDDADLDRAADIAVTANFFSSGQVCTNGTRVFVHRSIKDAFTQRVLERVKRIRVGKPTDADTNFGPLVSAAQLDKVLGFIESGKAEGAKLLAGGTRLTDGHFGSGQYVAPTVFGDCRDDMKIVREEIFGPVMSILDFESEDEVIARANDTHYGLAAGVVTENLSRAHRTIHRLEAGICWINTWGESPAEMPVGGYKQSGVGRENGITTLEHYTRIKSVQVELGRYNPVF

SEQ ID NO: 26256 - protein, 340 aa, Burkholderia cepacia R18194
MSTESALQATIQALVQDGKGLLAADESGPTIAKRFKTIAVESTEENRRAWRTLLLSTPGLGEFVSGVILYEETLGQCADDGTPLPELAARQQIVPGIKVDAGKIPLALAPGDEITQGLDGLAARLDGYQRQGARFAKWRAVYNVSATLPGHAAIQANAEALARYAAICQEAGVVPIVEPEVLMDGDHSIGRCAQVTDAVLHAVFDALHRHRVVLAHMLLKPSMVVAGSTHTAQPAPAEVAEATVRLLRSAVPAEVPGIFFLSGGQTPEEATAHLDAMNRVAGRPWLLSFSYGRALQEPPLAAWQGQAANVRAAQDALLLRARLNGAACRGQYDAAMERTP

SEQ ID NO: 26257 - protein, 501 aa, Burkholderia cepacia R18194
METNEHFPLLDATRAFLAKPKKMLIGAEWSDAASGRQLDVVNPADGTVLARVPEADAHDVQQAVAAARRAFDAGPWRTAKTTDRERLLLTLADLIEANARELAEIESLDNGKPVMVAQGLDVAMAAQCFRYMAGWATKIEGSVIDAGMPYMPDSEIFTYTRKEPVGVVGAIIPWNFPLLMAAWKLAPALATGCTVVLKPAEDTPLSALRLGELIREAGFPDGVVNIVTGYGHTAGAALSSDPRIDKIAFTGSTQTGKTIGHAALDNMTRMSLELGGKSPVIVLPDVDPDKAALGVANAIFFNQGQVCTAGSRAYIHAKVFDDVIERVAKIAASLKIGPGMDPSTQIGPLVSAKQRQRVCGYIDSGFGEGARAAAGGRAVDGPGFFVEPTVLVDTTQAMRVVREEIFGPVLVAMPFDDVDTAVQLANDTPYGLGASIWSNDLSAIHKLIPRIAAGTVWVNCHSLLDNAMPFGGMKQSGFGRELGRAVIDQYTESKSVMMNYA

SEQ ID NO: 26258 - protein, 318 aa, Burkholderia cepacia R18194
MLEPEIAAFVAAVDAWYPADAAARSPGEQRRLYDRFAAEWTPAALPAGIVQQDAVWHAPDGHKIALRRYTSAHGTPRGTVLFFHGGGFVVGSLDSHALITAQLAADTGLDVIAVDYRLAPEHRAPAALEDCLDVTRAARDARWPFGPCVHPLTLAGDSAGGMLAAAVVTALRDAGEGGIDGIALVYPMLGFEPQSPARETEAHAPMLTLDDVHRYRALYWEGGLSDALGDGNPLLHASVPLAASRFDGLPPVLAIGAEHDPLRDDARVYVERIRAARGVAHYWMGEGLVHGCWRALGTSPQAALMHRTVGGFLLAPHA

SEQ ID NO: 26259 - protein, 332 aa, Burkholderia cepacia R18194
MEADMHAWSARHVPAQGGKVAVVTGANSGLGWQLAETLAAKGATVVMGCRDAARAAQAADAIRRLHPDARVEVDPLDLADLASIARFAADVAERHGRVDILCNNAGVMFLPLRHTHDGFEMQFGTNHLGHFALTGHLLPALRAARRARVVTMSSGLNRGGRIRVDDLRAEHRYNRYLAYCDSKLANLVFAIELQRRFERAAFAGISVAAHPGYAATNLQFAGPAMDSSPARAALMRAANRYLAQPADQGALPAIHAATSPDLAGGAYIGPSGLFESRGLPAPASVPRAARDVASAALLWEASEAATGVRFLSSGAPAGRSPGRPFDTAAEVR

SEQ ID NO: 26260 - protein, 433 aa, Burkholderia cepacia R18194
MSLNDDPTFWRNARQHLVRYGGTFEPLIIERAKGSFVYDADGRAILDFTSGQMSAVLGHSHPEIVSVIGEYAGKLDHLFSGMLSRPVVDLATRLADVTPAGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPEGYMAALKRKCEERGMLLILDEAQTGVGRTGTMFACQHDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEAEIDLGLSLLEQAIRRAL

SEQ ID NO: 26261 - protein, 427 aa, Burkholderia cepacia R18194
MSRAWFALAVLALAAILGITDRQMLTLAVEPLKRDLQLSDTSLGAIVGFGPILFGALASPLLGWLTDRVDRRWLLVACVLVWSAGTALCGLVTQGWMLFLCTLTLAVGEAGLGPVVYSMLPDLFPPSLRTAANTIFFAVALFGAGLGIAGAGAIFSVAAPLAHTLSIEPWRLAFLLVAIPGPVVAGLFALVGHPPRGGTADAHARAQETLAHYWRRSGRMLTCLVVGYAMAAFYVGAILGWAPVSLIRDFHVDVARSGLYSGIAVGGGSALGLLVSVLAVRCLRARWGRLLPVVIGCAMALLAALLLLTMSFATSTAMLLACMIGIIAAYIAGAALTPTLLQDIAPPHLRGRVVGTSSLVTYAFQAMSVPSVGAISDALDGTPYALIKGIVWLGVPAAVFSVILLGLVLRTFRTRFEPPCEVGAQAL

SEQ ID NO: 26262 - protein, 433 aa, Burkholderia cepacia R18194
MESIKRYFGFAEAGTDFRTEILAGVTTFLTMAYIIFVNPAILGDAGMPKESVFVATCLVAALASLIMGLYANYPIACAPGMGLNAYFAYTVVKGMGFTWQAALGAVFISGCLFLLVTLFRVREAIVNGIPKSLRISITAGIGLFLGIISLKTSGVIVGNPATLVTLGDLHKHDTILAIVGFFTIVTLDHLRVRGAILIGIIGVTILSFFFGDNQFHGVFSAPPSIDATLFKLDIRAALSTGIINVILVFFLVELFDATGTLMGVANRAGLLVEGKMNRLNKALLADSTAIVAGSVLGTSSTTAYIESASGVQAGGRTGVTAITVAVLFLACLFIAPLAGVVPAYATAPALLYVSCLMLREMVEVPWDDATEAVPAALTALLMPFTYSIANGVAFGFIAYGGLKLLTGQARSVKPIVWLIAAVFLFRFFYLGSE

SEQ ID NO: 26263 - protein, 368 aa, Burkholderia cepacia R18194
MKTKAAIAWKAGAPLTIEEVDLEGPRAGEVLIEVKATGICHTDYYTLSGADPEGIFPAILGHEGAGVVVDVGPGVGTLRKGDHVIPLYTPECRECKFCLSRKTNLCQKIRATQGKGLMPDATSRFSLDGKPLFHYMGTSTFSNYIVVPEIAVAKVREDAPFDKICYIGCGVTTGVGAVVYSAKVEAGANVVVFGLGGIGLNVIQGAKMVGADKIIGVDINPKRVELAKKFGMTHFINPNEVENVVDHIVQLTDGGADYSFECVGNVKLMRQALECTHKGWGQSFIIGVAAAGEEISTRPFQLVTGREWKGSAFGGARGRTDVPKIVDWYMEGKINIDDLITHTLPLERINEGFDLMKAGESIRSVVLY

SEQ ID NO: 26264 - protein, 452 aa, Burkholderia cepacia R18194
MQAPPEEFAYTLLLSPDFSRPDALAVIDVKPGSSTYGKIVHTVTMPTTGDEFHHFGWNACSSSLSPLTGHAFLERRFLIIPGLRSSRIYVIDTKPHPTQARIHKIIEPDEIFSKTGYSRPHTVHCGPEGIYVSTLGGAGEDGTDGAPGIFIMDCETFDVLGRWEIDRGPQDKHYDFWWNLPRDYMVSSEWALPPQFENGIVPEDLLANKYGHRLHFWDLRARRNVQTIDLGAQHQMALEVRPAHDPAREYGFVGVVVDTTNLEGSIWTWWREGGKFHVKKTATIPAEPAAADELPPLLKGFGAVPPLVTDIDLSLDDRFLYVSCWGTGEMRQYDVSDPHHPVLAGSVRIGGIVRRAPHSNGRTFAGGPQMVEISRDGKRVYWTNSLYSTWDDQFYPDGVPGAQVLAHVGPEGGLKLADDYWVEFPDGYRAHQIRLEGGDCSTDSFCYPSVKR

SEQ ID NO: 26265 - protein, 220 aa, Burkholderia cepacia R18194
MRLILLGAPGAGKGTQANFIKEKFGIPQISTGDMLRAAVKAGTPLGVEAKGYMDAGKLVPDALIIGLVKERLKESDCANGYLFDGFPRTIAQADAMKEAGVAIDYVLEIDVPFSEIIERMSGRRTHPASGRTYHVKFNPPKVEGHDDVTGEPLIQRDDDKEETVKKRLEVYEAQTKPLITYYGDWAQRGEENGLKAPQYRKISGLGSVEEIRERAFGALK

SEQ ID NO: 26266 - protein, 468 aa, Burkholderia cepacia R18194
MVVQGSGNAVTQQQRSFDDIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGTVEYAFSLLKIAAIVVFIVLGAYLVWSAPAASGVGFANYTAHGGFMPKGPWGTWVAVIVAIFSYMSIEAVAIAAGEARDPQHAVTRAFRSTVFRLVLFYLLTLSLMLAIVPWTQAGTDESPFVKVMAATHVPYAAGVINFVLLIAALSAMNSQLYVTTRMMFSLSRARLAPAVFGRLGTNGVPRAALWISTSGVAVAAVLVALAPDTAFTVMMAIAMFGALFTWLMIFVTHLRFRSRYRGPALAFRMWGHPFGSLLGAGLVAAILFTTAFTREFRMTMVVGVVFAVLLTLAYALHYRHQHAR

SEQ ID NO: 26267 - protein, 394 aa, Burkholderia cepacia R18194
MPLNDYPIDSLMYITNRPDIVFTHGKGSWLYDHTGKRYLDFIQGWAVNSLGHCNEGIVEALKTQAEKLLNPSPAFYNEPMAKLAGLLTQHSVFDKVFFTNSGAEANEGAIKLARKWGRKFKNGAYEIITFDHSFHGRTLATMSASGKPGWDTIYAPQVPGFPKAELNDINSVEKLITDKTVAVMLEPIQGEGGVIPATREFMQALRALTKQHNLLLIVDEVQSGCGRAGTLFAYELSGIEPDVMTLAKGIGGGAPLGALLSKAEFAVFEAGDQGGTYNGNPLMTAVGYSVISQLVAPGFLEGVRARSEYLKRKLLELSEERGFEGERGEGLLRALLLGKDIGPQIVEKARDMQPDGLLLNAARPNLLRFMPALNVTTEEIDQMMAMLRSILDTL

SEQ ID NO: 26268 - protein, 479 aa, Burkholderia cepacia R18194
MEEAKHFIAGEWTLPAQLETIAVVDPSDGQPFASIARGTAPDIERAVAAARDAFAGPWGAASAAERGRVLMRLSARVAGSIEELAAIEARDTGKPLKQARADAAALARYFEFYAGAADKLHGETLPYQAGYTVLTVREPHGVTGHIVPWNYPMQIFGRSVGAALAAGNACVVKPAEDACLSLLRVAELAVEAGLPAGALNIVTGYGHEAGAALARHPGIDHISFTGSPATGKLVTQMAAENHVPVTLELGGKSPQIVFADADLEAALPVLVSAIVQNGGQTCSAGSRVLIERAVYEPLVERLATAFNGLRVGPSRADLDCGPLINAKQQQRVWDFLSDAQHDGIPMAAHGQVVADAPESGFYQAPALLRDVPPSHRLAQEEVFGPVLAAMRFVDEDEAVALANGTPYGLVAGIWTRDGARQMRLARRLRAGQVFINNYGAGGGVELPFGGVGHSGHGREKGFEALYGFTMLKTIAIRHG

SEQ ID NO: 26269 - protein, 481 aa, Burkholderia cepacia R18194
MVPRTLAHIGGCSVPARSGRTFAAINPATEAVIAEVASCDAPDVDDAVRAARHAFESGAWSRCAPAERKRVLCRLGELIASHGAELALLDSLNMGKRVADAFSIDVPAAGGLFSWYGEAVDKLHGEVASTDPGNLAVVTREPLGVVGAVVPWNFPLDMVAWKVAPALAAGNSVVLKPAEQSPLSALRLAELALEAGLPPGVLNVVPGYGETAGRALGLHPDVDVLAFTGSTAVGKKFLEYAAQSNMKQVWLECGGKSPNLVFDDTDDLDLAARKACFGIFFNQGEVCSANSRLLVQRSIHDAFVDRLIAHAAAFMPGDPLDPSSGMGAIVDEQQHRRVREWIARGRDSATLAIGGGAPRVDGKGYFIEPTIFIDVKHDDAIAREEIFGPVLSVMAFDTEDEAVRLANDSIYGLAASLWTGSLSRAHRVSGRLRAGTVSVNTVDALSAQTPFGGFRQSGFGRDLSLHAIDKYTGLKTTWISY

SEQ ID NO: 26270 - protein, 463 aa, Burkholderia cepacia R18194
MNAPNFPHRTTQDYQRSDAAHHLHAFVDQKALNEEGARVMVRGEGVHLWDNDGNRYLDGMSGLWCTNVGYGRPELVDAAARQMKELSYYNMFFHTTHPSVIELSERLFALLGNRFSHVVYTNSGSESNEVLIRTVRRFWDVMGKPEKKVLIGRVNGYHGSTVGSASLGGMAFMHEMGDLPIPNITHVDEPYWYANGGDLSPEAFGKQAALSLERKILEIGADRVAAFVAEPFQGAGGMIFPPDGYWQEIERICRQYDVLLCADEVIGGFGRTGEWFAHRHFGFEPDLICVAKGLTSGYVPMGGLIMSRRVGDALVDKGGVYAHGLTYSGHPVAAAVALANLDVLEREGLVERTKTDTGPYLQKALRDAFGSHPLVGEVQGVGAVGAIQFAKNKATRERFANEADLTWHSRTVGFELGAIVRSTNGRLIVAPPLVIDHAQIDELVDTMRKAVDATAREVLGIDC

SEQ ID NO: 26271 - protein, 445 aa, Burkholderia cepacia R18194
MTTKPTGDIAAHRLSSTQLSCEFADIAPLLDPTAAAAAASRCHYCYDAPCVQACPTQIDIPSFIRKIGNGNLKGAATDILSANPLGGMCARVCPTEILCEGACVRNHQDAQPVAIGALQRHATDWAMETGAVRFTRAPDTGRHVVVVGAGPAGLACAHRLALAGHRVTLFDARPKGGGLNEYGIAAYKTVDDFAQREVEWLLSVGGITLKTGVALGHDITLDALREQHDAVFLAMGLGGVRALSIDGEQLGGVMNAVDFIVQVRQADALENVAVGRRVVVIGGGNTAIDAAVQSRKLGAERVTMVYRRGVDAMSATWAEREFAQKSGVTLVTHAKPVRMAGENGQVTGVEFEAASGERFTVDADMVLKAIGQTLVPDAIDAALLTADGARIAVDADGHTAWPDVWAGGDCAATGGVDLTVQAVQDGKRAAASIDATLAQRDAKAA

SEQ ID NO: 26272 - protein, 490 aa, Burkholderia cepacia R18194
MNTTPDLAFDPPLHTRHFIDGAWRASVDGATLPVVDPSTEAVLADVSAGSEADVEHAVQAASRAYPGWKRTTGAMRAALLRAIARGVDARRTRLATLQSLNNGKPLAEAEIDVADVIATFDYYAGLAERLDTDGETEIALPDADHRAWIRREPAGVAALIVPWNFPMVTTAWKLAPALAAGCTVVLKPSEITPLPELELAAIAAEAGLPPGVLNVVTGTGHDVGARLCAHPRVAKVSFTGSTAVGAQVMKTAADTIKGVGLELGGKSSIVVFDDADLDHAVELVTGGGLFNAGQMCSATSRVLVAASLADDLIARLAQRIDATVVGPPFAPGVQMGPLTNRAQYERVQRHIAQGRADGARLVTGGNALDGPGYFIRPALFADVPADSSLWCEEIFGPVLCVRAFDTEDEAIAAANDTEYGLVATVVTRDTARARRVADALEAGVVWINTPQLIYPQTSWGGYKRSSIGRELGPFGLAAFQEIKQVMMPAG

SEQ ID NO: 26273 - protein, 503 aa, Burkholderia cepacia R18194
MLNESLATTDHAPLRRYEHLYIDGAWVKPIDGELAESIDPATGQPWAIAPMGGPQDIDRAVEAARTAFHGTWRSTPGHVRAALLRRLADLFSAAIPELAIIESRDNGNLVREHRASLTAQVQWYQWFASLADKAQGATIPIDDSVHAFTTRVPIGVVGAIIPWNAPLLATCLKVGAALAAGCTVVVKPAEQTPVSALELARLVHEAGFPPGVFNVVPGYGRTAGAHLVKHPDVNKISFTGASQTAKHMVRDGADNLKRFTFELGGKAPHILFADADLDNAINAATASAWRLTGQSCALGSRVLVERPIYDRVVEAFRTRAKAVRVGLPSIDSNHMGPQSHETQLAKTLSYVDAGKQDGAELVTGGRRITTPELAAGYFVEPTVFAGVTNQMRIAREEIFGPIASLIPFDGEDEAIAIANDTPYGLTAGLWTRDVGRAHRVSNRIDAGMVWVNTYSFLRWSTPYGGFKASGWGRENGIDALDPYLETRTTVISTTGQFPNLYED

SEQ ID NO: 26274 - protein, 502 aa, Burkholderia cepacia R18194
MLVDELHSRKNEVIDPSALRARLRDGALLETRAWLASGWQEGTDGRSFPVTNPATGDILARVASLGAAEVEQAIESSALAQQGWQKRTSHERAKLLRAWFDLILANADDLALIMTSEQGKPLAEARGEITYAASFVEWFAEEAKRVYGDVMPHPQGDKRILVIRQPIGVCAAITPWNFPAAMITRKVAPALAAGCSIIVRPADLTPLTALALAVLAERAGIPAGVLQVVCGPSREIGAVLTASPVVRKLSFTGSTEVGRVLMSQSSGTIKRLSLELGGNAPFIVFDDADLDAAIEGAMASKYRNSGQTCVCANRFLVQAGIHDRFVEALTRRVQALKVGNGIEPGVQQGPLIQKSACDHLNQLIDDAVSKGARIVTGGKGHPLGGTFFEPTVIADATPAMRLAREELFGPVGPVFRFDDEAEAIAMANDTEYGLAAYLYTRDNSRIWRVGEALEYGMVGLNTGVISNEVAPFGGVKQSGLGREGSRYGIEEYLEIKYMCSQV

SEQ ID NO: 26275 - protein, 324 aa, Burkholderia cepacia R18194
MHWLPLTEVADDARDAVRAFRELGGRHYGSFSVDQSRVNFVRACELNGLTGDEAVVHEDIDVPVAGGSIRVRLYRPPAGASADGNPLVVFIHGGGWVIGSVDTHDGICRHLARHGGCAVASVEYRLSPEHRWPVPLEDCEQALDYLTANAAALSINASRVILAGDSAGGNMATLIANAASVAGPAIIGQVLFYPVTDLTASLPSYRRIQGGFPLVAESMLWFREHYVPDGTPFDLPRLSPLLHAEGRRQPPMFMATVGLDPLCDEGIAYASCAARAGSQVEHHHLPGHHHGIVTAARAIPAARYLLDRAASFVRRLAEKDGCDA

SEQ ID NO: 26276 - protein, 283 aa, Burkholderia cepacia R18194
MQHLARAVRAPEAVVDVHGVEDLTVPGATGSLRARLYRPTQERNLPTVVYLHGGGFVIGDLDTHDNICRELARGANAVVVSVDYRLAPEHPYPAAADDAIAATKWVIANAGELGGSDVVAVAGDSAGGNLAAVVTQQLHADGISLSAQFLIYPAVAQDRAGFPSFKENGEGYFLDLETIAWFERHYVLDGTDREDPRLAPIRAKDLAGLPPAVILTAEFDPLRDEGEAYGRLLHASGVKVDTIRCDGMIHGFFDMGAISPGAQAWIEKGIASFRKVLGGAQHH

SEQ ID NO: 26277 - protein, 486 aa, Burkholderia cepacia R18194
MPIFEAEHLRKAFIGGRWVAPANGGVEHDIINPATGEVSGVLLFSDEADVNLAAEAARDAFAAFSNTPLVERLKLLERVIGAYTERLQDMADAITLEMGAPMDAISRPLQAALGLWHLHTTLEVAKQYPFERTQGTSRIVKEPVGVCGLITPWNWPMNQVMCKVAPALVAGCTIVLKPSQNAPYSAIVLAEILEKAGVPPGVFNLVQGAGQRLGRAIASSPLFDMVSLTGSTSAGVEVAQAAATTIKRVTLELGGKSANIILDSENFQQGVTHGVLQMMANSGQTCTAPSRMLVPAHRLEEAEQIAVAACGQVVVGDPRDPGTTMGPMANQRQHQKVQEMIRVGIDEGAMLLSGGLGNPSGLERGYYVKPTVFSRVNNRMKIATEEIFGPVLVIIPYRDESDAVTIANDSPYGLSGYVYGDSIEQAERVARKLRTGMVHLNGAAVDIAAPFGGYKQSGNGREWGYAGIEEFLETKSMFGATPGAVS

SEQ ID NO: 26278 - protein, 422 aa, Burkholderia cepacia R18194
MDRLAKKNEWFARAEKVIPGGMYGHQSVKYLTEDFPLYFAKAKGTHLWDVDGNKYIDYVCGYGTNLFGYGNERIEQAAALQLQKIDTATGPSEVMVQLAEALTQQVSHADWAMFCKNGSDATSMAMVISRAYREKRKILVARGTYHGASPWNVPYTTGITKEDRAHIVYFEYNDIESLNAAVKSVDGDVAAIYATPFRHEVLYDQFFPSIEYAKECRRLADEQEALLVVDEVRTGLRLSRDCSWSDWGVHPDLSCWGKAIGGGYAIAAVLGSDKAREAATNVFVTGSYWLSAVPMAAAIETLRLVRETDYLEHTKRLADKLRAGIAEQAERHGFELKQTGPSVMPQMLFAGDDELVSRGRAWASEVIKNGAYLHPWHNMFFTASHTDDDIARTLEATEVAFGAIKQKAVAVSRLDILDTVQR

SEQ ID NO: 26279 - protein, 462 aa, Burkholderia cepacia R18194
MMPNVLQYPISICAVLRAGYAVVNVNPLYTPRELQHQLNDSGAEAIVILDGCTATLDAIIAHTQVKHVLVAAQGNAAAAEQTPSPHVKFDDAIEEGRRGKFVLASPSPDDVAFLQYTGGTTGVSKGATLLHRNIVANVLQTDVWLKPARDWRPDVTQFITVAALPIYHIFALNVCCLLTMHTGGLCVLVPNPRDIGGMIQSLAGYKVTSFPGVNTLFNAMLHHPEFSRLDLSNLLLANGGGMATQEAVARRWKEMTGAPIIDGYGLSETSPCVAINPVAGREFNGTIGLPLPSTEVSIRDDDGKELPPGAAGELCIRGPQVMAGYWQRPDETAKVMTADGFFRSGDIASISEDGFVRIVDRKKDMILVSGFNVYPNEIEEVVANHPGVFEVAVIGVPDEHSGEAVKLFVVRKDPELTFDDLMAFCKGQLTGYKRPKSIEFRDSLPKSNVGKILRRELRVPNN

SEQ ID NO: 26280 - protein, 473 aa, Burkholderia cepacia R18194
MHQGYPTDLAARFERQRRAFALELNPALATRLARLDRLAAWLDAHEHDIVRAIDADFQGRSTHETRLAEVFIVRAGLRHARRHLKHWMRARRVPTALHFRPGHNRLMPQPLGVTGIISPWNYPLQLSLGPALAALAAGNRVLIKPSELTPALSDLLVSMARDTFAPDELDVVVGDVELGKAFAGLPFDHLFFTGSTQVGRVVAQAAAANLTPVTLELGGKSPAILDASCNVAVAAQRIAFGKLLNAGQTCVAPDYLLVPTGTADSVALQLTRAVARLYPTLAANPDYTAIISERHRARLTEMVDEARRAGARILEVNPAGETFGSSSRKFAPTIVIGAPADTRLMNEEIFGPVLPIVEYANLDDALAYIQGRARPLALYWFGEDASRRDRVLRETVSGGVTINDCLWHLVQENQPFGGVGQSGMGAYHGQWGFDTFSKLKPVFHQTRWNGAVLFHPPYGRVFDLLLRTLSRLA

SEQ ID NO: 26281 - protein, 427 aa, Burkholderia cepacia R18194
MILDGYDLAIVGISLPLIMKAMHISPVMAGVIASSSLFGMMVGSILLGSVADRIGRRPAIVLCVLLFSVFSAAAGAVSSAVAFCALRFLAGLGLGGIAPTCAAQMTEYSPRRMRSMLVSLMFAGYSGGGVLAALLGKTLLENYGWRSIYYAAAVPIVLVPVIWRTLPESLSFLVLKGRDADVRRIAQRLMPGEVPRPGDRFAMPKEEAGPTRLLGALFSEGRAFSTLMFWVTCITNLFMVYGLSSWLTKLMASAGYSLGSALTFVMAMNLGAVVGAIGGGWLADRLNIQRVLIGMYLVAAVSIALLGYQAPTAVLYAVVTVAGACTIGTQIVVYAYAGQFYPTNVRSTGVGWAAGIGRLGAMFGPILIGVIVGLALPLRFNFYAMAIPAVIGALAVALVNDRLSDRIRSRAAHDRAGELGAVGEGSA

SEQ ID NO: 26282 - protein, 494 aa, Burkholderia cepacia R18194
MKSESEHPGLAAALAWCRSGAKQHFIDGKWVPAASGRTMETLNPATADVLAHIAEGDKADVDLAVAAARRAFESSGWRGMSPHARTAVLLRLADAIEQHADELAALETLDNGMPAWFSAAVVKMTVDTFRYYAGWPTKILGTTVPTDPSAFIYTLREPIGVCGQINPWNVPLLLAGVKFGPALACGNTIVAKPSELASLTCLRLVEIFHEAGLPPGVMNVVTGYGQTVGAAISEHPGIDKVAFTGSTAIGKQILLASAGNLKRVTLELGGKSPHIVFPDADLDKALAAAVNGFTRNSGQICSSGTRLFVHRSIHDEFANEVAKLAARLKVGNPFDADTKLGPLISSKQRDRVMSYVAAGNDEGATLLTGGRQACDAGYYVEPTVFSGVSNAMRIAQEEIFGPVVCVIPFDTEEDVIAQGNDSTYGLAGGIWTRDIGRAHRIAAALKGGRIWINTFGETDPVMPFGGYKQSGLGREFGAESIQTYTEAKSVMLRY

SEQ ID NO: 26283 - protein, 299 aa, Burkholderia cepacia R18194
MDIGFLGLGKMGAPMAERLLGQACRLHVYDPSAQAVAPFVDGGAVAHASPRAVADAASIVFACLPNRDVSLAVGLGPDGVVHGSAVRLYVEMSTIGQDMIERIGEGLAQRGIDIVDAPVSGGPSAARAGTLAMLVSGMPSAVEQVSPLLERIGKEVFPMGDRPGMAQIMKIVNNVVMAANLVVCAEGLAMGAKAGLDADRMMRLIDSGSGQSFACSKIMSRAVSGAFDFGAALAVIEKDMALGLAEARLMDVAMPAIERARDVWHAAYEAGRGGEDFTSILRYVEERNGTRVRGRAVPA

SEQ ID NO: 26284 - protein, 510 aa, Burkholderia cepacia R18194
MFTFEQLNESVDIAARALMSRGVGKGDPVGIWLTNRPEFIIAFYAIVKIGAIAVPLNTRYRSDDIRYVVRHAEIKLLFVCERSGPVDYMSLLTEAIPGLSGDRFDGSDAYPALREVVIVEPSNVASPLSWERFLAGADRTTRVELDAVASAVQVSDLALMVFTSGTTGNPKGVLHDHRNLRAVCERAASWPLRHGDTVLNFLPMFHLYGLSEIVMATMTQGIHQVLMSVFDAQRALRLIEQERVTGLHGFETHYADLLKHHEALGTDLRTLKFGTLPAGMENSTAVARVVQERMCPTVTGFGISETWAWVCITTLDDPVEQRCATSGRPMPGIEVRIVDPSSGDVLPNGSVGEIVCRGYNVMRGYFKDTESTRASIDPDGWFHSGDRGMFRSDGYLQFLGRYKEMLKVGGENVSPAAVELELLRLVPAIDQVAVVGFPDERLAEVPVAFVVPKPGMTCTLDDVQARCNGKIASFKIPRHVIEMESLPMTASGKVQRTALKALALRDIAAR

SEQ ID NO: 26285 - protein, 321 aa, Burkholderia cepacia R18194
MTSRQHPLHSGFGAASTANDVLVDLDLDGKTAIVTGGHSGLGLETTRALAQAGATVIVGARNADAAREATRGIAGVEIAALDLADLASVAAFAARFVEARRDVDIVINSAGVMACPETRVGDGLEAQMAVNHLGHYALVNGLWPVLAQGDGARVVAVSSLGHRLSPIRWDDAQFAHGYDKWLAYGQSKTANALFAVQLDALGAPYGVRAYSLHPGKIATPLQRHLTREEMMAQGWVDEHGLPIDPTFKTPAQGAATQVWAATSPRLAGIGGVYCEDCDIAVVTQGNEESGVRPHAIDPEEAARLWAWSAALTGIDAFAVRR

SEQ ID NO: 26286 - protein, 1138 aa, Burkholderia cepacia R18194
MMKREDSLDDVRRAQFPSLAPGGTPRRRRARRRAPALCADDPLWYKDAIIYQVHVKSFYDSNNDGIGDFPGLIAKLDYIAELGVDTIWLLPFYPSPRRDDGYDIADYRDVHPDYGTLADVRRFIREAHARGIRVITELVINHTSDQHPWFQRARRAKPGSTHRDYYVWSDTDTKYAGTRIIFLDTETSNWAHDPVAGQYYWHRFYSHQPDLNFDNPAVVREVMQVMRFWLDLGIDGLRLDAVPYLVAREGTNNENLPETHAILKRIRATIDAEYPNRMLLAEANQWPEDVQEYFGDEDECHMAFHFPLMPRIYMSIASEDRFPIVDIMRQTPELAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAVNVEAQTRDPHSLLNWTRRILSTRRASQAFGRGTIRFLRPENRKVLAYLRELDGDDPVLCVANLSRASQAVELDLSEFAGRVPIEMTSDSPFPPIGQLPYLLTFPPYGFLWFVLAEHGREPSWRQPHAEPLPEYVTLVMRRGDARPDIEQLHVLAHDALPSWLARRRWFASKDRAIGAARLNVVTPVPGEPFQYAEAWVESDEPGDVERYVVPLAAAWGGETSQPLFAQLALARVRRGHSVGYLTDAFALPAFAHGMLRKLRDGATVPTSDDGRLAFLPEDALAALDPGDNADVRWLAAEQSNSSLVIGDAIVLKLVRKVAHGVHPEAEMSRYLTRIGYPNTATLAGEVVHVDPDGTPHTVAILQRYADNQGDAWTRSFDFLRRAVDELALPAADEEEPDDTDEEPDALLGYAAFAGIIGTRLGQLHVALAQPSDDPAFAPEHATPEHVDGWCADAIASFEHALDVLHTRLDALDPATRAAADTLLASRDAAVRALGELVPRTLDAQCIRIHGDFHLGQVLDVQGDALLIDFEGEPARPLERRRAKSHPLRDVAGLLRSLSYVSAIAQFAIEKAPPQAAGRKRALFDRFGQAAADRFVDCYRAAAELAPARFVDPRYAYRLLALFLIDKASYELCYEAANRPDWLSVPVGGLAALVERLLDGGAASDDGDTP

SEQ ID NO: 26287 - protein, 484 aa, Burkholderia cepacia R18194
MIEGHVGDAAVLLVRRADELFAVGAQCPHYGAPLADGLLEGDTIRCPWHHAAFCLRTGELLRAPALDGLPCWRVERRDGRAVVLDARPAAVPPALNAAGLPVSVVIVGGGAAAIAAAVTLRQEGYPHPVTLLTADADPPYDRPNLSKDYLAGTADADWLPLRAPSFYADHHIDVRCGTRVARIDPARQAVELADGSRVGYGALLLATGAEPNRLTVPGADLPHVCVLRSRADCDALIAKLKTARRCVVVGASFIGLEAAAALRTRGLDVQVVAPDAHPMARVLGDALGSTIQALHESHGVVFHLGATPAQITPDSVTLSTGDVLPADLVVVGIGVHPNVALAQDAGLAVERGVTVDRFLQTSAPGIYAAGDIARWPDPLTGERIRVEHWVVAERQGIVAARNMLGQQRPFDAVPFFWSQHYDLTVNYVGHAEQFDRVEIDGDLGAHDCTIAYWRGNTRLAVATIGRDLDSLKAEAAFEQQIAAA

SEQ ID NO: 26288 - protein, 479 aa, Burkholderia cepacia R18194
MHQTVTAGGAPLDTPQVRAGIRAGADISARMDRLPITRHQWMLVLLISLGGFFEVYDLIFTGYIAPGMAKSGLLQTTTQAFFGFTGIAAFIAATFAGLFVGTFGFGWMPDRYGRRAVFTYSLLWYSIGSAIMAFQTTPEGVLLWRFITGIGVGLEIVTIDTYVTELVPQHMRGRAIAFNQVVMFAAAPVAAILSWWLVPTTVFGLDGWRVVVLAGSAGAVIVWFIRRAVPESPRWLAAHGDAERSERIVSRMEAIAERESGMPLPPPAPASEAPEVHRAAFAALWRAPYRARLLMLVAFNFCQAIGYYGFANWVPTLLIGQGITVTKSLLYAFVIAFAMPAGPLLAMRYADRIQRKHLIVGGALAVIACGLAFAQVKTVAPLIVLGVLISLAGQTISVAYHAYQCELFPTEVRSRASGIAYSASRAGAMMSGFIIAALLKDFGVSGVFTGITVFMLVVVIVIGTFGPRTNGVRLEELNR

SEQ ID NO: 26289 - protein, 353 aa, Burkholderia cepacia R18194
MPTLFDPVTLGDLTLPNRIVMAPLTRSRAGATRVPNALMARYYAERATAGLIITEATSVTPQGVGYADTPGIWSDEQVEGWKQVTQAVHAAGGRIVLQLWHVGRISDPVFLNGDLPVAPSAIAAGGHVSLVRPQRPYVTPRALELDEIPGIVAAYRKGAENAKAAGFDGVEIHGANGYLLDQFLQDSTNRRTDAYGGPVENRARLLLEVVDAAIDVWGAGRVGVHLAPRGDAHTMGDSDPAATFGYVARELGRRKIAFIFTRESYSGDHLSPRLKEAFGGPLIANEQFTLDTAQATLASGNADAIAWGKLFIANPDLPRRLELGAALNKPVPETFYAEGETGYTDYPALSDAA

SEQ ID NO: 26290 - protein, 446 aa, Burkholderia cepacia R18194
MSYNEAKFWHPMVHPNEMKQRKPIRIVRGDGCYVFDEEGRKLVDGVAGLWNVNVGHNRQEVKDAIVRQLDELEYFQLFDGISHPRAEELSKKVIDMLEPEGMRRVLYSSGGSDSIETALKIARQYWKVRGQADRTKFISLKQGYHGTHFGGASVNGNTVFRRNYEPNLPGCFHVETPWLYRNPFTQDPEELGRICAEMLEREIQFQSPDTVAAFIAEPIQGAGGVIVPPANYWPLVREVCDRYGVLLIADEVVTGFGRSGSMFGSRGWGVRPDIMCLAKGISSGYVPLGATVVNARIEDAFAANADFGGAIMHGYTYAGHPVACAAAIASLDIVVKEDLPANAAKQGAYLLEALKPFAERFAAVGEVRGKGLMLALDLVANKDTREPIDPLSGYANAVAEVARENGVLVRPVGTKIILSPPLVIQREQLDRIVDALAAGFEAVPFA

SEQ ID NO: 26291 - protein, 500 aa, Burkholderia cepacia R18194
MSTTNFVAVSDTVRTFVARDFGLFIDGEMQPAHAAARLDVYDPATGERLATVADADERDVDRAVASAKHAFDTRVWSGLRPADRERILLKLADLIERDAETLAQLETLNQGKSIHVSRAIEVGASVEYVRYMAGWATKITGQTLDVSIPFPPGARYTAYTRKEPVGVVAAIVPWNFPLMIAVWKLIPALAAGCTIVLKPSPETPLTALRLAELALEAGVPPGVFNVVTGGRVCGAALASHPSIAKISFTGSTATGKLVGAAAVQNMTRFSLELGGKNPIVMLDDIDVAQALDGVAAGAFFNQGQVCAAASRIYVHRSKFAQLADGLAGVAQSMKLGAGLDTTAQINPLVSAHHRDKVVQHIEGARRAGLTFLAGGTPADDLPGYYVKPAVIADPHPDSAIVRDEVFGPVIVVVPFDDAADAVRLANASPYGLAASIWSNDLKRVMNLVPQIEAGTVWVNCHIPLDPSMPFGGYKQSGIGREFGQYAIEGFTETKSVCIAH

SEQ ID NO: 26292 - protein, 393 aa, Burkholderia cepacia R18194
MNHLHSIDTVLAHEGRSHGQPGSPVNPPVYRQSTLLFHGTDALDAVRGTPLAYGRHGSPTTRALEKALARLEGAHAALLTPSGLSAITTALLAVLNPGDHLLMADSVYDPTRSFCDETLARLGIETTYFDPTIGADIASLMRPNTRAVFAESPGSLTFEVQDIPAISRVAHQRGAVVLLDNTWGTPLNFRSFSHGVDVSIHAATKYIAGHSDVLMGAILTTEALAPKVTRFYRQLGMTVSGDDAYLALRGLRTLSVRLERHQRNAHVLTDWLSQQPEVARILYPARAGDAGHALWQRDFTGACGLFGVVLHPQGDEAVRALLDGMTCFGMGYSWGGFESLIIPSNPARNRTATQWAATGPLLRIHAGLEHPDDMIADLAAGFARMRAAALAEA

SEQ ID NO: 26293 - protein, 504 aa, Burkholderia cepacia R18194
MLHRRALVLSILVLASCGLGYELISSALSSYLLGDSILQFSSVIGCYLFAMGIGSWLAKFVEDDDVLDRFVDIELLVGLLGGVSAALLFAVFAWLAAPFRAALYALVLALGMLIGMEIPLVMRAFQQRRQAFRHTVSEVLTFDYLGSLAVSLIFPLVLAPRLGLLRTSFLFGLLNAFVALWTTHLFRDEIRNVRGKLMRASLVIGLLVAGFALSDRITHWAEHGVYGDETIYSETTPYQRIVLTQWHDDMRLYLNGNLQFSSRDEHRYHEALIHPTIDALPWAKRVLVLGGGDGLAVRELLKHRNLEQITLVDLDPAMTKLFSTSAPLVKLNQGSLKDPRVHVINDDAVRWLESNADVYDAIVVDFPDPTNFGLGRLYSVPVFRLLARHLSENGYAVIQSTSPYFAPHAYWTIIATLHEAGLNTWPYHCYVPSFGDWGFVIAGKRRDFTVPTHYSVPTRWLDAQTAAEMFHFPADMPALPMSPNELNDQPLVRRFDDDWKHVLR

SEQ ID NO: 26294 - protein, 448 aa, Burkholderia cepacia R18194
MADVVPALVDEVRAFRQAHPEIRYVDLICLDLPGHFYGKRYPIDALEKVAAGSLLKLPQNCILLGTQGGLYKIGDYCFNDGDPDAVRRLIPGTLKPVTWEKQPLGQMLITTDGTDAPVEFEPREVLARVLKRLARRGIRPVVAFELEFYLFAAQLEDGMPKYPRDRLSDDRDDQPNMHIERLSRFSDVLHEMVDVACVQGIDATVITAELGPGQFEINFGHCDDGLRAADWSAMFCRSTRGVALQHGYRASFMGKPYLHAPGSGMHVHVSLYDDAGRNLLAADGQRPLRHAVAGCLALLPHCMPVFAPNHNAFRRYGSMVNAASRASWGFEDRDACIRIPESDARNLRIEHRLASADANPYLVLAAILSGMEHGLDAKLEPIAPLNEDRGSGIDFPKEMLSAVAEMQDHAAVREGLGSEFVMVYCENKRQEELDFRNEIGAREYRWFL

SEQ ID NO: 26295 - protein, 396 aa, Burkholderia cepacia R18194
MSTNETSGSRGDPVVIVGTGLAGYTVAREWRKLDGDTPLVMISRDDGSFYSKPALSNALAQRKTPEQLAMSDARTMAEQLRATIRTHCAVRRICADEHEIVLDDGSTQRYRALVLATGADARRVPCEGDGAADVLSINDLADYARFRGGLRDCRSVALLGAGLIGCEFANDLVAAGLTVTVIDPADAPLSRLLPTEAGRVFGHALSDAGVHLRLGTGVRSIARLARGYRLALTDGGHLEADLVISAIGLVPRVALARDAGLDVADGIVTDAWCRTSAPDIFALGDCAAIEGRVRPYVLPIMHAARALAQCLHGTPTRVAFPVMPIVVKTPAIPAVVVAADSGGRWTTEVGVGDAPRATRALCADPDSGRITGFALLDAATAEKAALLKTMAGDAAK

SEQ ID NO: 26296 - protein, 459 aa, Burkholderia cepacia R18194
MQDNSLRQSLKQRHITMIALGGVIGAGLFVGSGAIIATAGPAAILSYLIGGVIVTLVMFMLGEMASRNPDSGSFSTYASSYLGEWAGFAVGWLYWFKSMMTITVEAILLGAILHDFLPWLPVWGGALFMLVTLIASNAYSVRSFGEAEYWLSFAKVTTIIIFMALGASILLGFQPRIPAPGLINLTDHGGFMPNGISPVLAGVMVVIFSLGGSEIAAVAAGESENPSKNVIRAIKSVIVRVMVFYVGSVSILILCMPWTDKANLKSPYVSLFSMAGFTSAAVAMKLVLFVSFMSVMNSFLFSNSRMLFSLSQRGHAPAMFGRTNAKGVPMNALVLCLAICVSILGIHFVSGGDLFLMLAKSSGAFVMIVWIFIIVAHFAMRRQEKHAPRDPQAFRAWFYPVSNWIALLALVAVLGSQAFNPDSRFQFWFTVLTALAIVAAYFVRRKPVQLGDTAGAKVR

SEQ ID NO: 26297 - protein, 492 aa, Burkholderia cepacia R18194
MQANDRTIPLDHPDCFYIDGQWTPAPSAETFEVLDCSTERVAARVARADAAVAARAIDAARRAFDQGPWPRMTPAERAACLERIAQHLEAANDEFARGWSIESGILQRIAKPRIGQFLGAAFRQYAAMADTYPFVEPHRSVTGHQAYAVKEAVGVVLAIVPWNGPAALIAYKVAPALLAGCTVIIKPSPEAPTSAYLFAQICDEIGLPPGVVNVVTADREVSEAMVRNPSVDKITFTGSTAAGRSISEAAAGRIARVTLELGGKSAALVLDDYDLDAAAQVLGKSYFSYLTGQVCHSLTRIIVPRAKHDTMVEALSEAAREMVLGDPFSDATTVGPLATARQRDTVEHHVAKGIAEGATLAAGGARPRHLSRGFFFEPTVFANVDNRSTLAQQEIFGPVLSVIAADSEAHAIELANDSIFGLNAVVFTSDAQHALQVARQLRTGSVGHNASRTDFSIGFGGFKQSGIGREGGVEGLNAFVESKTIVLDQPLA

SEQ ID NO: 26298 - protein, 491 aa, Burkholderia cepacia R18194
MAVSAESSSSFDPAVLLARQRNAFVSEGPPSVQQRKARLARLRAVVLAYRREVEEAISADFGHRSRHETAIMELVGVVQAIDYLTRNLCRFTKPQRRHVGLLYRAGQAHIEYQPLGVIGVMAPWNYPFALTFIPLATALAAGNRAMLKPSELTPRTSEVMRRMLAETFPSEEVAVVLGGPEVGAAFSGLPFDHLLFTGSTQVGRKVMKAASDNLVPVTLELGGKSPAIVARGHVDGRTMSSIVFGKLSNAGQTCVAPDYALVHEDDLDAFVAQYDEAVARFYPDGPTSPDYTSIVSDRHFDRLKGLVDEARSKGARVIEAGVNPQQAATRKRTLAPTLIVGAGDDTTVMQEEIFGPILPVRTYRTIDEVVDYVNARPRPLALYYFGAQDSDCESLLRRTTSGNVGINNTLLHVAQEDLPFGGVGPSGMGAYHGIEGFRAMSHAKGVFVLGRWNLPSLLRAPFGKLADLSLAALLGRSREPEGVRAGLSAKR

SEQ ID NO: 26299 - protein, 498 aa, Burkholderia cepacia R18194
MLSLVSHLDHLNVRPGRLFIDGQWLDWPDARFDQLNPCTNEVMTSFADAGAQGVELAVAAARKAFDEGPWPRMRAQDRKRLLQPIVERLYAAEEEIARLQTLDNGIPYAFSRHSRVSAKSAADVFDHFLGWIDKINGDTLPIFSGASNMQYMTFRDPVGVVAAVLPYNGPVLTFAMKVAPALACGCTVIVKSSELTNLAVARLAQIIADSDLPPGVFNFVTGGVETGSALTSHAGVDKVTFTGSPAVGEKIMIASAPTMKRLSLELGGKSAALVFPDTRSVQTTAHALMGLCSTFLSGQVCSTPSRAVVHRSIMDEFLHHAQEQLQKVRFGDPFDAATTSAPMISRRHQARVLDYVESGRQQGATLLAGGRAPGGEFRNGNWVEPALFANVSNDMTIAQEEIFGPVLSVIPFDTEEEAIRIANDSAYGLAGCVYTTDVSRAFRVARAVKSGAIGVNGFASIPNAPFGGIKRSGTGREGGWSTIEAFTELKTVNFNLDA

SEQ ID NO: 26300 - protein, 496 aa, Burkholderia cepacia R18194
MTIVTEAAQAARTQALAWINRGPKRLLIGGRWVDAASGNTFETINPATEQVLCRVAEADSADVDAAVIAARRAFDAPSWGGLSPHARTRALLKIADAIEQHVDELAAIESLDNGMPLWFALAAVTATIDIVRYYAGWCSKVLGTTIPSDGSTLIYTLREPLGVCGQIIPWNVPILMAAIKFANALCCGNTVILKPAELACLTSIRLAELIQETDLPPGVINVLPGYGPTAGAALAQHPGVDKIAFTGSTPVGKQITRDATLNLKKVTLELGGKAPNVIFADADIEKAVQAAVKTFCGNSGQVCSAGTRLFVQEGIHEQVAERVAQIAATWKAGDPFASDTKLGPLISAKQRDRVWSYIGVGQEGGATLRLGGDPWRGAGYFVEPTVFDNVRNGMRIAQEEIFGPVLSIIPFKDEGDAVLQANDTTYGLSAAVWTRDVARAHKVVRALKAGRLWINTFGESDPAMAFGGYKQSGWGREFGQESIDAYTQTKSIMLRM

SEQ ID NO: 26301 - protein, 489 aa, Burkholderia cepacia R18194
MSVNIPGFIEGNKKLLIGGQWVEPAGGEHIEAINPATGEVLCHIAKGGTQDVERAVAAARRAFEGPWSRFTPHERRKLLLRVHDVILDHFDELALIETLDMGAPLARTRGYKEWLSQLLQFYASQTGAGTVQAAPMSIAPGFTALKHLMPVGVVGGIIPWNGPLMGLWWIYGPALATGCTAVLKPAEDASLSSLRVSELMMEAGVPDGVINVVTGYGKDVGQALAEHPDVDRVAFTGSVGTAQAIVRASAGNLKRLQLELGGKSPDIVFADADLDKAVPGAAMGVFTNTGQVCVAGTRIFVQRAIHDEFVQRIAAFAKTIRIGDGLSPDTQIGPLISQRQLERVMHYVDIGGKEATLVHGGQRPGGELARGYFVEPTVFANVRNDMTIAREEIFGPVASVIPFDTMEEALQLANDTPYGLAGGVWTSSLSTAHKVSQGIRSGTVWVNCYGVIDPAVGFGGTKMSGYGWKGGKEHVESFLYPKATYINLG

SEQ ID NO: 26302 - protein, 377 aa, Burkholderia cepacia R18194
MFQPFTFPNGITLRNRVLMAPMTTWSSNPDGTVSDQELAYYRRRVNGVGAVLTGCTHVTENGIGFTDEFAAHDDRYTPSLRALAQAAKSGGAPAILQIFHAGNKAVPALVPDGELVSASAMKAPPGPFNNGELESRALTHDEIGEMIRAFGETTRRAIEAGFDGIELHGAHGFLIQNFFSPRFNQRADAWGGSLENRMRFPLALVAEIRRVIAQHADRPFLLGYRISPEEPDAGGLRVDDALTLIDRLIVAGIDYIHVSLADLLDAKPLDATDERRTIERVVAAVQQRVPVIAAGQIRTPAQAEAALALGLSVVAVGKGLVMNPAWVEQAMRGEAAAIRTQLHPVDVPQLVIPDKLWGVIDAMKGWFPVHRDEPAVA

SEQ ID NO: 26303 - protein, 486 aa, Burkholderia cepacia R18194
MTNRTIELKHPRAFYIGGQWVAPSTPDTFDVLDCATEEVVATVAKAASADMQRAIDAARDAFDNGPWPRMTPQERAGYLEKFAERLEALNDEFARIWTIETGIVYKVAQPRIGLFISGAFRQYAAMAATFPFVEEQRSVTGNLGYRVYEPVGVVGEIIPWNGPAGLMAYKTAPALLAGCTLVIKSSPEAPCSAYLFAEICDEIGLPPGVVNVVTADRDVSEELVRHPGVDKITFTGSTGAGRRIASIAGDRIARVTLELGGKSPAVILDDYDIETAANVLGPSYFGYNTGQICHSLTRVIVPRAKHDAMVEALSAIAKQIVVGDPFAPETTSGPLASARQRETVERFVATGIAEGATLATGGKRPAGLARGFFFEPTVFGNVDNRSTIAQDEIFGPVLSVIPADDEASAIRMANDTPFGLNAAVFTNDRARALHVARQIRSGTVGHNGPRTDFSIGFGGFKQSGIGREGGVEGLTAFMESKTIVMA

SEQ ID NO: 26304 - protein, 182 aa, Burkholderia cepacia R18194
MSTIYDIPVNAIDGAQTTLRPYEGKVLLVVNVASKCGLTPQYEGLEALYEGKRAEGLEVLAFPANNFKGQEPGTDAEIQSFCTGTFGVKFPLFSKISVIGDDKHPLYRSLTQAQPQATGDGPFRTRLEGYGIQPNPAPEVLWNFEKFLVSRTGEVVARFSPDTTADDPKLVAAIDAELAKAA

SEQ ID NO: 26305 - protein, 309 aa, Burkholderia cepacia R18194
MPMPLDPQIAAILKTLEAAPPMESLSVDALRNSLAYPPLERRTVVGEVVDFDMPLEGRVLAARLYRPKLAQSDGVTVFFHGGGFVIGNLDTHDHVCRDLCAESGAAVIAVDYRLAPEHPFPAAVDDCFDAVRWIAEHADTLSFDPSRIVVAGDSAGGNLAAVTALKIRDEGGPTLRAQVLVYPVTDYHTPPTRSYIENQSGYSLTRAAMIRFWNDYVANEREALHPHACPLRAKSLAGLPRALVITAGFDPLRDEGEAYANRLFDAGVPVTFRRHDDMIHGFFRMGPACAAAQEGLLRAAAWIRDVMAR

SEQ ID NO: 26306 - protein, 302 aa, Burkholderia cepacia R18194
MDKLAATPSKPRHLMSPDEARTAFARISTILSPGADVRSTIALDIPVDGGTLRARLFVPDGRPQALLVYFHGGGWVVGGIDAFTPLCREIAAGAGVAVALVEYRKAPEHPFPGPVHDAWQAAQWLASQRVALLGAELPVFVGGDSAGANLAIAVTLLTRREGSMSFAGQLLVYPVTDCVFDRPSYVAAENQLLTTRDAMMGYWNHYAPSDAARHSSLASPLREADLSGLPEAIVVTAEHDVLRDEGEAYAQRLEQAGVPVHHRRALGQMHGFLMMIGVLPGSRDGLEFVCERLRDLVARSSR

SEQ ID NO: 26307 - protein, 338 aa, Burkholderia cepacia R18194
METRELGRTGPRVSAIALGCMGMSDFYGPADRDESIATLHTALDHGITMLDTGDFYGMGDNEMLIRDALRGRARDQVLISVKFGALRDPSGGFAGYDARPVAIRNFVAYSLKRLGTDYIDIYRPARVDPAVPIEETIGAIADLVKAGYVRHIGLSEAGVDTIRRAAAVAPISDLQIEYSLLSRGIEAGILPACRELGIGVTAYGVLSRGLLGGRWSAAREGERDFRGASPRFQGENLAHNLALVDALRAIADEKGSNPAQVAIAWALSRGGDIVPLIGARKRTQLQDALQAAEMQLTVNDIARIEAAVPAGAAAGERYPAAQMAHLDSEQGQGVSHGD

SEQ ID NO: 26308 - protein, 441 aa, Burkholderia cepacia R18194
MTDKATRIDLFSFRTAPMRAFHLTWMAFFVCFFAWFACAPLMPLIAREFHLTAAQVANINIAAVAATIAVRLLVGPLCDRFGPRRVYVGLLLLGAIPVFAVSFTHDYLSFLICRLGIGAIGAGFVITQYHTSVMFAPNVVGTANATTAGWGNAGAGATQALMPLLVAAGLMLGFGEDSSWRIALVVPGVAMLVMAWAYWRFTQDCPQGDIVALRKAGVTVDSGKKGGWASFFAACGNYRVWMLFVTYGACFGVEVFIHNIAALYYVDHFSLSLKDAGFAVGLFGLLALFARALGGWLSDKIAARRSLDVRATLLCALIVGEGLGLIWFSHAQSIGVALVAMLTFGLFTHMACGATYALVPFIDRKALGGVAGIVGAGGNVGAVAASFLLKGVGDVQHTLSLLGLAVTATALCAMAVRFSEEHKAREAELRDRALAASSVAN

SEQ ID NO: 26309 - protein, 1395 aa, Burkholderia cepacia R18194
MTATPVKSVCPYCGVGCGMVLHVEEGEVVKVSGDSDHPTNFGRLCTKGSSAHVALRRSGRLDRAFVRRAREDDLVPLSGRDAIAETARRLRTVLDTYGPDALSFYVSGQMSIEAQYLVNKLAKGFVGTNNIESNSRLCMASAGTGYKQSLGADGPPGSYQDFDRANLFFVIGANMADCHPILFLRMMDRVKAGAKLIVVDPRRTGTADKADLFLQIRPGTDLALTNGLLHLLHANGRTDAAFIDAYTEGWDAMPAFLADYTPERVAEITGLAEADLRTAAQWIGDAQEWMSCWTMGLNQSTHGVWNTNAICNLHLATGRICRPGSGPFSLTGQPNAMGGREMGYMGPGLPGQRSVASDDDRRFVENLWRVPAGTLRKETGQGTVDMFSRMAAGDIKACWIICTNPVATVPNRQNVIAGLQAAELVIAQDAFLDTETNRYADILLPGALWAEGDGVMINSERNLTLMRAAVAPPGDALPDWRIVAEVARAMGFGDAFDYASAADVFDEIVRFSNPATGYDLRGASHAALRDGPVQWPVAPGTARERHPIRYLNDGVSQTLRPAADGNDAPRLAFPTPSGKARFFARPHVDPAELPDDTFPIVLNTGRLQHQWHTMTKTGKVAMLNKLNPRPFVELHPDDASALGIAAKDSVEIRSARGRAVLPAVVTERVQRGNCFAPMHWNDVYGDDLCINAVTNDAIDPESQQPELKYCAVALRRVETDAFASADDETAQPDARADDVRPAPVMTQATASQESDMADIDTFAAALGVADLAPPPLTDTERLYVAGLVSGLKASAGKREGSVPVLPAAAPLTPPVRFWLDGMLAGLFSRSLPASVPGAAAPALPADAGASGGVRIVRTRPKVVLLWASQTGNIESLTEDYATQLMNAGFEIRTACMSDYPVASLAGAQYVLLMTSTFGDGDAPDNGSEFWEALQAGSAARLDGVHFAVLAFGDRNYDQFCGHGRRLDARLAELGAARLCARVDCDVEFQRDADQWLERVVARIKEADAALHAVPTGGMSPSGLLPTKAHPAPSKLVANLRLNRPGAAKDTRCVSLSTEGANLEYETGDALGVWPTNCPELVDELLSVTALKADSPVSVAGVGDVRLGDALARHFDITRPHPDTLAFIASRSANGALKSLLGDERKGDLKQWLWGQQLADVLHEFPVELSGTELVGMLKRMQPRLYSIASSPSAHQGEIHLTVSAVRYHNGRRARKGVASTFLADRADDGRVPVFVQKSAHFRPPVNGDVPIVMVGPGTGVAPFRGFLHERQARGARGRNWLFFGEQHAQTDFYYGDELGAMHDSGFLTRLDLAFSRDQADKIYVQDRMREQGAELFAWLEEGAHFYVCGDAARMAKDVDTALKAVVAEHGGMSDEAANDYVARLSKARRYMRDVY

SEQ ID NO: 26310 - protein, 500 aa, Burkholderia cepacia R18194
MTDLLSAPEYAALAAALRFPSGPFIDGAFRTASSGDTFATVNPATDAVLAQIGACNAADVDIAVANARQAFEDGRWRKLAPSHRKAVLLKFADLLEQHAHELATMESLDSGKPIRECQTIDVPETIHTIRWHAELIDKIYDNTAPVGGNALALVVREPIGVVGLVLPWNFPLLMLAWKIGPSLAAGCSIVVKPAKETTLTALRVAELAHEAGVPAGVFNVLPGGGREVGEPLGRHADVDMVSFTGSTDTGRKFLKYAAESNLKRIVLECGGKNPAVVLPDAPDLDAVAQHIVNGAFWNMGENCSASSRLIVHADIKDDLLQRIGTQMREWKMGNPLDPAHRIGAMVSKAHFEKVRSYLEQAGAEHLHVAFGGQTDGGIFVEPTVVDGVSPHSRLFREEIFGPVLSVTTFTDIAEAIALANDSVYGLAASVYTGSLNLAIRLSREIRAGVVTVNCFGEGDVTTPFGGYKESGFGGRDKSVWAHDQYTEIKTIWIDVPVDPA

SEQ ID NO: 26311 - protein, 438 aa, Burkholderia cepacia R18194
MSIEDVPLNGFHQLLTIRSGGGWLMDGYVLSIIGVAMVQFSDALGLTGFWQGMVAASALIGIFFGGFIGGWLSDRLGRKKPYFFGPVIFFACSLAQLWVHSGEALFVLRFLIGIGVGIEYPVAGSLLVEFMPRKYRGPRLAMLTIIWFFGAALAYIVGNIILGSGGPDAWRWVLASPAVIGLALFVVRIGTPESPRWLLSKGRVAEADDVIRTVYGPSFSVKNLPEEQTEKKISLWALLHSGYGKRMLFVSVFWSCSVIPVFAVYSFAPRVLEALHLTGKWESFGSVAITLLFVVGCIIATWIINELGRRAMVIHSFLWSGLALLGLGACSGGSAVLILVLFGAYAVLIGGAQVLQLVYPNEIFPTDIRAFAVGMGASLSRIGAAVGTWLVPIALQTVGIGNTMYAAAAVSFVGLIASLALAPETRSLSLQEAASLNH

SEQ ID NO: 26312 - protein, 400 aa, Burkholderia cepacia R18194
MTTSDHASRPLPEADGDFYQLARTLPDDENEIRLRVRAFMEKEVQPIINEFWMRDEFPFELLPKFKALGIAGLPFQGYGCPGKSTTLMGFVMMELARVDASISTFFGVHTGLAMGSIAICGSDEQKRTWLPPMAALDKIGSFGLTEPLVGSGASGGLLTSARRDGDTWILNGQKKWIGNATWGDVTVIWARDVADNQVKGFIVENRTPGFHVDKIQHKMALRVVQNGLITMTDCRVSEANRLQNANSFKDTAQVLKMTRAAVAWESVGCATGAYEHAVRYAQERQQFGRPIASFQLVQDLLFRMLCNITSTQALCHRLSQMQDAGIMQDEHASLAKGLCTVRMRETVGWARELLGANGILLDHHVGRFVADAEALYSYEGTREMNALIVGRAVTGFSAFV

SEQ ID NO: 26313 - protein, 256 aa, Burkholderia cepacia R18194
MADVPAPTPGPGDVLIRVAYAGINPADWKCREGYLGAFMQYTFPFVIGFDAAGVVEAVGDGVDSFEPGMRVFAQTDVGAGRWGAYAEYVAVRHDSVVRVPDALSLAEAATVPTPALAAWAGLFDDGGLRAGQCVLVHGGAGAVGTFAIQLAVQAGARVAATCSARNRETVESLGAAASIDYRAQDIAAALRAWAPGGVDLVLDAVGGDTLPDALDLLAPGGTLVNIMTLAAGDAERLAATAAEAARRGLRTAMTYS

SEQ ID NO: 26314 - protein, 481 aa, Burkholderia cepacia R18194
MANVTYTDTQLLIDGEWVDAASGKTIDVVNPATGKPIGKVAHAGIADLDRALAAAQRGFDAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLAAMAGLHMKRATMELGGHAPVIVAEDADVALAVKAAGGAKFRNAGQVCISPTRFLVHNSIRDEFTRALVKHAEGLKVGNGLEEGTALGALANPRRLTAMASVVDNARKVGARIETGGERIGTEGNFFAPTVIADVPLEADVFNNEPFGPVAAIRGFDKLDDAIAEANRLPFGLAGYAFTRSFANVHLLTQRLEVGMLWINQPATPWPEMPFGGVKDSGYGSEGGPEALEPYLVTKSVTVMAV

SEQ ID NO: 26315 - protein, 312 aa, Burkholderia cepacia R18194
MPLDPQAQALLAAFAQAPAIDFAQLTVPAYRASLADGGAFAPGDAVVAEEDWQIPASGRQLSARLYRPAVDGPLPLTVFFHGGGFVSCGIDTHANLCRSLAARARTLVLSVDYRLAPEARFPAAAHDACDAMRWAAASARDLGARAGALAVAGDSAGGNLAAVAALQLRGSGIAIAHQLLLYPVVDCATEHPSYETLGNGYFLTADMMRWFKRQYFDEGADRASPLASPLAAPDVAGAAPATIVSAEFDPLRDEAEAYALRLAQAGTPVTLVRWPGQLHGFASMLGAVDAADRVLTFGADALRRAFDATEAP

SEQ ID NO: 26316 - protein, 411 aa, Burkholderia cepacia R18194
MESVDLTTAFSPLQIGPLTLRNRLIKSATNEGMTPNGVPSRALVRFHERIAEGGAALTTVAYCAISDDGRTFVDQARLDVPTVRQFRALTDAVHRHGAAASAQITHGGCFTFLPSLSTRRPLSASGGLNKVGVMSGRFLKQAMTRDQMSTIADEFAQAARHARDAGFDAVEIHMGHGYLLSQFLSPLYNRRRDAYGGDATRRATFPVEVLRRVLDAVGRDLAVVCKIGVTEGVRGGGTADDACEIARRLEAEGAHLLVLSGGMNVESVWQLFGSPLPGEARANADNAIVRTAMALQKLTEPKMGAFREMYFLEHSKKVRAAVRMPLAYLGGVRSRGNVELAMREGFDAVALARALVFEPDFVNGLRDGRLAQSGCTSCNRCVVSMYTPGGTACVLREPNDPAPNRVPAAGA

SEQ ID NO: 26317 - protein, 441 aa, Burkholderia cepacia R18194
MALGATIGVGLFLGSASAIRVAGPAILLTYLLGGIAIFLIMRALGEMAIANPVAGAFSRYARDYLGPLAGYLTGWTYWFVWIVTCMAEITAVGVYMHMWFPGVPNWIWALAALMAMGSVNFIAVKLYGEFEFWFALIKIVTIVLMIIGGGLMIAFGIGNGGVAIGLSNLWAHGGFMPNGINGVIAALPIVMFAYLGVEMLGLTAGEARNPEKSLTKAVNSVFWRVLIFYIGALFVIMSLYPWDQIGTQGSPFVMTFSRLGIPAAAGIINFVVLTAALSSCNSGLFSTARMLYNLAQQGQAPSKLGKVNRNGVPVYGVIVSVALLLIGVLLNYLAPQHVFTWLTSVSTFGAIWTWCVILIAQMRFRRTLSADKIARLPIRVPFYPLGSFVALGFLVLVVVLMAFTPDTRVALVIGPVWIVLLGITYALFYANRPAASVPTKS

SEQ ID NO: 26318 - protein, 461 aa, Burkholderia cepacia R18194
MVSGNESDGLKRGLKNRHIQLIALGGALGTGLFLGIAQTIKMAGPSVLLGYGVAGIIAFFIMRQLGEMVVDEPVAGSFSYFADKYVGHFTGFLSGWNYWVLYILVSMAELSAVGIYVQYWWPGVPTWVSALVFFVAINLLNLASVKSYGETEFWFSIIKVAAIVGMIGFGGWLLASGHAGPEASVRNLWQHGGFFPNGVSGLVMSMAAIMFSFGGLELIGITAAEADDPKRSIPRATNQVIYRILIFYIGALAVLLSLYPWEKVVTGGSPFVLIFHALSSNLVANVLNVVVLTAALSVYNSGVYSNSRMLFGLAKQGNAPKVLCSVNKRGIPLAALGASALATGVCVLVNYFMPGKAFEVLMGLVVSALIINWAMITLIHLKFRQAKRAAGEETSFRSLGYPFTNYLCLAFMAGILVVMYLTPDLRLSVYLIPVWLAVLAVGYRFRQKNAGYAVHDSASAR

SEQ ID NO: 26319 - protein, 451 aa, Burkholderia cepacia R18194
MTDITTAQQDETNLRTDAAWLDAHWMPFTANRQFKADPRMIVSGKGAYYTDGEGRKIFDGLSGLWCTGLGHGRTEIVEAVSRQVAQLDYAPAFQFGHPKSFELANKIKDLTPAGLDYVFFTGSGSEAADTSLKLARAYWRAKGKGTKTRLIGREKGYHGVNFGGISVGGIGPNRKLFGQGLDADFLPHTQLAENKFSRGMPEHGAELADRLLELIALHDASNIAAVIVEPFSGSAGVVVPPKGYLKRLRDICTAHDILLIFDEVITGFGRAGAMTGADAFGVVPDIMNFAKQVTNGVQPLGGVIATKEIYDTFMAAGGPEYMLEFPHGYTYSAHPVACAAGVAALDLLVKEDAVARVRDLAPHFEAAVHGLKGQRHITDIRNYGLAAGLTIAALPGEPARRPYEIAMRCWAKGFYVRYGGDTIQLAPPFISEKREIDNLVNALSDALNEVD

SEQ ID NO: 26320 - protein, 369 aa, Burkholderia cepacia R18194
MSALFEPFKLKDVTLRNRIAVPPMCQYVAEDGVVNDWHHVHLAGIARGGAGLVIAEATAVSPEGRITPGCAGLWNDAQAEAFAPSVAAIKAAGAVPGIQIAHAGRKASANRPWEGDDHIADGDPRGWQTIAPSAVPFGAHLPKTPRAMTRDDIARVQADFVASAKRARDLGFEWLELHFAHGYLGQSFFSVHANQRDDEYGGSAENRGRFLVETLAAVRKVWPEHLPLTARFGVIEYDGRDEETLAESIALTQRLKQEGLDMLSVSVGFSTPDAQIPWGPAFLAPIAERVRREAGLPVSSAWGIDTPQLANRVVAEEQLDLVMVGRAHLADPHWPYYAAKQLGVERPSWTLPAPYAHWLERYRTADKVA

SEQ ID NO: 26321 - protein, 487 aa, Burkholderia cepacia R18194
MTIKHWIGGREVESRETFTTLNPATGDVITDVASGGEAEVDAAVRAAKEAFPKWASTPAKERAKLMRKLGELIEKNVPNLAALETQDTGLPIAQTSKQLIPRASENFNFFAEVCVQMNGRTYPVDDQMLNYTLYQPVGVCALVSPWNVPFMTATWKTAPCLALGNTAVLKMSELSPLTADQLGRLALEAGIPPGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVQEFARRANNLIVGDPSDPATNLGAMITRQHWEKVTGYIRIGEQEGARVVAGGADKPAGLPDHLRNGNFVRPTVLADVDNRMRVAQEEIFGPVACIIPFEDEDDGLRLANDTAYGLASYIWTQDVGKVHRLARGIEAGMVFVNSQNVRDLRQPFGGVKESGTGREGGEYSFEVFAEIKNVCISMGSHHIPRWGV

SEQ ID NO: 26322 - protein, 478 aa, Burkholderia cepacia R18194
MQRATKIVATIGPASSSPEILLQMMQAGLDVVRLNFSHGTADDHRQRAEMVREAARKVGREIAIMADLQGPKIRVGKFENGKTTLEPGQAFILDAGCELGNDERVGLDYKELPRDLRTGDLLLLNDGLIVLTVERVLGDEIHTIVKVGGELSNNKGINRQGGGLSAPALTAKDMEDIRTAMSLGADLVAVSFPKNATDMEMARQLANIAGAPYGIKPKMIAKIERAEAIPALQSILDASDGIMVARGDLAVEVGNAAVPALQKRMIRMARESNKLVITATQMMESMIHAPVPTRAEVSDVANAVLDGTDAVMLSAETAAGKYPVVTIETMAAVCVEAEKSEHVELDKDFLDRTFTRIDQSIAMGALFTAYHLGAKAIIALTESGATALWMSRHYTHVPIFALTPRVGSERTMALYRNVTPLHVDFNSDRDSALQAALEIVVKQGYVQHGDMVVLTVGEPMGQAGGTNTLKIVRVGEHY

SEQ ID NO: 26323 - protein, 398 aa, Burkholderia cepacia R18194
MSQVKRLTDLIAAGQLAGKRVFIRADLNVPQDDQGNITEDTRVRASVPAIQAALDAGAAVMVTSHLGRPTEGEFKPEDSLAPVAKRLAELLGRDVPLVSNWVENGVNVAPGQVVLLENCRVNKGEKKNSDELAQKMAKLCDVYVNDAFGTAHRAEATTHGIAKYAPVACAGPLLAAELDALGKALGNPARPLVAIVAGSKVSTKLTILKSLAGKVDQLIVGGGIANTFMLAAGLSIGKSLAEADLVNEAKAIIDEARERGASVPIPTDVVTAKEFSPTAVATVKQVADIEADDMILDIGPDTAKALASQLEKAGTIVWNGPVGVFEFDQFGNGTKTLAEAIAKSSAFSIAGGGDTLAAIAKYGIHDQVSYISTGGGAFLEFLEGKKLPAVEVLETRAA

SEQ ID NO: 26324 - protein, 416 aa, Burkholderia cepacia R18194
MTNDRVMAIVGAGHAGGRAAQVLRESGWGGRIVLIGAEAHLPYERPPLSKGVLTGERSAARCRLREPEAWVADRIEPVVATVERIDPCAREVHVSGARVFGYDALLLATGGRARRLAIPGATLDGVFALRTLDDAAALGSRLVPDARVVLIGGGFIGLEVAASARRRGCRVTVLDAAPRLLGRAVPETIAARVHALHEQQGVAIRVSRKPVAIERTASGALAVVLDDGDTLIADTVVAGIGIEPADELARDAGLAVERGIVVNERLETSAHGIYAAGDVAVFPSALSGRPVRQETWHGAETQARVAARNMLGADEPYRDTPWFWSDQYDAQLHVAGEPALGERSVARVLGDDAEIHFHFDAGARLVAASGFGRASGFIKEMRVARMLVERGAGVTPTAVADVNVKLKSLIGEAGGR

SEQ ID NO: 26325 - protein, 184 aa, Burkholderia cepacia R18194
MASVNKVILVGNLGADPEVRYLPSGDAVANIRLATTDRYKDKASGDFKEMTEWHRVAFFGRLAEIVSEYLKKGSSVYIEGRIRTRKWQGQDGQDRYSTEIVADQMQMLGGRGAGGGGGGGDEGGYGGGYGGGGGGGRGEQMERGGGGGGRAGGAARGGAGGGAQSRPSAPAGGGFDEMDDDIPF

SEQ ID NO: 26326 - protein, 248 aa, Burkholderia cepacia R18194
MYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 26327 - protein, 304 aa, Burkholderia cepacia R18194
MNASNETDAHAAAIGAGSVGTGPAASADADDLVIEVRNLTKRYGRNIIHQKLDFDVRRGEIVSIVGGSGSGKTTLVRQILGLERPTSGTIKVFGEDTATIDDASARMMRTRSGMLFQQGALFSSMTVFDNVAQPLRELGRVPPDLLHDIVMLKLEMVGLPCKHASKMPAALSGGMVKRVGIARAIALEPELLFLDEPTAGLDPQASDEFVELIATLHRTLGLTVVMVTHDLDTMVALSTRVAVLADRKVLVAAPVEEAANVDHPFIHEYFLGLRGRRALQALPPERRAKLPKAALEPALSSVEL

SEQ ID NO: 26328 - protein, 369 aa, Burkholderia cepacia R18194
MNRTAFFTDERTFWHTGGTHALFFPVGGWVQPPSSAGYAESPDSKRRFLSLVQASGLAAQLDLRGAEPASTTDLLRIHPAHYLDAFRALSDANGGDLGDLAPFGKGSYEIAALSAGLAITAVDTVLGERAANAFSLSRPPGHHCLRDRPMGFCLLANIPIAIEAARAKHGIERIAVIDWDVHHGNGTQSIYYDDPDTLTISLHQDRCFPPGYSGADDRGEGAGAGANLNVPLLAGSGDDAYRYAFERIVLPALERFRPELIVIASGLDASAVDPLARMQLHTDSYRFMTRAVKEAAQRHCGGRLVIVHEGGYSEAYVPFCGLAIVEELAGVRTDVADPMLDLAIAQQPGERFVAFQRELLDELAASFGL

SEQ ID NO: 26329 - protein, 319 aa, Burkholderia cepacia R18194
MPLNPKIAQVLDMIERAKRPSYHHQTPQQARAAYEKSAPILDVASAPMHSVEECVVPTRDGRTIGARLYLPVEPSLAEPLPALVYYHGGGFTVGSVDTHDALCRMFARDAQCAVLSVGYRLAPEHRFPTAVNDADDALQWLHREAATFGIDAARLAVGGDSAGGTLATVCAVLARDAGIRLALQMLIYPGVTGYQDTESHARLANGYLLTQDTIQWFFTQYVRDRADRDDWRFAPLDGTRDAPSFAGVAPAWIATAEYDPLSDEGAAYAEKLRAAGNVVTLVCYPGMIHEFFKMGGYVPEVRAAHADAVAALKAAFDDV

SEQ ID NO: 26330 - protein, 297 aa, Burkholderia cepacia R18194
MATIGFIGLGIMGAHMARNLLKGDHQLVVNGAFPIPDDLRTSAKVVANSTEVAQNADIIVVMVPDTPDVRNVLFADDGVAKGLTAGKLVIDMSSISPLDTQEFAKQINALGCDYLDAPVSGGEVGAREASLTIMVGGPEAAFERAKPLFEKMGKNITLVGDNGAGQTCKVANQIIVALNIEAVGEALLFAARSGADPERVRQALMGGFAASRILEVHGARMTKRTFDPGFRIELHQKDLNLALDGARKLGLALPHTASAQQLFSVCASHGGKAWDHSALVRALEIMSNFEIGQTPAA

SEQ ID NO: 26331 - protein, 308 aa, Burkholderia cepacia R18194
MTAAFPEILALGEAMIEFNQSQPGRPEFLQGFGGDTSNFCIAAARQGASTGFVSAIGDDPFGRLLADMWRAEQVDTTYVRVDRSAPTGVYFVTHGADGHQFDYLRAGSAASRYAVGDLPLDALAAAKAVHLSGISLAISTAACDAAFAGIDHARRNGAKVSFDTNLRLKLWPLPRARAVMREALRQTDICLPSWDDVTALTGANDRDAIVDAMLEHGPQVVALKLGKEGAYVATPNERRVVPGFAVEAVDATGAGDCFGGAFVARIVAGDDPFAAARYANAAAALSTTGYGAVAPIPHRDAVERLMQG

SEQ ID NO: 26332 - protein, 478 aa, Burkholderia cepacia R18194
MKIYDQFYIDGAWRKPAGTGTIDVIDSGTEAVIGRIPEGVASDAQDAIRAARAAFDAWAATPPATRAGYLRKIVEHLLARSEELAQSITGEVGMPIKLSRAIQVGGPIYNWKAYAKLAESFEFEAQVGNSLVVREPVGVVAAITPWNYPLNQVTLKVAPALAAGCTVVLKPSEVAPLNAFMLAEAIHEAGLPAGVFNLVCGYGPVVGEVLATDPDVDMVSFTGSTRAGKRVAELAAAGVKRVALELGGKSASVILDDADFATAVKGTVNACYLNAGQTCSAHTRMLVPEARYDEARAIAKAAAETYVAGDPRQDATRLGALASAVQQQRVQDYIQRGIDEGAELVTGGTGLPEGLDKGFFVKPTVFGRVDPKSTIAQEEIFGPVLSIITYRDEDEAVRIANDSPYGLGGAVWAGSDERAMGIARRIRTGQVDINGGAWNMAAPFGGYKQSGHGRENGVYGLEEYLEYKSMQLKPAKPA

SEQ ID NO: 26333 - protein, 324 aa, Burkholderia cepacia R18194
MNPMKPRIVAYKPLPDDVLAYLREHADVVQADGTAALADALGDADGAIGASLKVTPQMLDRAPRLKAWSTISVGYDNFDVADLTRRGIVLAHTPDVLTESTADTVFSLILASARRVVELAEWVKAGNWHHSIGPDLYGTDVQGKTLGIVGLGRIGGAVARRAALGFRMQVLYANRSAHAEAETQYGARRVTLDELLAQSDFVCLQVPLSPETHHLIGAAEFAKMKRGAILINASRGPVVDEAALIDALRAGTIRGAGLDVFEKEPLAADSPLLQMKNVVALPHIGSATHETRHAMARCAAENLVGALAGTLRTNLVNPDALAQV

SEQ ID NO: 26334 - protein, 325 aa, Burkholderia cepacia R18194
MDVRQGFVDCVGRTPLIRLTKLSAETGCEILGKAEFMNPGGSVKDRAALYIIRDAERRGVLKPGGTVVEGTAGNTGIGLAHICAARGYRCVIVIPDTQSPDKLAILRTLGAEVRPVPAAPYRDPNNYQKIAGRLADELDNAVWANQFDNVVNRQAHYETTGPEIWRDTAGTIDAFVCATGTGGTLAGVSRYLKEQNPDVRIVLADPCGSGLYGYVKTGDLGAEGSSITEGIGSTRVTMNLAGTPIDDAVRIDDQQCVTMVYRLLREEGLYVGGSSGINVAAAVWLARRMGPGHTIVTLLCDRGDIYRARLFNREWLREKGLDPGD

SEQ ID NO: 26335 - protein, 334 aa, Burkholderia cepacia R18194
MAEYYAQRASAGLIVSEATNVSPVSASFELTPGLITDEQVAGWKKVTEAVHAKGGRIFAQLWHGGRVSSLTLLGGQAPLSPSGVNDDLEQLQVWAQLQNGYYTKIHATPSRAMTTDEVVKTIDEFRQSAAHARSAGFDGVEIHAANGYLPHQFLSSTLNRRDDRYGGTLANRVRFLEEIIAAVGGEIPLSRVGVRISPYAKYNNVRDTDPDATYAYVGRMLDEAGVAYVHAADTNGWSGEPDLPRIIEIVRKSFGGALIVNGGISPDVATKLIMSGDADLVAFARAYIANPDLVERIANKAPLAAPQAVGWYGGDRTGYVDYGRHDATGHTTGE

SEQ ID NO: 26336 - protein, 491 aa, Burkholderia cepacia R18194
MTNNTLLSPATVWSEKIYSNGWTRSNFGNTEDVLEKATGKRLGAIGIASSQDVAKAAAIAREAQKAWANVPGPKRGDVLREFSWLVLVHANEIADQIVRETGSIRAKALWEVQVSAREVLEAAALGSQPEGVLVATAEAGRQSIARRIPVGVIGVITPWNSPFILGSRAIGPALAMGNAVILKPDVQTPIAGGVTFARLFEEAGLPAGLFHVLPGGADTGSALVNEPLVDMISFTGSTRVGRQIGSIAGGQLKRVSLELGGNNPYIVLEDADIEAAASAGAWGAFFHQGQICLTAGRHLVHERVAEAYAAALVRKARALVVGDPFDDRVQIGPIINERQAANVDRIVAETRDQGATVLAGGTRNGLFFEPTVIVGVRPGMAAFDEEIFGPVAPITTFSSDDEAVALANGTDYGLVAAVASADLAHAQRIADRLHSGVIHINDQTVLHEVYGPIGGVGASGNGFNHSTLTNADQFSEWQWITTRQQIPAYPF

SEQ ID NO: 26337 - protein, 474 aa, Burkholderia cepacia R18194
MRTSQQSYIDGQWLDPADSRSIDVIDPSTARPYAQLRIGGTADVDRAVGAAKQAFDTYSRWPVDERVALLRRVLEIYQHRYEEVAQTISQGMGAPIAFARAAQAAVGTAHLEQTIRALQSFRFSTQTDSLLVSHEPIGVCALITPWNWPINQIVCKVAPALAAGCTMVLKPSEIAPFSAILFAEILDEAGVPPGVFNLVHGYGHEVGDALSRHPDVDMVSFTGSTRAGVEVAKAAADTVKRVHQELGSKSPNLILPDADIEDAVTRGVRSCFSNSGQSCNAPTRMLVHVDHLALAEQAARREAERTVVGDPRSTETGIGPVVSRTQFDRIQHFIRLGIEEGAMLVAGGPGRPDGLGDGFYVRPTVFSNVTPDMTIAREEIFGPVLAIMTYRTEDEAVALANDSVYGLAAYVQTKDPERARKVAARLRVGNVHINYPPWNPAAPFGGYKRSGNGREYAEFGLVEYLETKGTTGYA

SEQ ID NO: 26338 - protein, 465 aa, Burkholderia cepacia R18194
MNAVDVNLDADLQAIGKRHLLMHFTHADAYRDHALTVFDRGEGCWLVDRNGKRYFDGLAGLYCVQVGYSHGAEIGDAIREQMVRLPFATNWGVGHEPAIKLAHKLAALAPEGLNRVFFTSSGSESNESAIKLVRQYHQSRGEPQRRKFIARRVAYHGTSFGALALNGMTNFRKHFEPLMSGVRHVGNTKRYGRPVGETEAQFTRHLLDEIESLIVQEGPDTVAALVVEPLQNAGGSLTPPAGYAAGLRDICDRHGVLLVADEVICGFGRLGEYFGSARYGLKPDIITFAKGIASGYVPLGGVIASDTVVDTVLNGPQQMFLHGATYGGHPVACTAALANLAIMEREGVLENVRSNEAVFRQTLDGLLELPCVGDVRGDGYHYSLELVTDKAARRWAAGVSAQAFVSTLLAPAIFDAGLLCRAGVDHEGTPIVQFSPPLVMSRDEIVWFVAKIRDILVDTYARATR

SEQ ID NO: 26339 - protein, 471 aa, Burkholderia cepacia R18194
MNQRQGFDAIVEREKGLHRGLSTGQLSMIAIGGAIGTGLFLGSGFAIGFAGPSVLVSYAIGALIALLLMGCLAEMTVAHPTSGSFGAYAEHYVSPWAGFLVRYAYWASIVFAVGTEVTAIAVYMKYWFPAVPGWYWIVGFSAALIGINLVSVKVFGAVEYVFSMLKIAAIVAFIALGAVVVFGAPAGSGIGFANYTAHGGFFPKGVWGMWVAVIVSIFSYLSIEMIAVAAGEARDPHQAITRAFRATMVRLVFFYLLTLALMLAIVPWTAAGADESPFVKVMAATHVPGAAGVINFVILVAALSAMNSQLYITTRMMFSLSRAGYAPKALGRLTGHGVPAAALGLSAIGIALATVLNVLYPDTSFVMMMSVSMFGAMFTWLMIFVTHLFFRRHHRGQVLAFRMWGFPVTSLLGAALMFAALVTTYFTREFRMTLFCGVPFMIVLSVVYAVWYRGKGAEPAAGREGVHVPGQ

SEQ ID NO: 26340 - protein, 482 aa, Burkholderia cepacia R18194
MRHYIDGAFVETARTFADTSPVDGREIARVCEADEASVDAAVRAARAAQAAGWRDTTPAQRADWLHRIADGIQARFDDFVAAEVADTGRPLAQARTLDIARGIANFRTFADLVRTAGDDCFESQTADGAQYLNYVTRKPLGVVGIISPWNLPLLLFTWKVAPALAMGNCVVAKPSEETPGSATLLAEVIDAVGLPRGVFNLVHGHGPAAAGEFLTRHPGIDAITFTGESRTGSAIMKAVADGVKDISFELGGKNAAVVFADADFDAAVDGIVKSSFTNAGQVCLCSERVYVERPIFERFVAALKTRTEALQVGAPDDPATTMGPLISRGHRDKVLSYFRLAVDEGATVVTGGGVPAFGDARDDGAFVQPTIWTGLPDTARCVTEEIFGPVCHVAPFDSEDEVIRRVNDSAYGLAASVWTTHLARGHRVAKRIETGIVWLNAWFVRDLRTPFGGTKLSGIGREGGRHSLDFYSETTNVCVRVA

SEQ ID NO: 26341 - protein, 496 aa, Burkholderia cepacia R18194
MNQPTFEDWQARAAVLRVEGRAFIDGDARHAHTGATFACVSPIDGCVLAHVADCGADDVDLAVAAARRAFDARSWAGMNPRTRKAVLQRWAALMREHLDELALLETLDTGKPIADTTAIDVPAAAHCVDWYAEAIDKVGGEVAPVDHHLVGLVTREPIGVVAAVVPWNFPLLMAAWKFAPALAAGNSVVLKPSEKSPLTAIRVAQLACDAGVPPGVFSVVPGGAEPGKALALHRDVDCIAFTGSTRTGQQIMACAAQSNLKRVWLELGGKSPNIVLRDCPDLDRAAQAAADAIFFNMGEVCTAGSRLLVHRDIKDAFVAKLVDASRRFAPGHPLDPSVTMGAIVDRTQLDRVMGYIGAGRDEGKLVTGGARVREETGGFYVEPTVFEVKPDAKIAREEIFGPVLSVIVFDEVDEAVRIANDTEYGLAAAVWSADLSTAHAVARRLRAGTVWVNCYGDGSDDMNFPFGGYKLSGNGRDKSLHALDKYTELKSTVVRL

SEQ ID NO: 26342 - protein, 472 aa, Burkholderia cepacia R18194
MNLINGERVAGDGEAFPVVNPATGETVVTMRDASAEQVDAAVAAAAAAFPSWSATPPGARAARLLALADAIEERADEFAALESLNCGKPLHAVKADELPLTVDVFRFMAGAARCVSASSAGEYVAGFTSMIRRDAVGVVGSIAPWNYPLMMAAWKLAPALAAGCPVVLKPSELTPLTSLRVAELAAELFPRGVVNVVVGRGATTGDALINHRQLDLVSLTGGPATASRILEASSRKLMHTHMELGGKAPVIVFDDTNLDAAVEGIRNAAFFNAGQDCAQPCRLYVEDGIYDTFVANLANRVASIRLGAPDDTRTEMGPVISEGHRRRIAGFVDRARDLRHVEILTGGRDVAGGGYFYEPTIVAHARQDDEIVQREVFGPVISVTRFSGAEQAIHYANDSPYGLASSIWTRDVGKAMTVASRLRCGITWINAHGVATAEMPHGGMKASGYGSDMSVYALENYTTVRHVQIAHA

SEQ ID NO: 26343 - protein, 215 aa, Burkholderia cepacia R18194
MLDREGFRPNVGIILLNARNEVFWGKRLREHSWQFPQGGIKYGETPMQAMYRELHEETGLHPEHVKIIGRTRDWLRYEVPDKFIKREVRGHYRGQKQIWFLLRMVGRDCDICLRATDHPEFDAWRWNEYWVPLDAVIEFKRDVYQLALTELSRFLRRPAQRAEKPRGPRLSRYPRVIGVQAQQTLTIVDTSVVCSEIEVEASTLDEMPPHVIVGK

SEQ ID NO: 26344 - protein, 285 aa, Burkholderia cepacia R18194
MSTTLLFHPTPDAAYGFPNARRLARVASPHQQIEVWETPQLGRLFTLDGRPMTSVGDEYVYHECMTHPAALAHPAPRRALVLGGGDGGAARQLLKHACIERIVIAELDDEVVGMARRYLDDVHQGALDDPRVEVVIGDAAHFVESTVEHFDLVVFDLTPPDSPAAGLYTRAFYARLKRILTPCGAISMHLGSPVFHAARIAALLDDLRACFAVVDPLSAHVPLYGSQWLMAIASDTLDAAALFAHDIDERLAARRVQGLRYYDARLHASLFALPCALRDTLGVRR

SEQ ID NO: 26345 - protein, 378 aa, Burkholderia cepacia R18194
MAKRDYYEVLGVAKNAGDDEIKKAYRKLAMKYHPDRNPDNKDAEEHFKEVKEAYEMLSDGQKRAAYDQYGHAGVDPNMGGAGAQGFGGFADAFGDIFGDIFGQAAGGAARGGRGGPQVYRGADLRYSMEITLEQAAHGYDTQIRVPSWVSCEVCHGSGAKPGTKPETCPTCHGQGTVRMSQGFFSIQQTCPKCHGTGTYIPEPCVHCHGSGKVKETKTLEVKIPAGIDDGMRIRSAGNGEPGINGGPPGDLYVEIHIKPHSVFERDGDDLHCQMPIPFTTAALGGEIEVPTLAGRASFPVPEGTQSGKTFRLRGKGIKGLRSSIAGDLYVHVQVETPVKLTDNQRDLLKQFEKSLAEGGARHSPQSKSWFDRVKSFFE

SEQ ID NO: 26346 - protein, 457 aa, Burkholderia cepacia R18194
MSRGGYPKQYLKLTGDRTLVQQTAARLQHIPGAAAPIVLTNNEQRFLVAEQLRQVNITPSSIVLEPVGRNTAPAIAIAALLALHESLDALLLVLPSDHVILNEPAFIAAATEAAAIAADQYLVTFGITPTEAHTGFGYIRRGPAIADGKQVYKVDAFVEKPDAPTAERFVSDGNYSWNSGMFMLKASTYMEELRRHAPEIARQAELAFESAKRDNDFVRLDADVFAACPNVSIDYAVMEKTERAAVVAAADLGWNDIGSWSALADIADADEQGNALIGDIFTDAVTNSYIRAEHRMVAAIGLDDIVIVETADAVLVAHRDKAQDVKKIVEWLNASGRHESVTHRRVVRPWGSYEGIDQGDRFQVKRIIVNPGAQLSLQMHHHRAEHWIVVKGTAMVTNGDKEIMLTENQSTYIPLGATHRLTNPGKIPLELIEVQSGAYLGEDDIVRFEDTYGRAAS

SEQ ID NO: 26347 - protein, 395 aa, Burkholderia cepacia R18194
MSAATFHWDDPLLLNQQLTEEERMVRDAAQAYAQDKLAPRVTEAFRHERTDAEIFREMGEVGLLGPTIPEEYGGPGLNYVSYGLIAREVERVDSGYRSMMSVQSSLVMVPIYEFGSDAQKQKYLPKLATGEWIGCFGLTEPNHGSDPGSMVTRAKKVPGGYSLSGAKMWITNSPIADVFVVWAKLEENGKDAIRGFILEKGWKGLSAPAIHGKVGLRASITGEIVLDEVFVPEENLMPNVSGLRGPFTCLNSARYGIAWGALGAAESCWHTARQYVLDRQQFGRPLAANQLIQKKLADMQTEITLGLQGVLRLGRMKDEGTAAVEITSIMKRNSCGKSLDIARLARDMLGGNGISDEFGVARHLVNLEVVNTYEGTHDIHALILGRAQTGIQAFF

SEQ ID NO: 26348 - protein, 453 aa, Burkholderia cepacia R18194
MSAAPADARVLEVESVIDDTHRPGFHWMLLVLCGLCLVIDGFDAQAMGYVAPSVIAEWGVPKQALGPVFSASLFGMLLGALGLSVLADRIGRRPVLIGSTLFFAVTMLATPFAGSIPVLMALRFVTGLGLGCIMPNAMALVGEFSPATHRVKRMMIVSCGFTLGAALGGFISAALIPALGWRSVFFVGGAVPLVLTIAMVARLPESLQFLVLKGRVAQARDWLAHFAPQAGIDANTRLVVRERAATGAPVAELFSHGRLPVTLLLWAISFMNLIDLYFLSNWLPTVMRDAGYSQGTAVIVGTVLQTGGVIGTLSLGWFIERYGFVRVLFACFACAAVSVGLIGSVAHALPWLLVVVFAGGFCVVGGQPAVNALAGQYYPTSLRSTGIGWSLGIGRIGSVLGPLVGGQLIALNWSNGALFHAAAVPVLCSALFVLGLAGVTRRNGAQAPNAAMN

SEQ ID NO: 26349 - protein, 475 aa, Burkholderia cepacia R18194
MSTQPQIVPTILCGGAGSRLWPVSRESHPKPFIRLEDGESLLQKAFKRGTQLPGVTEVVTVTNRELYFKTSDEFSTVNTGHLSTSFILEPFGRNTAVAIAAAALRVAATLGENAILLVLPADHLVTDDAAFATAVQEAAALALKGALVTFGITPTFAETAYGYIEADGTRVKRFVEKPTVDVARQYVESGSFLWNSGMFCFTAAFLLAEMAKHCPDVLEATRACIAQSRQSEGGGVSLVELNGDLLNRSPDISIDYALMERSDKVAVVRCDIGWSDIGSWNALGDLLKPDDHGNRVDGEALLHDVSNCYIRSDNRLVGAVGVKDLLVVDTPDALLIADRNRAQDVRHVYAALKSQGHETFRVHRTVGRPWGMYTVLEESTRFKIKRIEVKPGASLSLQLHHHRSEHWIVVSGMALVVNNDEEFYLRTNESTYIPAGHKHRLTNPGVVDLVMIEVQSGDYLGEDDIVRFDDNYGRS

SEQ ID NO: 26350 - protein, 307 aa, Burkholderia cepacia R18194
MIHDAPAFVANAASWYEASARQRIDGLLDAGSFSEFLGPAERVTSPHLPLFDLPQQFDDGMVVGHGRLDGQPVFVAAQEGRFMGGAFGEVHGAKLTGLLRAARETGKPVLILFDTGGVRLQEANAGELAIAEIMRALVEARTAGVPVIGLIGGRAGCYGGGGLLAACCSALAVSEQGRISVSGPEVIETNRGVEEFDAKDRALIWRTMGGKHRRLIGGADRYVADTPDAFRAVALELIGRAPKFDAAMLRAEQARLEARVERFGACNDALDVWRALGASAPEAIPGMPDDAFAALADQLQESPHDAR

SEQ ID NO: 26351 - protein, 322 aa, Burkholderia cepacia R18194
MSQNDFAFTRDSLYGTQAEPTFAGATSFMRRRFSRDLDGVDLAITGVPFDSAASHRPGTRFGPRGLRIASTGIAWERPWPWSFDPFDVLAAVDYGDCAFDLGQPESVPGAIERHADAILARGCAMLTLGGDHFITYPLLKAHAKVHGPLSLVHFDAHTDTWPDRDVKRIDHGTMFYHAAREGWVVPERSAQIGIRTTNDEPMGFDIQDARQVHASTPAAIASRIRERVGDHPVYLTFDIDCLDPAFAPGTGTPVSGGLSSHQAFEILRHLEGINLVGMDVVEVSPPYDHAEITSLAGATIALELICLYASRRRQTMEKSNDD

SEQ ID NO: 26352 - protein, 483 aa, Burkholderia cepacia R18194
MDEQLITGRLLIDGELVDSETGEWAASINPATEAVIGRAPAGSRRDVARAVDAAQRAWPAWAERTGEERGELLRGFGERLLERAEELSRIEVLDSGNTYVPTLASMHETVRSLRYYAGLVHGLHGETIPATGRNLHMTVYEPYGVVGRIAAFNHPAMFSAARTASALVTGNTVVVKPPETSPLSVLVLGEVARDTLPAGVFNIVNGTGAEVGDALVRHPDVKRLALIGSVATGQAIQRSAAEVGVKHVTLELGGKNPMIVFPDADPDAAADSAVRGMNFSWQGQSCGSNSRLLVHDDIYDDVLARVVERVAAIRVGDPMSPDTGMGPINSRKSYDHVMSFLDPAQTHGARLMTGGRRPPGHAFEKGFWVEPTVYADVTPGMRLWREEVFGPILSVARWRDVDEVVAMANDTEYGLSAAIWTNDIRQALNTARRIRAGSVFVNGSNTHFLGVPWGGFKNSGVDREEGIEEMYSYVEKKVINVML

SEQ ID NO: 26353 - protein, 463 aa, Burkholderia cepacia R18194
MKNEHTTLLVIGGGPGGYVAAIRAGQLGIPTVLVERDRLGGTCLNIGCIPSKALIHVADAFEQARGHAGEGALGIRVRTPEIDIGKSVAWKDGIVDRLTRGVGALLKKNGVRVLHGDAQVVDGKTVDVVAGGHTTRISCEHLLLATGSEPVALPSMPFGGHVVSSTEALSPETLPKRLVVVGAGYIGLELGIVYRKLGVDVSVVEAAERVLPAYDAELVRPVADSLARLGVRLLLGHKVLGPAEHGAVRVQAADGAEQTLQADRVLVAVGRRPRVDGFGLESLPLDRNGRALWIDDECRTSMRNVWAIGDVAGEPMLAHRAMAQGEMVAELIAGKRRKFMPASIPAVCFTDPEIVTAGWSPDDARAADVDCVSASFPFAANGRAMTLQATDGFVRVVARRDNHLIVGWQAVGRGVSELAAAFSQSLEMGARLEDIGGTIHAHPTLGEALQEAALRALGHALHV

SEQ ID NO: 26354 - protein, 343 aa, Burkholderia cepacia R18194
MKMKAIVMTGANRPWEVQEVAVPVAGPGQVLVKVHASGMCYTDVWATQGFGGDIYPQTPGHEVVGEIVEVGAGVHARRVGDRIGTTWVQSACGRCPYCREHRPLSGQTAVNCDAPRTTGFASQGGHAEYIAVAAEGTVLLPDALAYVDAAPMMCAGYTTWSGLRDAAPQPHEKVAVLGIGGLGHVALQLSRACGFETIAITHSADKRDLAIGLGADRVVENGAALRDLGGADVLLVTTNEFSTAEEAMTGVRVDGRVILCGLDFSKPFSIASQRKPFHMMRQQVIGSTHGGLRYLSEVLDLAAKGKVKPIVETFSLDQATEAYDRLASGKMRFRGVFTPAQSH

SEQ ID NO: 26355 - protein, 452 aa, Burkholderia cepacia R18194
MQRHLSARHIRFLALGSAIGTGLFYGSASAIQLAGPAVILAYILGGAAVYMVMRALGEMAVRDPVAGSFGHYATENLGPFAGFVTGWTYTLEMVIVAIADITAFGIYMGFWFPDVPQWIWVLGVVAIICGLNLCHVKVFGELEFWLSIIKVGAIVAMIGGGVAILLTGMHFGHSADVPTFANLWNHGGFLPNGVGGLIASLSVVIFAYGGIEVIGMSAGEAKDPERVIPRAINAVPARILLFYVLTMVVLMSISPWTGVGNEGSPFVQIFSALGVKSAATILNLVVISAAISAINSDIFGAGRMMFGMARQGQAPRVLMTTSRHGVPWVTVVVMAAALLVGVLLNYLMPKDVFLMVAAIATFATVWVWLMILLSQVAMRRRLSSTEVAALKFKVPLWPVAPALTIAFMGFVIVMLGWFEDTRVALYVGAAWLALLALVFYARIRPKFAPASR

SEQ ID NO: 26356 - protein, 410 aa, Burkholderia cepacia R18194
MTTSTVNRQTFDEVMVPVFSPAPFVPDRAEGSRVWDTAGREYIDFACGIAVTSLGHGHPELLKVLDEQSRKLWHIGNGYTNEPVLRLAQRLESLTFADRAFFANSGAEANEAALKLARRVAFDRHGADKAEIISFVQSFHGRTFFTVSVGGQPKYSEGFGPVPAGIKHLPYNDIDAAKAAIGPQTCAVIVEPVQGEGGVIPADPAFLKALREACDAHGALLIFDEVQTGVGRTGQFYAYMDTGVTPDILTTAKALGNGFPIGAMLTTNELAAHFKVGVHGTTYGGNPLASAIADKVVELIGDPALLEGVRERSVRLKGALERINARFGIFKDVRGKGLLVGAELTAAFDGRAKDFVTAAAENGLIMLIAGPNVLRFVPSLVIPFDLLDEGMKRFEKAVEQVLAAQEATAR

SEQ ID NO: 26357 - protein, 250 aa, Burkholderia cepacia R18194
MQSVPASLSLTDTAFFFDFDGTLVELAPTPDSIHVPPSLLTLLDELQRRSHGAVAIVSGRGIDNIDTFLKMPDMPIAGLHGAERRDANGDTQRIGFNDERLLRIERELAAVVDRHPGMLLEIKGAAVALHYRNAPEREAAARAATERLVADYADAYVLQPGKMVFEIKPKGVDKGRALAAFLDEPPFAGRVPVFAGDDLTDEKGFAVVNARGGLSIKVGAGETSARMRLDSVDALHEQIACWLGAGQSDA

SEQ ID NO: 26358 - protein, 331 aa, Burkholderia cepacia R18194
MAMQKILVARPIFPDVIERLKQYFDVDWHNGDALAPDALAARLADKDGALTAGDLVGAAELAAAPRLRVVANMAVGYNNFDMAAFNAANVLGTNTPDVLNESTADFGWALMMAAARRIAESEHWLRAGHWQKWAYDGFLGSDIYGSTLGVIGMGRIGQALARRARGFGMQVIYHNRSRVAPEIEAELNAEYVSKDALLARADHVVLVLPYTKENHHTIGAAELAKMKPTATLTNIARGGIVDDAALAVALRDGTIAAAGLDVYEGEPTVHPALLEVPNVVLTPHIASATEKTRRAMANLAADNLIAALGEGPRAGQPPNPINPDVIGKPRA

SEQ ID NO: 26359 - protein, 462 aa, Burkholderia cepacia R18194
MSHSGLTRTAAAPPSLSSHAADTARLAAPLAIAQLSQMAMSVTDTVLLGSLGPDSLAAGGLGANFFFVIVTVLQGVLSSVSVSVAHARGAKADERVPHIYWTGFALSVLLAIPAIIALSLSEPILLMFHEPPLLAHHVGEYTGILRFAALGSLIGVGLMRAFLPAIGAARRLLWVSIGGVGVNGVLNYGLIHGAFGLPRLGFLGSAVATTITIWLTALALIWLLHGRQRFRHFVTAARPKLPMMGELIGIGWPVAITYGVESTLFLATGLTIGVLGATSLAAHQIALNVASVAFMVPLAIGQAANVRVGYWVGAGAPVAARHAGFVALGLGVAFMTLSGIVLIVAPHAIVGLYLNLDDPANAATVSLAASLLGIAAVFQIVDGAQTVASGALRGLKDTRIPMLAATLGYWGIGFPTGYWFAFHVGLGARGLWWGLAAGLASVAVLMAWRFHLKSASFVTSPH

SEQ ID NO: 26360 - protein, 307 aa, Burkholderia cepacia R18194
MATAFYTHPDCMLHEMGEWHPECPARLSAIQDQLIASRIDDLIVHETAPFASEVALGRVHTQAHIDYIRSMTPVDGYVEIDPDTLMNRDTWRAALRAAGAAIAATDAVIEGRYANAFCGVRPPGHHAEPARAMGFCFFNNVAIAARHALDVHGLERVAIIDFDVHHGNGTEAAFANDERVLMCSFFQHPLYPFSGVDHQAPNMVNLPMPARSNGMAIREAVDMFWLPRLDAFKPQMLFVSAGFDAHREDDIGNLGLVEADFEWLTAQIVDVARRHAQGRIVSCLEGGYNLSALGRSVVAHLRVLAGI

SEQ ID NO: 26361 - protein, 300 aa, Burkholderia cepacia R18194
MAYKTIEDTIGNTPLVQLVRLPDDEIRARNNVVLAKLEGNNPAGSVKDRPALSMISKAEARGRIKPGDTLIEATSGNTGIALAMAAAIRGYKMVLIMPEDLSVERRQSMAAYGAEIILTPVKGGMELARDLADQMQREGKGVILDQFANPDNPIAHYEATGPEIWRDTEGRITHFVSAMGTTGTIMGTSHYLKEQNPAIEIVGAQPEDGSRIPGIRKWPEAYMPTIFDRSRVDRVENVSQAAAETMARRLASVEGIFAGISSGGACEVAMRIARQVENATIVFIVCDRGDRYLSTGVFPA

SEQ ID NO: 26362 - protein, 360 aa, Burkholderia cepacia R18194
MDDELNSRLKPLRDRIDAIDAQLIALLNQRAAVALEVGEVKKHFNAPVFRPERELQVIARLQDMSAGPLASEHISAIWREIMAASRALEQTIHVAFLGPVGTYSEQAMLEYFGQSIEGLPCPSIDEVFRSVEAGASAFGIAPVENSTEGAVSRTLDLLLQTQLLISGELALPIHHNLLTQSGTLDGVKRVCAHAQALAQCQQWLAANAPQLERQAVASNAEAARLAAADPTVAAIAGDRAAAHYGLQIAFSLIQDDPHNRTRFVIVGKQPAGQSGHDQTSLIVSVKNEPGAVFKLLEPLARHGVSMTRFESRPARVGTWEYYFYIDIEGHRDDASVAAALAELGQKAAFLKILGSYPRAR

SEQ ID NO: 26363 - protein, 427 aa, Burkholderia cepacia R18194
MSNNQILFERAQKTIPGGVNSPVRAFRSVGGTPRFVARAQGPYFWDADGKQYIDYIGSWGPMIVGHVHPEVLSAVQNVLADGFSFGAPTEAEIEIAEEICKLVPSIEQVRMVSSGTEATMSALRLARGFTGRSRIVKFEGCYHGHADSLLVKAGSGLLTFGNPTSAGVPADIAKHTTVLEYNNVAALEEAFGAFGDEIAAVIVEPVAGNMNLVRGTPEFLNALRALCTKHGAVLIFDEVMCGFRVALGGAQQHYGITADLTCLGKVIGGGMPAAAFGGRRDIMAHLAPLGGVYQAGTLSGNPIAVAAGLKTLQLIQAPGFYDALTAQTKRLADGLAAEARAAGVPFVADSIGAMFGLYFTERVPTSFAEVTKSDTERFNRFFHLMLDEGVYFAPSAYEAGFVSSTHDDAVIDATLAAARRAFAALAA

SEQ ID NO: 26364 - protein, 477 aa, Burkholderia cepacia R18194
MLKETYPYYLANEAVYANTDLEVTDKFSGKVATRVALADAKAIDAAIGAAVDAAKPMRELPAFKRQAVLDHCVARFRERFDELAEALCIEAGKPINDSKGEVTRLIDTFRVASEESVRIDGEIINLEISARAQGYTGYTKRVPVGPCSFISPFNFPLNLAAHKVAPALAAGCPFVLKPASRTPIGALIIGEVLAETDLPKGAFSVLPAHRDGADLFTTDERFKLLSFTGSPAVGWALKEKAGKKKVVLELGGNAAAIVDADQRDRLDYVVERLAFGAYYQSGQSCIGVQRILVHADLYDALREKLIAKTRSLKMGDPKDPSTFVGPMISESESRRLSGWMDAAVAAGAKIVAGGKVDGAMFEATLLENVGHEQDLYRKEAFGPVAILEKFDRFDDALARVNDSDFGLQAGVFTDSLTHAQRAWDELEVGGVVINDVPSFRVDNMPYGGVKDSGLGREGIRYAIEDMTELRLMVVRRR

SEQ ID NO: 26365 - protein, 406 aa, Burkholderia cepacia R18194
MSADPFVIVGAGHAARRTAEALRERDAAARIVMIGAERELPYDRPALSKDALLSDGGEQRAFVRDAAWYDAQRIELRLGTRVDAIERDAQRVRLDDGTTLPYASLVLATGSRVRTFDGAIDEGVKPHYVRTVDDARTLRAQLLPGRRVAVLGGGFIGLEVAAAARQLGCEVTVIDPAPRLLQRALPEVVGAYAHQLHDARGVVFQMATLPRAIRRAPGGGAIVETDRGDVPADLVVVGIGVVPNVELAQAAGLDIDNGIRVDAGCRTVDPAIFAAGEVTMHFNPLLGRHVRIESWQVAENQPAVAAANVLGADDTYAELPWLWSDQYDCNLQMLGLFGSERTIVVRGDPANGPFTVFGLGDDGKIVAVAAANLGRDIGASRRLIAAGAVPDPVKLADPAVNLKAFM

SEQ ID NO: 26366 - protein, 482 aa, Burkholderia cepacia R18194
MIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 26367 - protein, 431 aa, Burkholderia cepacia R18194
MTDQAASNWRLETIAVHGGYRPDPTTRAVAVPIYQTVAYAFDDTQHGADLFDLKVQGNIYTRIMNPTTDVLEQRIAALEGGIGALALASGQSAVTYAIQTIAEAGDNIVSASSLYGGTYNLFAHTLPQYGITTRFADPRDPASFEPLIDARTKAIFAESVGNPLGNVTDIAALAEVAHRHGIPLIVDNTVPSPYLLRPFEHGADIVVHSLTKYLGGHGTSLGGAIVDSGKFPWAEHADRFKRLNEPDVSYHGVVYTEAFGPAAYIGRARVVPLRNMGAAISPFNAFQILQGIETLALRVERISDNALKIAQHLARHENVEWVNYAGLPDHPDHPLVARYLSGRAPGILTFGVKGGRDGGAKFQDALKLFTRLVNIGDTKSLATHPASTTHRQLSPAELAKAGVKEETVRLSIGIEHIDDLLADLDQALAQL

SEQ ID NO: 26368 - protein, 459 aa, Burkholderia cepacia R18194
MTQHFDAIVIGTGQAGPPLAARLSAAGMKVAIIERGRFGGTCVNTGCIPTKTLIASAYAAHLARRGSEYGVSVGGPVTVDMKAVKARKDQISGRSNQGVEQWVRGLANTTVFQGHARFERADAVRVGDALLEAERIFINVGGRAQVPAMPGLDTVPYLTNSTMMDVDFLPDHLVIVGGSYIGLEFGQMYRRFGSKVTIVEKGSRLIRREDEDVSQAVRDILEKEGIDVQLDATCLSARRNGDGIAVGLDCVGGGREVAGSHLLLAVGRVPNTDDLGLDRAGVATDARGYIEVDEQLRTNVPGIWALGDCNGRGAFTHTAYNDFEIVAANLLDGDPRKVSDRIAAYALYIDPPLGRVGMTFAEAKQTGRRLLVGTRPMTRVGRAVEKGESQGFMKVIVDADSHAILGASILGVTGDEVVHGMLDVMAAGAPYTTISRAMHIHPTVSELVPTLLQDLHPVE

SEQ ID NO: 26369 - protein, 465 aa, Burkholderia cepacia R18194
MSASTARAADGKRYTYEWYVVVICMLAYVFSFVDRQVLVLMIEPIKRDLHLSDTQFSLLNGFAFSLFYAVMGLPVAYLADRYARPRIIALGIALWSVATAACGLSQHFVQMFIARMGVGVGEAALSPGAYSMLADYFPKEKLGRAIAVYSLGSFIGGGVAFLIGGYVIALLKHASAFTLPVVGQVHAWQVTFLIVGLPGILVALLFAATVRDPQRKGLAQDRSGAVRRVSMRDSLRFVGTHRATFSCHYLGFSFYAMTLYCLLSWTPAFYIRHFGMTAVEAGYTLGIVLLVANTAGVFCGGWLNDWLLRRGREDAPMRAGAIGAACMVIPATLFTQLDSLPASLATLVVAMFFASFPMPTSTAAMQTLAPNQMRAQISALFLLVSNLIALGIGTTVVALFTDRVFGAPAAVGHSMSIVNVAAATLAALLLAAGCRHYRRSLDRERGHAPAAAPHAAEAGNAIAAR

SEQ ID NO: 26370 - protein, 481 aa, Burkholderia cepacia R18194
MKPSHPIETDALARLDNLPWTRFHTLMLVALGVGWALDSFETNIIGSVFGVLKSHWHLSAAQGSLAVSIWVFGMLVGAIAFGYLADRYGRKRLFLATLLWYAFFSVATVLSWNYESFLFFRAMTALAVGGEYSAVTATMGEFIPKRHRGRTDALILSGFPVGALLSAAVSYLVLNQLPAEWAWRVGFGLGTTMALVFFWIRRVIPESPRWLIQQGRVAEADAIVEQVVASAARDPLAQADRALLTKRYAPTRYAHQAPAFWRNVGELFGAYRARCALAGALNFSQAAVVYGVLSLMALVILPYMKVASTDMPLYYMIGNAAALAGGIVAAVLVEAWGRRASLFVSYTFTVAAIVFIYAMHALPGMVLGYCLIQFGVTWAYISGYVVSSEILPTRIRATGLGVSVAIGRLGAVVAPLMLTNVYAMSGSPSAALIVLLVLALPGPLAAGLWWINGRETRRISLEECSTEADAQPAVDAAPRVA

SEQ ID NO: 26371 - protein, 414 aa, Burkholderia cepacia R18194
MNLFTPLTLPNGAVIPNRLAKAAMEENMADANHAPSDALLRLYQAWADGQVGLILTGNVMVDGRAMTGPNGVVLESDAHLDRFRRWAQVARSGGAHVWMQINHPGRQMQAALGQTTLAPSAVPLALGALSKQFPVPKEMTPADIADVKQRFVRAAQLAEQSGFTGVEIHAAHGYLLSQFLSPLTNRRQDQWGGSIENRARLLLDIVRDVRATVSPEFAVAVKLNSADFQRGGFSADDAKRVVELLNPLGVDLVELSGGSYEVPAMQGEARDGRTLAREAYFLEFARDITAVARMPLMVTGGIRRRVVAEQVVDSGVAMVGIATALSIEPNLPRDWRAGKDSAPVLEPIRWKNKALGALANMAVVKFQLTRLSEGRRTHPQVSPLRALVRQQLAAQCQTRRYRKWMAGRVAGSRA

SEQ ID NO: 26372 - protein, 488 aa, Burkholderia cepacia R18194
MQTQLFIDGRFVDAVDRGTIDVLNPHDGSVITKIAAATAADVDLAVEAATRAFPKWSALPAAERGRLLLRLADAIEANAEELAQLESLDTGHPIRDSRALDVPRTAACFRYFGGMADKLQGSVIPVETGFLNYVQRAPIGVVGQIVPWNFPLMFTSWKMGPALAAGNTVVLKPSEITPLSTLRIVELMAEVGFPAGVVNIVPGYGHTAGQRLAEHPGVGKIAFTGSTATGRRIVEASQGNLKRVQLELGGKGANIVFDDADLDAAINGAAWAIFHNQGQACIAGSRLVLHERIADAFLERFVALASSIRIGNPLDANTEMGPLTSKQHLDRVLSFVDVAREQGGRVLTGGSAPQDPALANGYYVRPTVIEAKSAADRVAQEEVFGPFVTVLRFGSDDEALAIANATEYGLGSGLWTKDLSRAHKMASQINAGMCWINCYKRVNPGSPFGGVGQSGYGREMGFEAMHDYTEARSVWVNVDGNVPPHFKR

SEQ ID NO: 26373 - protein, 397 aa, Burkholderia cepacia R18194
MAAHLASPASEAEIAELVHTATRQGKHVRCAGSGHSFTPVVATSGLLLSLQDYQGIVAVDEARKRVTVKAGTKINAVTRHLKELGLSLVNQGDIDSQAIAGALATGTHGTGTTLSNLSSQVVGMRIVRPDGSIMTVSDRQDLDLLHATQVNIGMFGVVSELTLQVTDAFWLHDRVWREDFDALMAQYDDLAAKHRHFSFFWCPTSASRDLYCLPDTTKVSNSKKDYDVCEIKVMDVTDARTFHEGEHEKIAYSSEVYAIHYVPNFHELEYAVPAQHGKEALRRVRELILTKHRDCIFPVEYRFTKGDPAWISPFNHQDSVTISCSGGPNGVDYWPFLKDVDTILRDYGSRPHWGKLHFTNREDVDRWFPKAEAFRALRRSVDPEGYFLNDHLRTLFS

SEQ ID NO: 26374 - protein, 308 aa, Burkholderia cepacia R18194
MGGNEMPRFGGIATMMRLPQAETTDGLDVCFVGVPLDLGTSNRSGSRFGPRQIRTESVLLRPYNMATRAAPFDSLQVADIGDVATNPYDLKDSVRRIEEAYDEIVANGCRPITLGGDHTIAWPILRALHKKYGQVAVVHVDAHADVNDTMFGEKIAHGTPFRRAVEDGLLQCNKVTQIGLRGTGYHADDFDWCRQQGFTVVQAEECWNKSLAPLMAQVRERVGDTPVYLSFDIDGLDPSFAPGTGTPEIGGLTVQQGLEIVRGMKGLNIVGADLVEVAPPYDPTGTTALTGANLAFEMLCVMPGVAYR

SEQ ID NO: 26375 - protein, 480 aa, Burkholderia cepacia R18194
MLPAAHIAGQPVRTHADAPGAPIFDASTGAAIGWQEFATAAHVDAAVRAARDAFAGWRDTPPAERGRILAKIAERVEASRDRLAALQMQVSGKPPFEAEADVGDVAATFAYYAKLCEDPALFAAEPVALPSDAVTAERFYDSVGVAALVMPWNFPMVTTAWKLAPALAAGCAVVLKPSELTSPTEHALLDIVAEAGVPAGVVNVVNGGAEVGAALTAHPLIDKISFTGSTAAGRKVMQAAAVDMKRVTLELGGKSSLIVRDDADLDVAVSLAVAGAFTNAGQMCSATARILVHDSVYRSFMAAFETAVRALVVAPPAAEQVAMGPLISAAQRTRVEAMLQQGIDAGARVAFSGRVADAGGDGFFMAPVVIAEPAADNPLWTDEVFGPVACVKSFRTDDEAIALANDTRYGLVATVVTRDAAIAKQFQQRVRAGLVWINAPQLIYPHVCWGGFGLSGIGRELGVAGLRSYQELRHAMHAID

SEQ ID NO: 26376 - protein, 427 aa, Burkholderia cepacia R18194
MAYRNYHKRKIADRELHPETQMMSYGYDPFLSEGSVKPPVFLTSTFAFRTAEDGAEFFDVVAGRKPSPEGEGAGLVYSRFNHPNLEIVEDRLALLDDSEAAVVTSSGMSAIAAILLTFLRPGDCVVQSVPLYGGTETLISKFLPEWGIRSEVIADGLSTHAIRAALEAAAQKGNVRMCYIETPANPTNALFDLEGLRSEIDAFEARHGYRPLSVCDNTLLGPLYQKPSRQGIDLSVYSLTKYIGGHSDLVAGGVTGTRELITKIRSIRSTLGSQLDPHSCWMITRSMETLVLRMQQAARSGSTVARWLADNPHRPVRVLHPELIDEPAYQAVYQRQCTGPGSTFAFILDGGREQAFRFINHLTLFKSAVSLGGTESLICHPASTTHSGVPADARAAAGVSEGLIRVSVGLEHPDDLIADLSYALEHC

SEQ ID NO: 26377 - protein, 483 aa, Burkholderia cepacia R18194
MNEFLRTGHYIGGEWHESHGASDATYPVLNPATGETIAKVAKGGADDTQRAIDAAAHAFPAWRALTAKERGARVKRWGELMLENRDALAELLTREQGKPLAEARGEVVYAASFLEWFAEEAKRMYGDVIPSPKPNSQIVVTREPVGVVAAITPWNFPLAMITRKAGPALAAGCTMVLKPSEETPLSAFALAVLAERAGVPAGVFNVVSGDAVAIGETLTSSSVVRKLSFTGSTRVGKLLAKQSADTLKKLSLELGGNAPFIVFDDADLDAAVEGAIASKFRNTGQTCVCVNRFLVQDGVYDAFTRKLADAVRKLRVGNALAGEVDQGPLINEAALGKVERHVADATAKGAHALTGGKRHALGGTFYEPTVLTGMTADMLIAEEETFGPVAGCFRFATEEEAVAAANDTPFGLSAYFYTRDLGRAWRVSGALESGMVGVNDGIISTEVAPFGGVKQSGLGREGSKYGLDEYVELKYTLMAGLGR

SEQ ID NO: 26378 - protein, 444 aa, Burkholderia cepacia R18194
MPLSRGADAPHRPVALDDVPLNRFHVKIAGLTFGAHFTEGYTLGTIGYALAALGKQMPIDAFWMGMIGSSALIGIFFGSLVFGWLSDRMGRQKIFLTSFVIITAAAFAQLFVTSPLELCMLRVLIGFGMGGDFTVGHAILAEFSPRKHRGALLGSFSVIWTIGYVAANVLGLAYSDAAPDAWRWLLASAALPALIVLVLRIGTPESPRWLLGKGREKEARAIVAKHFGPHVMLDGSTEPHAHGGFSRLFQRDLIRRTVFNCAFFVCLVIPYFAIYTFLPTILKTIGLAEGFGADLLLNGFLVLGALIGIWLTIRLSRRGFLIGSFAVTCASLVALAVLPSSAAIAMIVAFAIFTLTMSAFSNLVGVFPPECFPTEVRASGVGLAIACSRLGSAIGTFLLPVGIATLGFHATMFALAGVLLVGMIVSIAWAPETKHLTLEEASGH

SEQ ID NO: 26379 - protein, 307 aa, Burkholderia cepacia R18194
MGLSYGYGPATDTASGIALIRAAFERGVTFFDTAEAYGPFVNEELVGEAVAPFRDEVVIATKFGFEDGQAMKGVDSRPSHIRDVADAALKRLKIDRIDLFYQHRVDPNVPIEDVAGTVKDLIREGKVAHFGLSEAGEQTIRRAHAVQPVAALQSEYSLWWREPEARILPTLEELGIGFVPFSPLGKGFLTGAIDANTTFAENDFRNVVPRFSEENRNANAGLVDLLGRIATDKGVTRAQIALAWLLARKPWIVPIPGTTKLHRLDENVGAAEVVLTADDLAAIETALQQIRIVGERYPAHFQQRIDR

SEQ ID NO: 26380 - protein, 338 aa, Burkholderia cepacia R18194
MNLQRFPRYPLTFGPTPIQPLKRLSEHLGGKVELYAKREDCNSGLAFGGNKTRKLEYLVPDALEQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAQLGFKFDYIVVCSVTGSTQAGMVVGFAADGRANRVIGIDASATPERTHEQITRIARHTAELVDLGRPITTADVVLDTRYAGPEYGLPNDGTLEAIRLCARLEGMLTDPVYEGKSMHGMIDKVQLGEFEPGSKVLYAHLGGVPALSAYHETFRNG

SEQ ID NO: 26381 - protein, 503 aa, Burkholderia cepacia R18194
MYDTEPLAATRGPAGGQPEPRRVRNFIDGDYRAGDRWFDKRSPLDNAVIARVAEASRADVDAAVQAARAALSGPWGGLTVAQRVDILYAVADGITRRFDDFLEAEVADTGKPVSLASHIDIPRGAANFKVFADVVKNVPGETFEMATPDGAGALNYAIRRPVGVVGVICPWNLPLLLMTWKVGPALACGNTVVVKPSEETPQTAALLGEVMNAAGVPRGVYNVVHGFGPGSAGEFLTTHPGVNAITFTGETRTGAAIMKAAADGARPVSLEMGGKNAAIVFADCDFDAAVEGTLRSCFANAGQVCLGTERVYVERPLFERFVAALKAGAEQLRPGRPEADTTGIGPLISQEHRDKVLSYYRKAAELGATVVTGGGVPDMPADLRDGAWVQPTIWTGLGDDSPIARDEIFGPCTLVMPFDSEAEVIGRANANAYGLSTAIWTTHLARAHRVAASIDVGIAWVNSWFLRDLRTAFGGAKQSGIGREGGVHSLEFYTELRNVCIKL

SEQ ID NO: 26382 - protein, 455 aa, Burkholderia cepacia R18194
MSTPASHAGLAAVLRDAAAAGATVRAAGAGHSFSPLVQTDDVILSLDGMQGVIDVDRDRRVARVHAGTRLWALGPALAAHGLAMENLGDINVQSIAGATSTGTHGTGITLGNLSTQIDSLTFMCADGSEIRASADTHPELFAGGRIGLGALGVLTEIGLRLVPAFKLRLERGGMQLDDCLAQADTLIAKHRSFEFYWFPHTDTVLTKAWDMTDEPADSVHWASRASESFLENTVFGALCGLGKRVPSLCPALSRLCASTVSAGRHVDASYAMLSTVRRVRFNEMEWSVPAERGADALREIRSFIARRSFPLMFPIEYRWVRGDDIWLSPDYGRDSVRISVHQYRGMPFDAYFSGVQAICRNHGGRPHWGKVHAMKAAELAACYPHWDDFLALRERMDPLGRFLTPYLRTLFGLPQHASASVASTARATPARRGTPPMHETAGIAQHRPRSNQEAS

SEQ ID NO: 26383 - protein, 337 aa, Burkholderia cepacia R18194
MTAIEIVRPGGPDVLVPTTRPVPSPRHDEVLIRIHAAGVNGPDVFQRKGLYDPPPGASDIPGLEVAGEVVAVGRDVTRFALGDEVCALIPGGGYAEYAVANESNTLAIPDGLDMTEAAAMPETFMTVWLNLFQRGRFAAGDSVLIHGGASGIGTTATMLAKAFGASTIITTVGSEAQRDASLRLGADLAIEYRNEDFVDAVKRFTDGKGVDVIVDIIAGDYVARNFAAAAMNGRIVQIGVINGPAKELDLFPMLTKRLTHIGSTLRSRTYEEKAQLIRELEEAVWPLIRQGTVKPQVYRTFDLRDASGAHALMDSGRHIGKIVLRTPASATDGKHST

SEQ ID NO: 26384 - protein, 478 aa, Burkholderia cepacia R18194
MNWIDGEWVDSPAHRDSVDPATGSVIGRYADGGEPEARAAIDAALRAFRDTPWKHDAALRARVLDELAAAFERHADALIELLALENGKIKPEAHFEVSMVPSKLRYYAALARAETGRSGTPRPDVVSLVLREPMGVAGIIVPWNSPVVLMVRSLAPALAAGTTTVIKMPGQTAQTNAFVSRILSEAPSLPRGVINLFSESGADGSKTLIASPDVPVISFTGSTATGRAISAVGAQRLKRFGLELGGKTPHLVFDDTDLDAALPVIEKSLTVFAGQFCMTGSRLLVQRGIADVVRTRLAQRLATVRVGPAADPLSDMGPLIDKPNVERVDRAVEEAIAAGAKVVVRGGPVTDGELARGAFYRPTLLEVDSPRLDIVQKETFGPVMTMQVFDTEAEAVALANDSEYGLAAAVWTRDVQRSMRVARSLQAGTIWINDWAKVYDEFEEGGYRQSGLGRLNGAAAIDDFIEYKHITLTTGDAL

SEQ ID NO: 26385 - protein, 312 aa, Burkholderia cepacia R18194
MPIDNHIAALLARLALAEPPSSLDALRQATETTLTGWHGPLEAVDRTETFAVPTRDGRQIRVRAYWPAATSAHAERQPAIVYAHGGGWCLGTLELYDNPCRALANATQCVVLSVDYRLAPEHEFPVPLEDFCDALDWVFGEAAGLGLDPARIAVGGDSAGGNLAAAACLVARERGGPSIAHQLLLYPPLDASMSTTSYRTCGQGYYLTDEIMQYCFDLYLADPADGSSPSVSPLRAASLEGLPPATLLACEYDPVRDDAHAYAARLREAGVPVDCVVLPGMIHACIHMVGVTPAARQVFDVAGAQMRRAFQR

SEQ ID NO: 26386 - protein, 237 aa, Burkholderia cepacia R18194
MVNKIFESLQSAVADIHDGATIMIGGFGTAGMPSELIDALIEQGARDLTIVNNNAGNGETGLAALLKAKQVRKIICSFPRQSDSQIFDGLYRAGEIELELVPQGNLAERIRAAGAGIGGFFTPTGYGTKLAEGKETRVIDGKPYVFETPIHADFALVKAYKGDRWGNLVYRKTARNFGPIMASAAKVAIVQVSEVVPLGALNPEHIVTPGIFVQRIVEVPQAAHAAELAAEHASQAA

SEQ ID NO: 26387 - protein, 484 aa, Burkholderia cepacia R18194
MTAEYTLQHRIAGEACDAAQGEWFEKFEPCTGHLLARVAAGTGADVDRAVRAARAEFDGGHWSRLPGAARAKLLHRLADLLEHDAERFVELLVREQGRPALEVRMMDLPMSIDTLRYFAGWADKLEGRQIPTGGFMGRPTVNYTVREAVGVAGLIVPWNAPLMIACWKLAPALAAGCTVVIKPSEDAPLAVGALADLAAQAGFPPGVVNLVHGIGASVGAALVNHPGVDKISFTGSTEVGRTIAREAGARFKRLTLELGGKAPQIIFDDANLEQAIAGVAMGLFVNQGQTCAAGTRVLVQRRHYDDVVGALAHAARSVKVGTPFDPDTQMGALISARHADRVKTHIAAALRDGATMVAGDEPVPSQGFFVRPTVFANVDPAMRIARDEVFGPVGTIIPFDTEDEAVALANDTVYALSASLWTRDLTTAHRTAARLRVGAVAVNAWSPLDARLPWGGFKESGVGRDLSQSGLDAYLEEKVVTIAM

SEQ ID NO: 26388 - protein, 477 aa, Burkholderia cepacia R18194
MLIAGEWCAARDGRTFDRFNPATGALASRAPAAGLADADAAIDAAHRAFPAWSALAPTERRRLLLKAADLMDARIDTFIATGVAETGATPGWIGFNVTLAANMLREAASMTTQIAGDVIPSDVPGNLALAMRVPCGVVLGIAPWNAPVILGTRALAMPLACGNTVVLKASEACPGVHALIGAVLDEAGLGAGVVNVITHAAVDAPELVERLIAHPHVKRINFTGSTHVGRIIARHAAAHLKPVLLELGGKAPVLVLDDADLDAAVDAIAFGAFFNQGQICMSTERVIVARPIADTLVERLAAKARTLVAGDPLAGHPLGTMVDAAAAARAASLVEDARAHGAQLPLGCRVEGATMQPAIVDGVTRDMRLYREESFAPVVAILRADSDDEAVALANDSEFGLSSSVFSRDVARAMAVARRIESGICHINGPTVHDEAQMPFGGTKASGYGRFGSRASIAEFTELRWITVQTVPRHYPI

SEQ ID NO: 26389 - protein, 463 aa, Burkholderia cepacia R18194
MQQHTMRRELGARQISFMALGMAIGVGLFLGSASAIKAAGPGALVAYLIGGAMIFLIMRALGEMAVHRPVSGSFGAYAFEYVGPFAGYVVGWSYWLLMVGVGVAETTAIGIYMGFWFPDVPQWLWVVSAIAAISAFNLLNVKVYGELEFWFAIVKVVTIVLMIAGGALIVFTGIGHGGVPVGLSNLWRHGGVFPHGVLGVVSALPIVAYSFAGVEMIGLTAGEAREPQKMIPRAINSVLWRILIFYVGALFIIMALYPWHELGEHGSPFVTTFESLGLRQAAGIVNFVVVTAALSSFNCIVFSGARMLSSMAGNGLAPASFAALSASGSPSRAVRATVLFMSVGVVLNYVIPARVFGWLMSFLSFDVAVIWAMIVLTHMRFRRALAARGETVAFRMPYASVTSWICLVFVAFVFVMLGVDPTTRGSLYAGAAVMALMAIIYRRSRHLQAAARSTRVGLGVERV

SEQ ID NO: 26390 - protein, 312 aa, Burkholderia cepacia R18194
MDTLHLVDREIRPLLVAWPTVTLSADTLAQSRERVLPLPPPDLAGSTLERRAVPGPAGAPDVPVLVYRPDAGVRPLPAIVHMHGGGYVRGAAKDLEAVHRSVVTELGCALISIDYRLAPETVFPGAIEDCYAALAWVFRQADALGIDPARIGVAGESAGGGLAAALALLARDRGEYRLAFQHLIYPMLDDRTCTRAPHPHAGEFVWHAANNRFGWSALLGHAPGLDGVSPYAAAARATQLEGLPPAFLSVGSLDLFLDENLDYAQRLLRAGVPTELHVLPGGVHGFDIVPGARVAETARRLSHDALRRFLHG

SEQ ID NO: 26391 - protein, 462 aa, Burkholderia cepacia R18194
MSDTPVQPTVGVGAEETDFGTKGVIDRYFGISSRGSTQRREIIAGVTTFLAMVYSVFVVPGMFGKAGFDTSAVFVAVCLTTAFGSLLMGLWAKLPIAIGCAISLTAFTAFGLVLGKGLSPTVALGAVFLMGLVFTGISVTGVRSWILRNLPAGVAHGTGIGIGLFLLLIASNDVGLVIKNPGAGLPVSLGQITAFPVIMSVIGLAAIFGLEKRRVPGGILLVVIAISIFGLIFDPSVKYHGIFALPSLSAPGHASLIGAMDIKGALSMAVLPSVLALVMTAVFDATGTIRAVAGQAGQLDENGRIINGGRALTADSLSSIFSGFLGGAPAAAYIESSVGVAAGAKTGLAAAVVGLLFLVVMFFSPLAGLVPSYATAPALMYVGLLMLGSVSKLHMDDMVDAMSGLVCAVFIVLTANIVTGIMLGFSTLVIGRIASGEFRKLNVGTVLIAAVLVTFYLGGWAI

SEQ ID NO: 26392 - protein, 371 aa, Burkholderia cepacia R18194
MTQDPLFQPLRFGALTLPNRIVMPPMTRSRASQPGDEANELMAAYYAQRASAGLIVSEGTYVAPLGKGYAWTPGIHTPSQVAGWRKVTDAVHAAHGRIFAQLWHVGRLSHTSLLGGRQPVSSSPLQAKGVNVFVAGEDGSTPGFVQASEPRVLTIDEIREIVDQYRTAARHAIEAGFDGVELHGANGYLVNQFIDSNANTRTDAYGGSLENRLRFLREVTQALIDGTGDASRVGIRLAPLTTLNGCVDDDPETTYLAAATLLGKLGVGYLHIAEADWDDAPLMPVEFKQQLRAAYPGVLIYAGAYTAERARDAIAAGWADLIAFGRPFVANPDLPERLRTGAALAPHDRNTLFGGGERGLTDYPTLAQAAA

SEQ ID NO: 26393 - protein, 489 aa, Burkholderia cepacia R18194
MSTVQETLALKDPSLFRQQAYVNGEWQGATNGETFEVRNPATGGLLGTVPAMGTAETRHAIEAANAAWPAWRKKTAKERAVVLRKWHDLMMEHADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGEMTSNPIVRKLSFTGSTPVGRLLMSQCAATVKKVSLELGGNAPFIVFDDADLDAAVQGAIASKYRNSGQTCVCTNRFYVHEAVYDQFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 26394 - protein, 429 aa, Burkholderia cepacia R18194
MTVKNADLQARKNAATPRGVGVMCDFYAARAENAELWDVEGRRFIDFAAGIAVLNTGHRHPKIVKAISDQLNNFTHTAYQIVPYASYVELAEKINARAPGDFPKKTAFFTTGAEAVENAIKIARAATGRPGVIAFSGGFHGRTMMGMALTGKVAPYKLNFGPFPGDVFHAPYPNAVHGVTTADSIKAIEMLFKADIDPKRVAAIIFEPVQGEGGFYAAPAEFVRALRKICNEHGILLIADEVQTGFARTGKLFAMQHYDVLADLITMAKSLAGGMPLSGVVGRADVMDAAAPGGLGGTYAGNPLAVASAHAVLEIIDEEKLCERATQFGDVLKAKLNALQADVPQIADVRGPGAMIAVEFLKPGSGEPDAEFTKRVQTRALERGLLLLVCGVYSNVVRFLFPLTIPQAVFDEALVILEEVLKETVGVPA

SEQ ID NO: 26395 - protein, 286 aa, Burkholderia cepacia R18194
MDASEFSKFLKAALPPQATAGAALTVTEVEIPGYAQDIVLRLYRRPDKTGLPVVLYFHGGGFVRGSLEDADFAARFLAERLPALVVSVDYSLAPAFPFPAAPEDAYRAAVWAATRARAFGGNPKKIGVAGHDAGGQLANCLAFIARDRGEVQIVAQALFGPMLDPSMTRIGDADRLASDITPRECAACYRAYLPQAAQRMHPYAAPLESVRLAGLPPTLVVTAQNDVLHVEAEKYASCLISSGVLTQVIRYPDITHAALATHEAAFEEAVRFFQCRFQARQPNRSE

SEQ ID NO: 26396 - protein, 487 aa, Ralstonia sp. SJ98
MQTQLFIDGRFVAALSGETLATLNPHDNSEIAQVSMAGREDVDRAVQAAKKAFPAWSAMAAADRGRLLLKLADAIEANADELARLESMDTGHPIRDTRNLDVPRTAATFRYFGGMADKFEGSVIPVEASFLNYLTREPVGIVGQVVPWNFPLMFTSWKMAPALAAGNCVVMKPAELTPLSSLAIAQLMAEVGFPAGVVNVLPGFGHVAGQYIAEHPEIGKVAFTGSTAVGRKIVQASSGNLKKVQLELGGKGANVVFGDANLDAVVQGSAFGIFHNQGQACIAASRLIVHESIADDLLERFTSLARSIRIGDPLDPSTEMGPLTSQMHRDRVLSYVDVAREQGGRVLAGGKSPDAAGLAKGCYVEPTIVQAKPTDRVAQEEVFGPFVTVSTFKSDEEGLAIANGTEYGLGAGLWTRDLQRAHLFARQLKSGMVWINCYKRVNPGSPFGGVGASGYGREMGFEVMREYTQAKSVWVNVDANIPPYYPR

SEQ ID NO: 26397 - protein, 340 aa, Burkholderia cepacia R1808
MKTYFHPEQLLHHPRTYLSRGRMREPQEVPERAARLVAAVRALDFDVCEPADRGTAPIAAVHDMNYLRFLEEAHRDWKRMPDDWGDEVMSNVFVRDPNPLRGILAKAARYLADGSCPIGAHTWRAAYWSAQSALAAAAHVNDGARDAYALCRPPGHHARRDAAGGFCYLNNAASAAQALLGRHRRVAVLDTDMHHGQGVQEIFYDRDDVLYVSIHGDPTNFYPVVAGYEDETGAAAGDGYNLNLPMPHGAPESAFFERLDDALRALARFEPDALVLALGFDIYKDDPQSQVAVTTDGFGRLGGALGALALPTVIVQEGGYHLESLDANARAFFSGFAAAR

SEQ ID NO: 26398 - protein, 369 aa, Burkholderia cepacia R1808
MSALFEPFKLKDVTLRNRIAVPPMCQYVAEEGVVNDWHHVHLAGIARGGAGLVIAEATAVAPEGRITPGCAGLWTDAQAEAFAPSVAAIKAAGAVPGIQIAHAGRKASANRPWEGDDHIAEGDPCGWQTIAPSAIPFGAHLPKMPRAMTHDDIARVQADFVASAQRARDLGFEWLELHFAHGYLGQSFFSVHSNQRDDEYGGSAENRGRFLVDTLKAVRRVWPEHLPLTARLGVIEYDGRDEETLAESIALVQRMKQEGLDMLSVSVGFSTPDAQIPWGPAFLAPIAQRVRRETGLPVSSAWGIDTPQLANRVVAEQQLDLVMVGRAHLADPHWPYYAAKQLGVERPSWTLPAPYAHWLERYRVADKVA

SEQ ID NO: 26399 - protein, 240 aa, Burkholderia cepacia R1808
MVGTYNGPTADAPGHTLGGYSQEIVVHERYVLRIRHDEAQLAAVAPLLCAGITTYSPLRHWKVGPGHKVGIVGIGGLGHMDIKLANAMGAYVVAFTTSGSKREAAKALGAHEVVVSRNADEMSAHAKSLDFILNTVAAPHDLDAFFTLLKRDGTMTLVGAPASPHPSPQVFNLIMKRRSLAGSMIGGIPETQEMLDFCAEHGIVSDIEMIRADQINDAYERMLKGDVKYRFVIDSSSLAQ

SEQ ID NO: 26400 - protein, 245 aa, Burkholderia cepacia R1808
MNLSQRLAAEAFGTFWLVLGGCGSAVLAAAFPGLGIGFAGVALAFGLTVLTMAFAIGHISGCHLNPAVSVGLTVAGRFPARDLVPYIVAQVVGATLGAFVLYLIATGKPGFDVVGSGFATNGFGERSPGHYSLGAAFICEVVMTGFFLFVILGATDKRAPAGFAPIAIGLCLTLIHLISIPVTNTSVNPARSTGPALFVGGEAIGQLWLFWIAPIIGAAIAGVVYPLIAGRDAAVLLPASARTVE

SEQ ID NO: 26401 - protein, 342 aa, Burkholderia cepacia R1808
MGVVGVICPWNLPLLLMTWKVGPALACGNTVVVKPSEETPQTAALLGEVMNTAGVPPGVYNVVHGFGPNSTGEFLTTHRGINAITFTGETRTGAAIMKAAADGARPVSLEMGGKNAAIVFADCDLDAAIEGTLRSCFANCGQVCLGTERVYVERPIFDRFVSALKKGAEGMQLGRPEDLATGMGPLISQEHRDKVLSYYKKAVEAGATVVTGGGVPDMPEALKGGAWVQPTIWTGLGDDSVIAREEIFGPCALVMPFDSEEEVIRRANDNDYGLATAIWTTNLSRAHRVAGAIEVGIAWVNSWFLRDLRTPFGGAKQSGIGREGGAHSLEFYTELKNVCIKL

SEQ ID NO: 26402 - protein, 427 aa, Burkholderia cepacia R1808
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSAEFTDYLATLADKFPIVSIEDGMHEGDWDGWKLLTERLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 26403 - protein, 476 aa, Burkholderia cepacia R1808
MSKEFDVVVIGAGPGGYIAAIRAAQLGKTVACIEKWKNPAGALKLGGTCLNVGCIPSKALLASSEEFENTSHHLADHGITVDGVKIDVAKMLGRKDAIVEKMTSGIEFLFKKNKITWLKGHGKFTGKTDAGVQIEVSGEGEAEVVTAKNVIIATGSKARHLPNIPVDNKIVSDNEGALRFDSVPKKLAVIGAGVIGLELGSVWRRLGADVTVLEALPAFLGAADEALAKEAAKLFKKQGLDIHLGVKIGDVKTTENGVSIAYTDKDGNAQTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 26404 - protein, 497 aa, Burkholderia cepacia R1808
MLRVADLRAAEAAATATLPPHTLMARAGAAAARWLSERMTDDERPVWFAVGPGNNGGDALVAAAQLQQLGVATHAWMPVTVKPDDAQWALGLARAAGVPLSTEPPASLDEYAWVVDGLFGIGLARALDGPFAAQAERIAAHARSGGRVLALDVPSGLDSDTGRIVGAGAAVVATHTLTFIGAKPGLYTGDGRDLAGAIEIASLDVAPPAAPAVVLNAPARFAAALPARAFASHKGTFGSLAVIGGDTGMCGAPILAARAALFAGAGKVHVGFLGTGAPPYDPPFPELMLHPADGVDLDAMSAIAAGCGLGTRDAAAALVRRVLAHGAATLLDADALNLVATHADLAAAVAARDGACVLTPHPLEAARLLGSDTASVQHDRLAAAQALAARYASIVVLKGSGTVIAAPDGRLTINPTGNAALATGGTGDVLGGLIGALLAQRVAPYEAALAGVYLHGLAADTLTASGTGPAGLTAGELAPMVRTLINRLFYPSPRADI

SEQ ID NO: 26405 - protein, 287 aa, Burkholderia cepacia R1808
MGAPMIRHLLAAGHRVGVWNRARAKAEALEQDGARVVDTPRELAEQVDTVFVCVLDGRAVGDVVFGAHGLLAGDANARRVKRIVDHSSIAPAATRDYAARAAALGVGWVDAPVSGGVPGAQAGTLAVMAGGNAADLDAVRPLIDRYASRITHMGDAGAGQTAKLCNQAIVTATVTAIAEAVGLAQASGIDAARLADALAGGWADSVLLQTFVPRMTSGGHPSIGALSTFQKDVDAIADAARDTGAVMPVAATVQQVLRLAAAQGLAGADFAAFIDILRPGNGRGAAK

SEQ ID NO: 26406 - protein, 486 aa, Burkholderia cepacia R1808
MRLIQKALTFDDVLLVPAFSDVLPRDTSLKTKLTRNISLNMPLVSAAMDTVTEGRLAIAMAQQGGVGIVHKNLTPAEQAREVAKVKRFESGVVRDPITVPPQMKVRDVIALSRQHGISGFPVVEGPQLVGIVTNRDLRFESRLDEPVKSIMTPRERLVTVKEGTPLAEAKALMHSHRLERVLVVNDAFELRGLMTVKDITKQTEHPDACKDEHGKLRAGAAVGVGPDNEERVELLVQAGVDVIVVDTAHGHSKGVLERVRWVKQNFPHVEVIGGNIATAAAAKALVEYGADAVKVGIGPGSICTTRIVAGVGVPQISAIANVAEALKGTGVPCIADGGVRFSGDVSKALAAGANAVMMGSMFAGTEESPGDVFLYQGRQYKSYRGMGSVGAMKDGAADRYFQDNSANIDKLVPEGIEGRVAYKGSVNAILFQLVGGVRASMGYCGCRTIDELHEKAEFVQITAAGMRESHVHDVQITKEAPNYHVD

SEQ ID NO: 26407 - protein, 220 aa, Burkholderia cepacia R1808
MRLILLGAPGAGKGTQANFIKEKFGIPQISTGDMLRAAVKAGSPLGVEAKGYMDAGKLVPDALIIGLVKERLKESDCANGYLFDGFPRTIAQADAMKEAGVAIDYVLEIDVPFSEIVERMSGRRTHAASGRTYHVKFNPPKVEGQDDVTGEPLIQRDDDKEETVKKRLEVYEAQTKPLITYYGDWAQRGEENGLKAPQYRKISGLGSVEEIRERAFEALK

SEQ ID NO: 26408 - protein, 503 aa, Burkholderia cepacia R1808
MKHVSERAPAKAGGAQPRDAERDAMFASHEAGYEQKLKPRHVQMIAMGGAIGTGLFLGAGGRLQSAGPALALVYLVCGAFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLALFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGVPYGGILVTVAVNALGVPLNYIVPAQAFEIVLNMASLGIITTWGFIVMCQILFRRAVDRGELSPVSFRMPGAPFTSWLTLGFLVSVLVLMAFDYPGGTWTVAMIPVVVLALVVGWKLAKRGAARDAAAAAAAQAASPIAADPAGSV

SEQ ID NO: 26409 - protein, 452 aa, Burkholderia cepacia R1808
MQAPPEAFAYTLLLSPDFSSPDALAVIDVKPGSATYGKIVHTVTMPHTGDEFHHFGWNACSSSLSPLTGHAFLERRFLIIPGLRSSRIYVIDTKPHPTQARIHKIIEPDEVFAKTGYSRPHTVHCGPEGIYVSTLGGAGKDGTDGAPGIFIMDCETFDVLGRWEIDRGPQDKHYDFWWNLPRDYMVSSEWALPPQFENGIVPEDLLANRYGHRLHFWDLRARRNVQTIDLGAQHQMALEVRPAHDPAREYGFVGVVVDTATLEGSIWTWWREDGRFHAKKTATIPPEPAAADELPPLLKGFGAVPPLVTDIDLSLDDRFLYVSCWGTGEMRQYDVSDPHRPVLAGSVRIGGIVRHAPHPNGRAFAGGPQMVEVSRDGRRVYWTNSLYSTWDDQFYPDGVPAAQVLAHAGPDGGLTLADDYWVEFPDGYRAHQIRLDGGDCSTDSFCYPSVRR

SEQ ID NO: 26410 - protein, 458 aa, Burkholderia cepacia R1808
MAKQKTVYVCSECGGQTPKWQGQCPSCHAWNTLVESVAESPAAHRFQSLAKRAPVQRLADIEAADVPRFSTGIGEFDRVLGGGLVPGGVVLIGGDPGIGKSTLLLQSLADIASERRALYISGEESAAQIALRAQRLALLDGGAPVAELKLLAEIQLEKIQAAIDTERPDVAVVDSIQTVYSEALTSAPGSVAQVRECAAQLTRIAKQSGTAIIMVGHVTKEGNLAGPRVLEHIVDTVLYFEGDTHSSFRLVRAFKNRFGAVNELGVFAMTERGLRGVANPSALFLSQHEQVVPGSCVLVTQEGTRPLLVEIQALVDTAHVPNPRRLAVGLEQNRLAMLLAVLHRHAGIACFDQDVFLNAVGGVKITEPAADLAVLLAIHSSMRNKALPKGLIVFGEVGLAGEIRPSPRGQERLREAAKLGFTAALIPKANAPKQPIEGLNVMAVERIEQAIDRVRELE

SEQ ID NO: 26411 - protein, 159 aa, Burkholderia cepacia R1808
MSTLYSFSAETLAGEPVSLDAYRGKVLLIVNTASECGFTPQYAGLQKLYDRYAARGFSVLGFPCNQFGKQEPGDATQIGAFCERNYGVTFPMFAKIDVKGDHAHPLYRYLTDEAPGILGLKAIKWNFTKFLIGRDGRIVKRYAPSTKPEEIAADIDKLL

SEQ ID NO: 26412 - protein, 410 aa, Burkholderia cepacia R1808
MAASPVNPRLDSLQPYPFEKLRALFKDVTPTAGLKPISFGIGEPKHPTPALIRDAVVASLDGLASYPATAGSDALRASIARWLERRYGLPAIDAATQVLPVSGSREALFSLAQTVIDARPRADGKKAIVLCPNPFYQIYEGAALLAGAEPYFANSDPARNFACDYAAVPDEVWARTQLLYVCSPGNPTGAVLTLDDWRELFALSDRHGFVIASDECYSEIYFDEAAPPLGGLEAAHRLGRGFERLVMLSSLSKRSNVPGMRSGFVAGDAALLKKFLLYRTYHGAALSPVWQHASIAAWNDEAHVRDNRALYLQKFATVTPMLADVIDVKLPDAAFYLWANVARTGLSDTEFARRLYADYNVTVLPGSYLARDAHGTNPGRDFIRIALVAGTPECVEGAQRIVEFCRALAR

SEQ ID NO: 26413 - protein, 470 aa, Burkholderia cepacia R1808
MGKQAIGVIGLAVMGRNLALNIESRGYAVSVYNRSREKTDELIAEFPGRNLVPTYTLEEFVASLETPRRILMMVKAGEATDATIASLKPLLEKGDVLIDGGNTHFTDTIRRNQELAQSGLHFIGTGVSGGEEGALRGPSIMPGGQRDAYDLVEPILKQIAAKAPSDGEPCVAYMGPDGAGHYVKMVHNGIEYGDMQLIAESYAVLKDVAGLTNDELGAVYTEWNQGELDSYLIEITSKIFGKKDDETGKQLVDVILDRAAQKGTGKWTSQNALDLGVPLPLITESVFARVLSSLKTERVAASKILSGPAAAPFDGDRAAFVEAVRRALYLSKVISYAQGFAQLRTASEEYGWNLDLGTIAKIFRAGCIIRARFLQKITDAYAKDPALANLLLDPYFKDIAANYQTALRDVVVAAVKAGVPVPAFASAVAYFDSYRSERLPANLVQAQRDFFGAHTFERTDRPGSFHANWS

SEQ ID NO: 26414 - protein, 238 aa, Burkholderia cepacia R1808
MSPYIAEFIGTAILVLLGNGAVANVLLAKTKGKGADLIVIVMGWAMAVFVAVYVTASFSGAHLNPIVTISLALAGKFAWSKVAGYVIAQMLGGMAGALLVWLAYRQHFANEADADLKLAVFCTAPAIRSTTHNVLTEAICTFVLILGVLYLASPQVGLGALDALPVGLLVLGIGISLGGPTGYAMSPARDLSPRIMHALLPIPGKRDSDWRYAWVPVIGPLLGGAAAAGLYLRLHAMA

SEQ ID NO: 26415 - protein, 453 aa, Burkholderia cepacia R1808
MSAAPANARVLEVERVIDDTHRPGFHWMLLVLCGLCLVVDGFDAQAMGYVAPSVIAEWHVPKQALGPVFSASLFGMLLGALGLSVLADRIGRRPVLIGSTLFFAVTMLATPFASSIPVLIALRFVTGLGLGCIMPNAMALVGEFSPAAHGVKRMMIVSCGFTLGAALGGFISAALIPALGWRAVFFVGGAVPLVLAIAMLARLPESLQFLVLKGRVAQARDWLARFAPHAGIDADTRLVVRERAASGAPVAELFRAGRLPVTLLLWAISFMNLIDLYFLSNWLPTVMRDAGYTPGTAVIVGTVLQTGGVIGTLSLGWFIERYGFVRVLFACFACAAVSVGLIGSVAHALPWLLVVVFAGGFCVVGGQPAVNALAGQYYPTSLRSTGIGWSLGIGRIGSVLGPLVGGQLIALNWSNGALFHAAALPVLCSALFVLGLAGVARRDGAHAANAAMN

SEQ ID NO: 26416 - protein, 383 aa, Burkholderia cepacia R1808
MLDQQLTEEERMVRDAARAYAQDKLAPRVTEAFRHERTDAAIFREMGELGLLGPTIPDEYGGPGLNYVSYGLIAREVERVDSGYRSMMSVQSSLVMVPIFEFGSDAQKQKYLPKLATGEWIGCFGLTEPNHGSDPGSMVTRAKKVPGGYSLSGSKMWITNSPIADVFVVWAKLEENGADAIRGFILEKGWKGLSAPAIHGKVGLRASITGEIVLDEVFVPDENLMPNVSGLRGPFTCLNSARYGIAWGALGAAESCWHTARQYVLDRKQFGRPLAANQLIQKKLADMQTEITLGLQGVLRLGRMKDEGTAAVEITSIMKRNSCGKALDIARLARDMLGGNGISDEFGVARHLVNLEVVNTYEGTHDIHALILGRAQTGIQAFF

SEQ ID NO: 26417 - protein, 243 aa, Burkholderia cepacia R1808
MIGNWKMHGRLAGNQALLNEVVQGADAVVAGTSIGVCVPFPYLAQVQAVLGGSRVAFGAQDVSAHEQGAYTGEVAAAMVAEFGAQYAIVGHSERRAYHGERNETVAAKAQRALAAGLTPVVCVGETLDEREAGTTEQVVGAQLDAVLAVLTADEAARIVVAYEPVWAIGTGKSATSAQAQDVHAVLRARLAAKGAAHVSVLYGGSVKPDNAEELFAQPDIDGGLIGGASLKAEDFLAICRAAR

SEQ ID NO: 26418 - protein, 339 aa, Burkholderia cepacia R1808
MKAIEITEFGAPDVLKLTERVRPEPARGEVLIKVAASGVNRPDVFQRKGAYAPPPGASDLPGLEVAGEIVGGDLSDPALNPFGLKLGDRVCALLAGGGYAEYAVAPLPQCLPVPGGLTDIEAASLPETFFTVWSNVFDRALLGAGEGGEQETLLVQGGSSGIGVTAIQIAHALGFRVFATAGTADKCRACEALGAERAINYKTEDFVEVVKSLTHDRGVDVILDMVGAAYLPRELSALADGGRIVLIALLGGAKAEINLGEILRRRLTVTGSTLRPRPVEFKARIAAQLKARVWPLLADGRIKPVIYRVLPAGDAAQAHALMESGEHIGKIVLDWGAIA

SEQ ID NO: 26419 - protein, 488 aa, Burkholderia cepacia R1808
MGKATGFLEFERRHEAYEAPLTRVKHYKEFVAALTDADAKVQGARCMDCGIPFCNNGCPVNNVIPDFNDLVYRQDWQQAIEVLHSTNNFPEFTGRICPAPCEAACTLGINNDPVGIKSIEHAIIDKAWAEGWVKPQPAEHKTGKKVAVVGSGPAGLAAAQQLARAGHDVTVFEKNDRVGGLLRYGIPDFKLEKWLIDRRMRQMEAEGVTFRTSVFIGKEPLPESIGNLAKETISPDTLKEEFDAVVIAGGSETPRDLPVPGRELAGVHFAMDFLPQQNRVNAGDKLTDQLLAKGKHVIVIGGGDTGSDCVGTSNRHGAKQVTQFELLPQPPEEENKPLVWPYWPIKLRTSSSHEEGCERDWAVATKRLEGKNGKVEKLIAVRVEWKDGKMQEVPGSEFEMKADLVLLAMGFTQPAAPVLDAFGVAKDARGNARAATEGERSYYTSVDKVFAAGDMRRGQSLVVWAIREGRQCARSVDAYLMGHSELPR

SEQ ID NO: 26420 - protein, 398 aa, Burkholderia cepacia R1808
MSQVKRLTDLIAAGQLAGKRVFIRADLNVPQDDHGNITEDTRVRASVPAIRAALDAGAAVMVTSHLGRPTEGEFKPEDSLAPVAKRLAELLGRDVPLVSNWVENGVNVAPGQVVLLENCRVNKGEKKNSDELAQKMAKLCDIYVNDAFGTAHRAEATTHGIAKYAPVACAGPLLAAELDALGKALGNPARPLVAIVAGSKVSTKLTILKSLAGKVDQLIVGGGIANTFMLAAGLSIGKSLAEADLVAEAKAIIDEARERGASVPIPTDVVTAKEFSPTAAATVKQVADIEADDMILDIGPDTARALASQLEKAGTIVWNGPVGVFEFDQFGNGTKTLADAIAKSSAFSIAGGGDTLAAIAKYGIHDQVSYISTGGGAFLEFLEGKKLPAVEVLETRAA

SEQ ID NO: 26421 - protein, 489 aa, Burkholderia cepacia R1808
MTSYDQSPVRHLLEAGRLERFFIDGDWVAPDGGGRFAVVCPSTEDTLCEIPLGSARDADRAVQAARHAFAGWAATSPQERAALLDRVHRLLLERAERFATALALEMGAPLGYARSAHVPLAAEHIRVARDNLTDYPFRKQRGTTAIVREPIGVCALITPWNWPIYQITAKVGPALAAGCTVVLKPSELSPLSALLFAEVLADAGVPAGVFNLVSGTGAEVGAALSSHPLVDMVSITGSTRAGVLVAQAAAPTVKRVAQELGGKSPNVVLPDADLERAIAPGVAAAFRNMGQSCSAPTRMIVPRAALGAVEALAVAAAQRCVVGDPFADATTHGPLANRAQFERVAQMIDVGVAEGAKLIAGGPGRPAGCERGFYARPTIFSDVRTGMAIAQQEIFGPVLAILPYDSIDEAVSIANDTVYGLGAHVQGTDRERTRAVAARIRAGQVHLNYPAWDPQAPFGGYKQSGNGREYGVEGMEEYMEVKSILGYYD

SEQ ID NO: 26422 - protein, 370 aa, Burkholderia cepacia R1808
MSSLLSAYDLRGLALPNRVVMGPMTRSRAPSRGLPTELMAEYYAQRASAGLIVTEATNVSTASAAFESTPGLIDDAQVAGWKKITDAVHANGGRIFAQLWHGGRVGSLALLDGAAPLSPSGVNDDLEQLQVWAQLHNGYYTKIHATPSRAMTTDEVVAAVAEFRHAAMQAMAAGFDGVEIHAANGYLPHQFLSSTLNRRDDRYGGSVANRARFLEEIVDAVGGVMPLSRVGVRVSPYAKYNNVRDADPDATYAYVGRMLDDAGVAYLHAADTNGWSGEPDLPRIVAQARRSFGGTLIVNGGIAPDAANALLDAGDADLVAFARAYIANPDLVERLATRAPLAQPKSSGWYGGDRAGYVDYARHDAAEAGV

SEQ ID NO: 26423 - protein, 410 aa, Burkholderia cepacia R1808
MTTSTVTRQTFDEVMVPVFSPAPFVPDRAEGSRVWDTAGREYVDFACGIAVTSLGHGHPELLKVLDEQGRKLWHIGNGYTNEPVLRLAKRLESLTFADRAFFANSGAEANEAALKLARRVAFDRHGADKYEIVSFVQSFHGRTLFTVSVGGQPKYSEGFGPVPAGIKHLPFNDIEAAKAAIGPQTCAVIVEPVQGEGGVIPADPAFLKALRDACDANDALLIFDEVQTGVGRTGHFYAYMDTGVTPDILTTAKALGNGFPIGAMLTTNELAAHFKVGVHGTTYGGNPLASAIADKVVELIAEPALLEGVRERSVRLKGALERINARFGIFKDIRGKGLLVGAELTAAFDGRAKDFVNAAADNGLIMLIAGPNVLRFVPSLVIPFDLLDEGVKRFEKAVEQVLAAHEATAR

SEQ ID NO: 26424 - protein, 464 aa, Burkholderia cepacia R1808
MKQSIDALLRADRAHFMHPSTHAYDHESGALPGRIVRGAHGIHIEDHEGRRYIDAFAGLYCVNIGYGRTEVADAMHEQAKQLAYYHTYVGHASDAIIELSSRIIECAPVGMKKVYYGMSGSDANETQVKLVWYYNNVLGRPNKKKIISRERGYHGSGIVTGSLTGLPSFHQHFDLPIDRVKHTVCPHWYRNAPVGMSEAQFVAYCVDELEKLIAREGADTIAAFIAEPVMGTGGIIAPPAGYWPAIQAVLRQHDILLISDEVVCGFGRLGSKMGAQHFGIEPDLITVAKGLTSAYAPLSGVIVGDKVWDVIARGSQAHGPMGHGWTYSGHPVCAAAALANLAILERENLVGNAAEVGAYFGAKLRDAFGAHPLVGEVRSVGMLAALEFMADRDARTPFDPALKIGAQVSAAALRRGVIARAMPHGDILGFAPPLVMTRAEADEIVGIVKEAVDEVAERNLAAVS

SEQ ID NO: 26425 - protein, 492 aa, Burkholderia cepacia R1808
MLPGHPVLFKSMCYVDGRWIHSDSAATRAVVNPADQSVIGHVPMLERAQIVGAVDAAQRAFGTWRWTPQAARSAALLRWHALILRHLDDLAALLSLEQGKPLAEARGEIRYAASFVEWFANEAKRAVGRTIPTHIDGAHLGTVMEPVGVAALITPWNFPAAMITRKAAAALAVGCTVIVKPAHETPFSALALAQLADEAGFPAGVFNVVLGEPQMAMEALVGDARVRAVSFTGSTRVGRLVTETAAKAGIRKIALELGGNAPFIVTDDADLDDAVRIAVGAKFQTSGQDCCAANRIFVARALYDAFVGRYASAVRALKTGPAFEPGVDVGPLMHQAAFDATVARVDDARARGARIVAGGRPHALGGWFYEPTVIADAAPGMRVYDEENFAPISAVCAFDTLDEVVARANDTEYGLAAYVCATRIDTIFRLVRRLDFAMVSVNGVKFTGAPIPFGGMKASGLGREGGVEGFEPFTETKYFCFGNLGLPVAATA

SEQ ID NO: 26426 - protein, 506 aa, Burkholderia cepacia R1808
MIRTLRQVPDPALPRILPVILAGGSGTRLWPLSREQFPKQLIELTSNESPLSATARRLNGIANASLDDTLLLVCSEQHRTLSAAQVTDRAAPARILLEPAPRNTAPALTLAALDASAFADDPVLAVMPADHVIVDVGAFQDAIARAARYAEEGAIVTLGVLPRRAETGYGYIQVGAPRNGCHGSQGGYSIGRFVEKPDEALAERYLQSGDYWWNSGIFVTRASVWLKAIRALAPAIHASCEAAWRAGIAEDPFFRIDAAAFDACPSDSIDYAVMERLPEHGELGIEGIVVPLAAGWSDVGTWDAIWEIMPKDDHGNVARGPIVFEDTQDSFVRSEGRLVACVGMRDVVVIETPDAVLVANKHDVQRVKNIVARLKNDRRPQAIEHRKVQRPWGHYDSIDLGERFQVKRIVVEPGKRLSLQMHYHRAEHWIVVRGTARVTRGSETFLLSENESTYIAVGEVHRLENPGRIPLEIIEVQSGDYLGEDDIVRFDDQYGRPVDALPAEQA

SEQ ID NO: 26427 - protein, 369 aa, Burkholderia cepacia R1808
MKSRAAVAFEAGKPLQIVELDVEPPRKGEVLVKITHTGVCHTDAFTLSGDDPEGLFPAVLGHEGAGIVVEVGEGVTSVKTGDHVIPLYTAECGECLFCKSGKTNLCVSVRATQGKGVMPDGTTRFSYNGQPVYHYMGCSTFSEYTVVAEVSLAKISPDANPEQVCLLGCGVTTGLGAVKNTAKVQEGDTVAVFGLGGIGLAVIQGAKLAKAGRIIAVDTNPGKFDLARVFGATDCVNPTDYDKPIQQVIVEMTGWGVDHSFECIGNVNVMRAALECAHRGWGQSVIIGVAGAGQEISTRPFQLVTGRRWLGTAFGGVKGRSELPGMVEDAMAGKIQLAPFVTHTKPLTGINEAFDLMHEGKSIRTVVHF

SEQ ID NO: 26428 - protein, 490 aa, Burkholderia cepacia R1808
MPLTLSRTELVRTANLVDGSWRAALDGRCFDVTNPATLDTIAYAPDSGAADARAATDAAARALPAWRATPARERAAILRAWHAAIVAHTDDLAKLMSLEQGKPLAEARGEVAYGASYVLWFAEEATRTYGDLIPQQQRGKQLSAVKVPIGVVAAITPWNFPLAMIARKIAPALAAGCTVVAKPAEDTPLTALALGFLAMEAGVPPGVLNLIAASRERGIDAVADWLADARVRKITFTGSTAVGKLLARESAATLKKLSLELGGNAPFIVFDDAQLDAAVDGLMAAKFRNGGQTCVSPNRVYVQAGVYDAFAAKLAARVAALKVAPATDPAAQIGPMINARAVDKIARHVGDALERGARVLTGGRRLSQLGPNYYAPTVLADATADMQLSCEETFGPVAALFRFDTEEQAVDAANDTPFGLAAYFYTQDVRRIARVSARLETGIVGINEGALASEAAPFGGVKESGYGREGSKYGLDDYLSIKYLCQGGLD

SEQ ID NO: 26429 - protein, 466 aa, Burkholderia cepacia R1808
MNQAALIEADRQHLIHPVVNYRAHEARGVTVLESADGVFLRDGDGHTLLDAFSGLWCVNVGYGRESIVKAAAEQMAKLPYATGYFHFGSQPAIELAERLAALAPPSLNRVYFTLGGSDAVDSAVRFITHYFNATGRPSKKQMIALERGYHGSSSIGAGLTALPAFHRHFDLPRADQHHIPSPYPYRHPLGDDPQALIAASVAALEAKVAALGADNVAAFFCEPIQGSGGVIVPPAGWLKAMRDACRRLGILFVADEVITGFGRTGPLFACETESVEPDLMTVAKGLTAGYAPMGAVLMSDEIYEGLAGSRTESAVVGHGHTYSAHPVSAAIGLEVLKLYHEGGLLANGRAQAPRFAAGLDALRAHPLVGDARSAGLLGALELVADKARKTRFDPALNVPDKIAAAAYANGVVFRAFGDGVLGFAPALSFTAGEFDLMFERVRKTLDDVLADPGVQRALDAAHAQPA

SEQ ID NO: 26430 - protein, 352 aa, Burkholderia cepacia R1808
MGITVRHLQKRFGDFTALDNVSLDFPPGELVALLGPSGCGKTTLLRVIAGLEHADAGQVVLQGLDVASVGARDRQVGFVFQHYALFRHMTVFENVAFGLRVKPRRERPSETVIRDKVHELLKLVQLDWLAQRYPSELSGGQRQRIALARALAVEPKVLLLDEPFGALDAKVRKELRSWLRRLHDDLHISTIFVTHDQEEALEVADRIVVLNRGHVEQVGSPQDVYDHPQSAFVYEFLGAANRLPGTVAARGFVADGAAASIAVDADFAGPAHAYVRPHDLQLWPVGGGHRDGIAVDVRRVIPLGGSVRVELEARTGGALEAELDRDAWRALALQVGDGATAVPRALRVFPAH

SEQ ID NO: 26431 - protein, 508 aa, Burkholderia cepacia R1808
MNPFDLKQLGLDVEYPYRQQYDNYIGGKWVPPVKGDYFENVSPINGKPFCRVPRSGAEDIEAALDAAHAARRKWAKTSVTERANLLLAAADRMEKNLKLLAVAETIDNGKPLRETMAADLPLAVDHFRYFAGCIRAQEGGISEIDDNTVAYHFHEPLGVVGQIIPWNFPLLMAAWKLAPALAAGCCVVMKPAEQTPASVLVLMELIGDLFPAGTINIVNGFGKEAGEALATSKRIAKIAFTGSTPVGKHILRAAAESLIPSTVELGGKSPNIFFADVLDQDDAFLDKTLEGLAMFALNQGEVCTCPSRILIQESIYERFIEKAVARVERIKAGHPLDLQTMIGAQASQQQLDKILSYIDIGRGEGAQCLTGGERTAPAADLGAGYYVKPTMLLGNNKMRVFQEEIFGPVASVMTFKDEQEAIELANDTFFGLGAGVWTRNGTRAYRMGREIEAGRVWTNCYHLYPAHAAFGGYKQSGIGRETHKMALSNYQQTKCLLVSYQAEALGFF

SEQ ID NO: 26432 - protein, 250 aa, Burkholderia cepacia R1808
MQSVPASLSLTDTAFFFDFDGTLVELAPTPDSIHVPPSLLTLLDTLRQRSHGAVAVVSGRGIDNLDTFLSMPDLPIAGLHGAERRDSNGDTQRIGFNDERLLRIERELAAVVDRHPGMLLEIKGAAVALHYRNAADREPVAREAAERLVAEYADAYVLQPGKMVFEIKPKGVDKGRALAAFLDEPPFAGRVPLFAGDDLTDEKGFAVVNARGGLSIKVGAGETSARMRLDSVAALHAQIARWLDLELPGA

SEQ ID NO: 26433 - protein, 378 aa, Burkholderia cepacia R1808
MAKRDYYEVLGVAKNASDDEIKKAYRKLAMKYHPDRNPDNKDAEEHFKEAKEAYEMLSDGQKRAAYDQYGHAGVDPNMAGAGGQGFGGFADAFGDIFGDIFGQAAGGAARGGRGGPQVYRGADLRYSMEITLEQAAHGYDTQIRVPSWVSCEVCHGSGAKPGTKPETCPTCHGQGTVRMSQGFFSIQQTCPKCHGTGTYIPEPCAHCHGSGKVKETKTLEVKIPAGIDDGMRIRSAGNGEPGINGGPPGDLYVEIHIKPHAVFERDGDDLHCQMPIPFTTAALGGEIEVPTLAGRASFPVPEGTQSGKTFRLRGKGIKGLRSSIAGDLYVHVQVETPVKLTDQQRDLLKQFEKSLAEGGARHSPQSKSWFDRMKSFFE

SEQ ID NO: 26434 - protein, 445 aa, Burkholderia cepacia R1808
MTTKPIGDIAAHRLSSTQLSCEFADIAPLLDPTAAAAAASRCHYCYDAPCVQACPTQIDIPSFIRKIGNGNLKGAAMDILGANPLGGMCARVCPTEILCEGACVRNHQDAQPVAIGALQRHATDWAMATGAVRFTRAPDTGRHVAVVGAGPAGLACAHRLALAGHRVTLFDARAKAGGLNEYGIAAYKTVDDFAQREVEWLLSVGGIALQTGVALGRDVTLDALREGHDAVFVAMGLTGVRTLAIDGEQLSGVMNAVDFIEQVRQADALENVPVGRRVVVIGGGNTAIDAAVQSRKLGAQRVTMAYRRGVDAMSATWAEREFAQTSGVTLVTHAKPVRIAGEGGHVARVEFESASGERFAIEADMVLKAIGQTLVPAGIDAALLTADGTRIAVDAHGRTVLPDVWAGGDCAATDGIDLTVQAVQDGKRAAAAIDAALAQRDAKAA

SEQ ID NO: 26435 - protein, 396 aa, Burkholderia cepacia R1808
MTLGFSEHRLAKVAAEQYSAFPGYHTFFGRNSKPTVELSERMLALAPVPMSRVFFTNSGSEANESVIKLLWMMWAAEGQPQRRKLLTRKNAYHGATVMASALTGKDYVKAFGLPTPDVITLDCPHAWRFAQAGESEEAFVKRLVSNLEKTILAEGPDTIAGMFAEPVMGAGGVIVPPAGYFEQVQAVLKKYQIPLVADEVICGFGRTGNLWGCQTVGLRPDIIVASKSMSAGYFPVGAVMLSAEIDRRATAASEQWEEFPHGFTTAGHPVACAVSLEAIRIITDEGILENVQKVGRKFQDGLRALADHPMVGDVRGVGLMGALEMVSDKSSKTSFSGELRVGERIAKAAREFGYIIRPLGASVVLAPPFITTSEQIDDLLTVLKRVLDSVYKDISG

SEQ ID NO: 26436 - protein, 394 aa, Burkholderia cepacia R1808
MPLNDYPIDSLMYITNRPDIVFTHGKGSWLYDHTGKRYLDFIQGWAVNSLGHCNDGIVEALKTQAEKLLNPSPAFYNEPMAKLAGLLTQHSVFDKVFFTNSGAEANEGAIKLARKWGRKFRNGAYEIITFDHSFHGRTLATMSASGKPGWDTIYAPQVPGFPKAELNNIESVEKLITDKTVAVMLEPIQGEGGVIPATREFMQALRALTRQHNLLLIVDEVQSGCGRAGTLFAYELSGIEPDIMTLAKGIGGGVPLGALLSKADVAVFEAGDQGGTYNGNPLMTAAGYSVISQLVAPGFLEGVRARGEYLKRKLLELSEERGFEGERGEGMLRALLLGKDIGPQIVEKARDMQPDGLLLNAARPNLLRFMPALNVTTEEIDQMMAMLRSILDTL

SEQ ID NO: 26437 - protein, 433 aa, Burkholderia cepacia R1808
MAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGSVEYAFSLLKIAAIIVFIVLGAYLVWSAPPASGIGFANYTGHGGFMPKGPWGTWVAVIVAIFSYMSIEAVAIAAGEARDPQHAVTRAFRSTVFRLVLFYLLTLALMLAIVPWTQAGTDESPFVKVMAATHVPYAAGVINFVLLIAALSAMNSQLYVTTRMMFSLSRARLAPAVFGRVGDNGVPRAALWISTSGVAVAAVLVALSPGTAFTVMMAIAMFGALFTWLMIFVTHLRFRARYSGPALAFRMWAHPFGSLLGAALVGAILLTTAFTHEFRMTMVVGVVFVVLLTLAYALHYRHQHAR

SEQ ID NO: 26438 - protein, 313 aa, Burkholderia cepacia R1808
MTNPAIHDHDAPAFVANDASWYEASARQRIDALLDAGSFDEFLGPAERVASPHLPLFGLPQQFDDGMVVGHGRLDGRPVLIAAQEGRFMGGAFGEVHGAKLTGLLRAAREVGKPVLILFDTGGVRLQEANAGELAIAEIMRALVEARATGVAVLGLIGGRAGCYGGGGLLAACCSALAVSEQGRISVSGPEVIETNRGVEEFDAKDRALIWRTMGGKHRRLIGGADRYVADTPAAFRAAALELLGCAPVFDTAMLRAEQARLEARVARFGRCADALDVWRALGADRPEAIPGMPDDAFARLADQLQEPQHDAR

SEQ ID NO: 26439 - protein, 234 aa, Burkholderia cepacia R1808
MNKVYPSAAAALEGIVRDGQTFAVGGFGLCGIPEALIAALRDSGVKGITCISNNAGVDGFGLGLLLETRQIKKMISSYVGENKEFERQYLAGELELEFTPQGTLAEKLRAGGAGIPAFFTNTGYGTVIAEGKETRQFGDRHYVLEPSLTADVALVKAWKADKSGNLIYRRTARNFNPMCAMAGKITVAEVEEIVENGALDPDQVHTPGIFVQRIVLNATPEKRIEQRVVRAKGD

SEQ ID NO: 26440 - protein, 506 aa, Burkholderia cepacia R1808
MNPVPAYTSDADVGHYLDGAPVAGRSGRFQDVLNPALGRAVRRVALADGDEVQRAVASAHAAFPEWAATPPIRRARVLHRFLQLMNEHRDTLAAIITAEHGKVFSDAQGEVARGIDIIEFACGVPQLLKGDFTDQVSTGIDNWTMRQPLGVVAGITPFNFPCMVPCWMFPVALATGNTFVLKPSERDPSAALFMADLLTQAGLPAGVFNVVQGDKGAVDALLDHPDVQAVSFVGSTPIAAYVQQRAVQSGKRVQALGGAKNHLVVMPDANLEQAVDALIGAAYGSAGERCMAISIAVLVGDVADRIVPAVAERARKLVIGDGMSPEVEMGPIVTGEALKRIEGYIEQGVSEGAQLVVDGRGLRVPGREQGFFTGGTLFDHVTPDMRIYKEEIFGPVLGCVRVKDFGAAVDLINAHEFGNGVACFTSDGGIAREFARRIQVGMVGINVPIPVPMAWHGFGGWKKSLFGDMHAYGEEGVRFYTRQKSVMQRWASSIGKGAEFAMPTAK

SEQ ID NO: 26441 - protein, 248 aa, Burkholderia cepacia R1808
MYKLVLIRHGESTWNKENRFTGWVDVDLTEQGRNEAYQAGALLKEAGYTFDIAYTSVLKRAIRTLWHVQDKMDLMYLPVVHSWRLNERHYGALSGLNKAETAAKFGDDQVLVWRRSYDTPPPALEPTDERAPFSDPRYAKVPREQLPLTECLKDTVARVLPLWNESIAPAVRAGKQVLIAAHGNSLRALIKYLDGISDSDIVGLNIPNGVPLVYELDENLKPIQHYYLGDQDAIAKAQAAVAKQGKAG

SEQ ID NO: 26442 - protein, 302 aa, Burkholderia cepacia R1808
MSTSDHPAAQPAAAGAGAAGAAPGAPGGELVIEVRNLTKRYGRNIVHQKLDFDVRRGEIVAIVGGSGSGKTTLVRQILGLERPTSGTIKVFGEDTSTIDEASARLMRTRSGMLFQQGALFSSMTVFDNIAQPLRELGRVPADLLHDIVMLKLEMVGLPGKHASKMPAALSGGMVKRVGIARAIALEPELLFLDEPTAGLDPQASDEFVELIGTLHRTLGLTVVMVTHDLDTMVALSTRVAVLADRKVLVAAPVEEAAGVDHPFIHEYFLGLRGRRALQALPPERRAKLPKAALEPALSSVEL

SEQ ID NO: 26443 - protein, 1309 aa, Burkholderia cepacia R1808
MASTTLGVKVDDLLRSRLKDAATRLERTPHWLIKQAIFAYLERIEHGQLPPELSGSSGVTELADGHAAEDDDNSPHPFLEFAQNVQPQSVLRAAITAAYRRPEPECVPFLLGQARLPANLQADVQTLATHLVETLREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVDEASKVVPLGAPHAKIPLPRNLYGDERANSMGLDLSNEHRLASLSSALLASAHHPWRAAPMLADDALADAPARDVRNPADQRDVVGAVSEATSEHVSAALAHAVAAAPIWQATPVDARADCLVRAADLLEAQMHTLMGLIVREAGKSLPNAIAEIREAVDFLRYYAAQIRGEFSNDTHRPLGPVVCISPWNFPLAIFMGQVAAALAAGNTVLAKPAEQTPLIAAQAVRLLREAGVPAGAVQLLPGTGETVGAALVADPRTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDAEAKQTIDTHVAAMKDKGHAVTQLPMPDACAHGTFVPPTLIEIGSIDELKREVFGPVLHVVRYRRSQLDKLLEQIRATGYGLTLGIHTRIDETIAHVIANAHVGNIYVNRNVIGAVVGVQPFGGEGLSGTGPKAGGALYLQRLLATRPSGLPKALAQTLIADGVAEGEQRGNPAAALTALRDWLIEQREPALAARCDGYLSQVPAGATAVLTGPTGERNTYTLGPRGTVLCVAATPSGARAQFAAVLATGNRALFAGSAGEALVAALPAALKGHAAVRKQADAPFDAVLFEGDSDELQTLVKDVAQRPGPIVSVQGVSAGAFENGDAEDYALERLLTERSVSVNTAAAGGNANLMTIG

SEQ ID NO: 26444 - protein, 370 aa, Burkholderia cepacia R1808
MTALFSPFTLRGVTLPNRIVISPMCQYSAERGEATDWHMIHLGHLALSGAGLLCIEATAVEPDGRITAGDLGLWDDATEAALAPVLAAIRKHSPVRVAMQLSHAGRKASSEVPWKGGQLVSVADGGWLPHAPSAVSHKDGETPPLALDTAGLNRIRDAFAAAAKRAARLGIDAIEVHAAHGYLLHQFLSPLANRRTDEYGGSRENRMRFPLEIFDIVRAAFPDDRPVGVRVSATDWVEGGWELDDTIAFAHALKQRGCDWIDVSSGGVSPLQKIPLSPGYQVPFAQAVKRAVGMPTVAVGLISEPAHANRLIEAGDADFVAMARAMLYDPRWPWHAAAELGAQVSAPPQYWRSQPREHKALFGDVAFGQR

SEQ ID NO: 26445 - protein, 479 aa, Burkholderia cepacia R1808
MEQAKHFIAGEWTLPAQLEPIAVVDPSDGRPFATIARGTAPDIERAVAAARDAFAGPWGAASAAERGRVLMRLSARVTDCIEELATIEARDTGKPLKQARADAAALARYFEFYAGAADKLHGETLPYQAGYTVLTVREPHGVTGHIVPWNYPMQIFGRSVGAALAAGNACVVKPAEDACLSVLRVAELAIEAGLPAGALNVVTGYGHEAGAALARHPGIDHISFTGSPATGKLVAQMAAENHVPVTLELGGKSPQIVFADADLDAALPVLVSAIVQNGGQTCSAGSRVLIEHAAYEPLVERLATAFNALRVGPSRADLDCGPLINAKQQQRVWDFLSDAQHDGIPMAAQGQVVADAPESGFYQAPALLRDVPPSHRLAQEEVFGPVLAAMRFVDEEEAVALANGTPYGLVAGIWTRDGARQLRLARRVRAGQVFINNYGAGGGVELPFGGVGHSGHGREKGFEALYGFTALKTIAIRHG

SEQ ID NO: 26446 - protein, 223 aa, Burkholderia cepacia R1808
MCDGGYAEMMLARSTGLVSIPDDLKAEEAAPILCAGIATFNALKKSGAEAGDTVAIVGIGGLGHMALQYARRMGFRVVAIGRGDEIANEAMTLGAHVYIDANAEDPAARLTEMGGACAIVTTVGQADVIAKLLPGLAPQGRLILLGVGKDPLPVSIGYLVSGERGIAGSITGTPYENEKALNFSVLTGVRPMIETMPLEQASEAYRRMRSGDVRFRMVLTMKR

SEQ ID NO: 26447 - protein, 356 aa, Burkholderia cepacia R1808
MHFWFPGIPIWVTAGAAVSLMFVVNIIGVKIYGEAEFWFSLVKVVAIVAMIVFGVGMVLFGIGNNGVPIGYHNLIDHGGFFPKGAGGTFLAIVMVAFAFGGVENLGLAAGEAQDVKTTMPKAVNATFWRLLIFYVGAIAVLLLVFPWTSLTSKGSPFVEVFTKIGIPAAAGIMNLVVIMAVLSAVNASVFTNSRTFYNLSLQKNAPAFLGVTNSRKVPHRAILMVFATMFAGVMLNYLMPEQAFELFSSVTVFALVCAWGSIVISHLRFRKNKIRKGEDGQLGYKMPFYPYSNYIALIFLAAVLIGIAILPDMRMSLVVSAVWVLVVFIAYTFYVRKESTRESIASETGDAKDLLA

SEQ ID NO: 26448 - protein, 487 aa, Burkholderia cepacia R1808
MTIKHWIDGREVASRDTFTTLNPATGDVIADVASGGDAEVDAAVRAAKAAFPKWANTPARERAKLMCRLAELIEKHVPMLAALETQDTGLPIAQTSKQLIPRAAENFNFFAQVCVQMNGRTYPVDDQMLNYTLYQPVGVCALVSPWNVPFMTATWKTAPCLALGNTAVLKMSELSPLTADQLGRLALEAGIPPGVLNVVHGYGATAGDALVRHSDVRAVSFTGGTVTGKRIMERAGLKKYSMELGGKSPVLIFDDADFDRALDASLFTIFSINGERCTAGSRIFVQRTIYDRFVQAFAQRANRLVVGDPADPATQLGAMITRQHWEKVTGYIRLGEQEGARVVAGGAQAPAGLAAHLRNGNFVRPTVFADVDNRMRIAQEEIFGPVACLIPFDDEDDGLRLANETSYGLASYLWTQDVGKVHRLARGIEAGMVFVNSQNVRDLRQPFGGVKESGTGREGGEYSFEVFAEIKNVCISMGSHHIPRWGV

SEQ ID NO: 26449 - protein, 453 aa, Burkholderia cepacia R1808
MALGATIGVGLFLGSATAIRLAGPSILLGYAFVGVFVFFVMRALGEMAVAHPVAGSFNRYAYEYIGPRAGFVTGWTYWFMWILCIMAEVTAVAIYMKFWFPGMPAWVWSLAALATMGLLNFVAVRAFGELEFWFAAIKIVTIVFMILSGIGIIGFGFGNGGVATGIGNLWRHGGFLPNGMWGLASAIPMVVFAYLGVEIIGLTAGETKNPEKSLARAVNSVFWRIAIFYIGALFIIMSLYPWNAIGTQGSPFVLTFERLGIRGAAGIINFVVLSAALSSCNSGIFGTARIVFNLAQQGQAPRIFAHTSKSGIPACAVVLTLVAALLGVLLNYVAPKGLFEWLTAIGTFAGLFSWAIILVAHYRFRRQRVAQDNRMLMPWWPYSSYCTLAFLAVLVAFMLKFDETRVAVIVGPLWLAFLWIVYGLSAKNGASRQGVPSPSASFAVEGVTRDIRD

SEQ ID NO: 26450 - protein, 215 aa, Burkholderia cepacia R1808
MLDREGFRPNVGIILLNARNEVFWGKRLREHSWQFPQGGIKYGETPMQAMYRELHEETGLHPEHVKIIGRTRDWLRYEVPDKFIKREVRGHYRGQKQIWFLLRMVGRDCDICLRATDHPEFDAWRWNEYWVPLDAVIEFKRDVYQLALTELSRFLRRPAQRAEKPRGPRPLRYPRIGGAPAQQTLTIVDTSVVCSEIEVEARTLDEMPPRVIIGK

SEQ ID NO: 26451 - protein, 285 aa, Burkholderia cepacia R1808
MSTTLLFHPTPDAAYGFPNARRLAHVASPHQHIEVWDTPQLGRLFTLDGRPMTSVGDEYVYHECMTHPAALAHPCPKKALVLGGGDGGAARQLLKHACIERIVVAELDDEVVGMARRYLDDVHQGALDDPRVEVVIGDAAQFVASTVEHFDLVVFDLTPPDSPAAGLYTREFYARLKRILTPRAALSMHLGSPLFHAARIAALLDDLRASFAFVDPLSAHVPLYGSQWLMAIASDTLDAAALFAHDVDERLAARRVHGLRYYDARLHAALFALPRALRDTLGGRR

SEQ ID NO: 26452 - protein, 452 aa, Burkholderia cepacia R1808
MNRTPVVDVQTFINEQPFGGFQWLVFLMCFVIVLLDGFDTAAIGFIAPSLLGEWNLSKPDLAPVLSAALFGLACGALVSGPLSDRLGRRSLLLGSVFLFGVACFASAFSTTIGHLTVLRFITGVGLGAAMPNAVTMMGEFCPDKRRATVINLMFCGFPLGAAFGGFLAAWMIPHFGWRSVLLLGGVTPLLLGVLLLLKMPESVRFMVAHGRSVERIRATLARISRDALNAGSFALTETAPQTGGKGLGVVMSRAYLAGSVMLWVAYFMGLVIFYASINWMPILLKDAGLAPKSATLISALFPLGGVGAVLCGVLMDRFNANRVIAVCYALTAISVYAIGQAAGNVGLLVLVVFVAGVLMNTAQSSMPALAAAFYPTEGRGTGVAWMLGVGRFGGIAGSFLVAELTRRHFSFASVFATIAVAGLLACVALLIKQMARPHGAAQPAGKVESLGH

SEQ ID NO: 26453 - protein, 1402 aa, Burkholderia cepacia R1808
MSATPVKSVCPYCGVGCGMVLHVEADEVVKVSGDSEHPTNFGRLCTKGSSAHVALRRSGRLDRAFVRRAREDDLVPLPARDAIAETARRLRAVLDAHGPDALSFYVSGQMSIEAQYLVNKLAKGFVGTNNIESNSRLCMASASTGYKQSLGADGPPGSYQDFDRANLFFVIGANMADCHPILFLRMMDRVKAGAKLIVVDPRRTGTADKADLFLQIRPGTDLALLNGLLHLLHANGRTDAAFIDAHTEGWDAMPAFLADYTPERVAEITGLAPDDLRTAAQWIGDAPEWTSCWTMGLNQSTHGVWNTNAICNLHLATGTICRPGSGPFSLTGQPNAMGGREMGYMGAGLPGQRSVASDDDRRFVENLWRVPAGTLRQETGSGTVDLFERMAAGDIKACWIICTNPVATVPNRQNVIAGLQAAELVIAQDAFLDTETNRYADILLPGALWAEGDGVMVNSERNLTLMRAAVAPPGDALPDWRIVAEVARAMGFGAAFDYASAADVFDEIVRFSNPATGYDLRGASHAALRDGPVQWPVAPGAARERHPIRYLNDGVSQTLRPAADGGAAPRIAFPTPSGRARFFARPHVAPAELPDDTFPIVLNTGRLQHQWHTMTKTGKVAMLNKLNPRPFVELHPDDARALGIAAKDSVEIRSARGRAVLPAVVTERVLRGNCFAPMHWNDVYGDELCINAVTNDAIDAESQQPELKYCAVALTRADTNAFAPADDDTARLDAAAADAAHAAAAADAQAAPVSLAASQESDMADLDTFAAALGVADLAPPPLSDAERLYVAGLVGGLRASAGRRDGGVPVLPAGAPLTPPVRYWLDGMLAGLFSRSAPAPATERAAPALPADAAAPGGVRIVRTRPKVTLLWASQTGNIESLTEDYATQLMNAGFEIRTACMSDYPVASLASAQYVLLMTSTFGDGDAPDNGSEFWDALQAAGAPRVEGMQFAVLAFGDRNYDQFCGHGRRLDARLAELGATRLCARVDCDVEFQRDADQWLERVVARIKEADAALHAVPSAGASASGLLPSKAHPAPSKLVANLRLNRPGAAKDTRYVSLSTEGANLEYEAGDALGVWPTNCPELVDELLAVTALKADTPVSVAGVGDVRLADALARHFDITRPHPDTLAFIASRSANGALKALLGDDRKADLKQWLWGQQLADVLHEFPVELSGMELVGILKRLQPRLYSIASSPSAHRGEIHLTVSAVRYHNGRRARKGVASTFLADRADDGRVPVFVQKSAHFRPPVNGDVPVVMVGPGTGVAPFRGFLHERQARGARGRNWLFFGEQHAQTDFYYGDELSAMRDSGFLTRLDLAFSRDQADKIYVQDRMREHGAELYSWLEDGAHFYVCGDAARMAKDVDTALKAVVAEHGGMSDEAANDYVARLAKARRYVRDVY

SEQ ID NO: 26454 - protein, 441 aa, Burkholderia cepacia R1808
MTDKATRIDLFSFRSAPMRAFHMTWMAFFVCFFAWFACAPLMPLISREFHLTAAQVANINIAAVAATIAVRLLVGPLCDRFGPRRVYVGLLLLGAIPVFAVSFVHDYLSFLICRLGIGAIGAGFVITQYHTSVMFAPNVVGTANATTAGWGNAGAGATQAMMPLLVAAGLLLGFGDDASWRIALVVPGIAMLAMAWAYWRFTQDCPQGDFVALRKQGVTVDSGKKGGWASFFAACGNYRVWMLFVTYGACFGVEVFIHNIAALYYVDHFKLSLKDAGFAVGLFGLLALFARALGGWLSDRIAARRSLDVRATLLCALIIGEGLGLLWFSHAQGIGMALVAMLTFGLFTHMACGATYALVPFIDRRALGGVAGIVGAGGNVGAVAAAFLLKGVGDVQHALSLLGLVVTATALCAMAVRFSAEHKAREAELRDRALATANAAN

SEQ ID NO: 26455 - protein, 228 aa, Burkholderia cepacia R1808
MTQFRIAPSILSADFARLGEEVRNVVAAGADWIHFDVMDNHYVPNLTIGPLVCEAIRPHVQVPIDVHLMVRPVDRIVPDFAKAGANLISFHPEGSDHIDRTLSLIRDHGCKAGLVFNPATPLNYLDHVMDRLDFVLLMSVNPGFGGQSFIPETLNKLREARARIDAYTERTGREILLEVDGGVKTDNIAEIAAAGADTFVAGSAIFGKPDYRKVIDEMRAALATVERS

SEQ ID NO: 26456 - protein, 445 aa, Burkholderia cepacia R1808
MMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWIFALGITLLLTITNLFSVKNYGEFEFWFALIKVVAIVVFLCIGGAAILGIVPAPAVSGVSNLFAHQGFMPNGAGAVLAAMLTTMFSFLGTEIVTIAAAESDNPQRQIVRATNSVIWRITLFYLGSILVVAAIVPWNDPLLPKHGSYQRAMELIGVPNAKAIIDVIVLVSVASCLNSALYTASRMLFSLSKRKDAPAFLHRTDSTGTPRAAVLASTAFGFLTVIANYLMPEQVFGFLLATSGAIALLVYLVIAISQLRMRKTLESTGADLALRMWLFPWLTWAVILFICGTLTVMFVSEAHRMEVGATAVLALLVLFASWLNKRARDARAVAGGRVSAT

SEQ ID NO: 26457 - protein, 138 aa, Burkholderia cepacia R1808
MTTDTQSLPAWLDKVRWDDNGLVPVIAQEAATNDVLMFAWMNREALAKTIETQRAVYYSRSRKRLWFKGEESGHVQHVHEVRLDCDEDVVLLKVEQVSGIACHTGRHSCFFQKFEGTVENGDWVAVEPVLKDPEHIYK

SEQ ID NO: 26458 - protein, 273 aa, Burkholderia cepacia R1808
MSPTPPDTLLELRDVDFGYGDRLVLSNLNMRFGRGRVVAVMGGSGCGKTTVLRLIGGLVRASRGQVLFDGADVGAQTRDGLYALRRKMGMLFQFGALFTDMSVFENVAFALREHTDLPDDLIRDLVLMKLNAVGLRGARDLMPSEVSGGMARRIALARAIALDPELIMYDEPFAGLDPISLGITANLIRTLNEALGATSILVTHDVPESFAIADYVYFLANGGVLAQGTPAELRASTDPSVRQFIDGAPDGPYKFHYTSAPLAADFGLGGGRA

SEQ ID NO: 26459 - protein, 175 aa, Burkholderia cepacia R1808
MVSLKDSHFDLFHLPAQFALDDAALDDAYRTVQTQVHPDRFAAAGDAQKRIAMQWATRANEAYRTLRDPLQRASYLLSLRGVDIGAENNTAMEPAFLMQQMEWREGIEDAAAARNVDALDALLAELRDEKRVRIERLGTLLDSGADQAAAEAVRQLMFIERVASEVGAQIERLET

SEQ ID NO: 26460 - protein, 435 aa, Burkholderia cepacia R1808
MESKTLAAPAADPTGPARNDNGLFGWYAHAQPRERRAFWSCKVGYMLDGMDTQMLSFVIPTLVATWGISLADAGFIGTMTLLASALGGWLAGILSDRIGRVRTLQLTVLWFAVFTALCGLAQNYSQLLAARALMGFGFGGEWTAGAVLIGEVIRARDRGKAVGLVQSGWAIGWGLAALLYALLFSVLPAEQAWRALFLVGLAPALLVVVIRRYVKEPDVYEKEKAAQRATDAPRLTEIFAPKLLSTTLRAALLTTGAQGGYYAITTWLPTFLKTERHLTVMGTGGYLATIIVGSWIGYLTSAYLTDRLGRKPNFILFALGSMVIAFAYTSPALHLTNTSMLWLGFPLGFFASGIFSGMGAFLTELFPTRVRGSGQGFCYNVGRAVGALFPFLIGALSKHYGLGASIGIFAVAAYGVLIVAALTLPETRGRELDAA

SEQ ID NO: 26461 - protein, 432 aa, Burkholderia cepacia R1808
MPVAVAGDGIEIIDSTGKRYIDACGGAAVSCLGHSNQRVIDAIKRQVQQLPYAHTSFFTTDVAEELADRLVEAAPAGLEHVYFVSGGSEAIEAALKLARQYFVEKGEPQRRHFIARRQSYHGNTLGALAIGGNAWRREPFLPLLIEAHHVSPCYAYRDQAAGETDEAYAQRLADELEQKIVALGAENVAAFVAETVVGATAGAVPPVRTYLKKIRAVCDKYGVLLILDEIMSGMGRTGYLFACDEDDVAPDLLTIAKGLGAGYQPIGATLVSDRIYRTIVDGSGFFQHGHTYLGHATACAAALEVQRVIADEKLLDSVKARGEQLRASLREHYAAHPHVGDVRGRGLFVGVELVRDRDSKAPFDPKLKLHAAVKREAMQRGLMVYPMGGTIDGVHGDHILVAPPFICTAQQIDTIVERLSGAIGAALASAGA

SEQ ID NO: 26462 - protein, 448 aa, Burkholderia cepacia R1808
MADVVPALVDEVRAFRHAYPEIRYVDLICLDLPGHFYGKRYPIDALEKVATGSLLKLPQNCVLLGTQGGLYKIGDYCFNDGDPDAPRRLIPGTLKPVRWERQPLAQMLISSDGTDAPIEFEPREVLARVLRRFAARGIRPVVAFELEFYLFAAQLADGMPQYPRDRLSDDADDQPNMHIERLSRFSDVLHEMVEAAREQGVDATVITAELGPGQFEINFGHSDDALRAADWSALFCRSTRGVALRHGYRASFMGKPYLHAPGSGMHVHVSLYDEAGRNVLAADDQRPLRHAVAGCLALLPHCMPVFAPNHNAFRRYGSMVNAASRASWGFEDRDACLRIPESDARNLRIEHRLASADANPYLVLAAILTGIEHGLDARLEPIAPLNDDRGSGIDFPKEMLSAVAAMQDHAAVRDGLGSEFVMVYCENKRQEELDFRNEIGAREYRWFL

SEQ ID NO: 26463 - protein, 465 aa, Burkholderia cepacia R1808
MNGIDVGLEADLQALGKRHLLMHFTHADAYRDQALTVFDRGEGCWLVDRNGKRYFDGLAGLYCVQLGYSHGAEIGDAMREQMGRLPFATNWGYGHEPAIRLAHKLATLAPDGLNRVFFTSSGSESNESAIKLVRQYHQARGEPQRRKFIARRVAYHGTSFGALALNGMTNFRKHFEPLMAGVRHVSNTKRYGRPDGETEAQFTRHLLDEIESLIVQEGPDTVAAIVVEPLQNAGGSLTPPAGYAQGLRALCDRHGVLLVADEVICGFGRLGEWFGSTRYGLQPDLITFAKGIASGYVPLGGVIASDAVVDTVLAGPQQMFLHGATYGGHPVACTAALANLAIMERERVLENVGGNQAVFRRTLDGLLELPCVGDVRGDGYHYSLELVTDKAARRWAAGIGAQAFVSTLLAPAIFEAGLLCRAGVDHEGTPIVQFSPPLVMSRDEIVWFVAKIRDILADTYARAMR

SEQ ID NO: 26464 - protein, 481 aa, Burkholderia cepacia R1808
MLTQEHSMRTSEQSYIAGQWLDPADARAIDVIDPATARPYARLAIGSAADVDRAVGAAKQAFDAYSRWSVDARVALLQRVLDIYQRRYDEVARTISQEMGAPLAFARAAQAAVGTAHLEQTIRALRAFRFSTQVDSLLVSYEPIGVCALITPWNWPINQIVCKVAPALAAGCTMVLKPSEIAPFSAILFAEILDEAGVPPGVFNLVHGYGHEVGDALSRHPDVDMVSFTGSTRAGVEVAKAAADTVKRVHQELGSKSPNLILPDADIDAAVTLGARSCFSNSGQSCNAPTRMFVHVDQLAAAEAAARREAARTVVGDPRSPETEIGPVVSRTQFDRIQQLIQRGIDEGATLVAGGLGRPDGLGDGFYVKPTVFSNVTPDMTIAREEIFGPVLSILTYRTEDEAVALANDSVYGLAAYVQTKDLERARRIAARLRVGNVHINYPAWNPAAPFGGYKRSGNGREYAEFGLVEYLETKGTTGYA

SEQ ID NO: 26465 - protein, 353 aa, Burkholderia cepacia R1808
MPTLFDPVTLGELTLPNRIVMAPLTRARAGTTRVPNELMARYYAERASAGLIISEATSVTPQGVGYADTPGIWSDEQVEGWKRVTQAVHAAGGRIVLQLWHVGRISDPMFLDGDLPVAPSAIAAGGHVSLVRPERPFVTPRALELDEIPGIVAAYRKGAENAKKAGFDGVEIHGANGYLLDQFLQDSTNRRTDAYGGPIENRARLLLEVVDAAIDVWGAGRVGVHLAPRGDAHTMGDSDPAATFGYVARELGRRKIAFIFTRESYTGDQLSPRLKEAFGGPLIANEQFTPDSARQALADGSADAIAWGKLFIANPDLPRRLELGAPLNKPVPETFYAQGETGYTDYPALDDAA

SEQ ID NO: 26466 - protein, 338 aa, Burkholderia cepacia R1808
MKAAVVHAFGEPLRIEEVPVPTPGPGQILVNIKATGVCHTDLHAADGDWPVKPTLPFIPGHEGVGIVAAVGAGVTHVREGDRVGVPWLYTACGHCEYCHTGWETLCHGQENTGYSVNGSYAEYVLADPNYVGHLPAQVAFDEIAPILCAGVTVYKGIRVTDTRPGQWLAISGIGGLGHVAVQYARAMGLHVAAIDVSPAKLELARQLGAELTIDASVDDPAKVIQKEIGGAHGVLVTAVSRSAFAQALGMVRRGGTVALNGLPPGDFPLPIFSTVLNGITVRGSIVGTRRDLQESLDFAADGLVRAHIHRDRLGNINDIFSRLREGKIDGRIVLTDMQ

SEQ ID NO: 26467 - protein, 481 aa, Burkholderia cepacia R1808
MANVTYTDTQLLIDGEWVDAASGKTIDVVNPATGKAIGKVAHAGIADLDRALAAAQRGFEAWRKVPAHERAATMRKAAALVRERADAIAQLMTQEQGKPLTEARIEVLSAADIIEWFADEGRRVYGRIVPPRNLGAQQMVVKEPVGPVAAFTPWNFPVNQVVRKLCAALATGCSFLVKAPEETPASPAALLRAFVDAGVPAGVVGLVYGDPAEISSYLIPHPVIRKVTFTGSTPVGKQLAALAGQHMKRATMELGGHAPVIVAEDADVALAVKAAGGAKFRNAGQVCISPTRFLVHNSIRDEFTRALVAHAQGLKIGNGLDEGTTLGALANPRRLTAMASVVENARKVGASIETGGERIGSEGNFFAPTVIANVPLEADVFNNEPFGPVAAIRGFDKLEDAISEANRLPFGLAGYAFTRSFANVHLLTQRLEVGMLWINQPATPWPEMPFGGVKDSGYGSEGGPEALEPYLVTKSVTVMAV

SEQ ID NO: 26468 - protein, 478 aa, Burkholderia cepacia R1808
MDITYDALHLFIDGEWIGASERETAPVINPATQIQIGRVPLATAADLDRALQAAVPAFDVWRNTVPAERARILKRAAELMRERAEHIATVMTLEEGKPLAESRDEVLRAADYFEWFAEEARRIDGRVVPSNRPGVQQLVKKQAIGPVAAFTPWNFPAITPARKLSAALAAGCSVIIKPGEESPATALALARALDDAGLPKGVLQVVFGVPDQVSTQLIASPVIRKVTFTGSVPIGRLLSARAAEGVKPITLELGGHGPVLVFNDADVEKAAVEGAANRFRGTGQVCISSTRFLIQREVYDEFVGHFVRATSALKVGNGMDAGTQVGPLANPRQLAKMEELIADAVERGATILAGGKRIEGEGYFFEPTVLADVPKDARVMHEEPFGPIAVLMRFDALADGLAEANRLPYGLSAYAFTSSARTAIDVADGLEAGMIGINQYRIVSTELPFGGMKESGHGSEGGTEGIEYYLTHKFISQA

SEQ ID NO: 26469 - protein, 331 aa, Burkholderia cepacia R1808
MKAITFKEFGDAEVLQLAEVAAPEVRPDDLLVRVHAAGVNRADLTHRRGGYGRPNFGDSTIMGLEIAGEVIETGSSVQGYKVGDRVMGVVGGGAYAERARIDWRMAMPIPATLDYVHAAAIPEVFVTAHEALLHLGRLQRGDAVLIHAAAGGVGSAAVQLAYATGATIFATAEASKLERIVQLGVDHAIDYKTQDFSEVVASRTGKRGVDVVIDFVGAPYFSRNVASLANGGRLVQVGILGGGGDVSVSLEQILYRHLQIIGTVMKSRDQSEKHAMVRRFREHWLDRFAGGAGLEPVVDSVFPLADAAAAHRRMESAVNVGKIILTMSEDS

SEQ ID NO: 26470 - protein, 473 aa, Burkholderia cepacia R1808
MRPSRPPELAASFERQRSAYARDPAPPLAIRLSRLDRLRALLDTHEAALVQAIDADFGGRSAHETRLAELFVVHSGLRHARAHLRQWMRERRVPTAAHFRPGYNRIAPQPRGVVGVMAPWNYPLQLALGPAVAALAAGNRVLVKPSDLTPRLSALLESLVADAFDVDELAVVTGDVDTAKAFARLPFDHLFFTGSTAVGRDVAQAAAANLTPVTLELGGKSPAIVDPSCDLAHAAARIAFGKLLNAGQTCIAPDYLLVPAGTAETVAARVADAIAHHYPTLAANPDYTSIIAATPRDRLAALVDDARAGGARVREVNPAGERFAAGSRKFAPTLVLDARDTMRVMREEIFGPVLPIVEYADLDDAIDRVNRGPRPLALYWFGRDAARRDRVLRETVSGGVTVNDCLWHLAQEHQPFGGVGASGIGAYHGKWGFDTFSHHKPVFHQARRSGTALFHPPYGKTFDLLLRVLTRFA

SEQ ID NO: 26471 - protein, 249 aa, Burkholderia cepacia R1808
MPLVETRGVEKYFGTHHVLKGIDFSVERGQVVSIIGRSGSGKSTLLRTLNGLERIDAGTISIDGECVDARHSELRALRLKVGMVFQQYNLFPHLSAGQNVMLAQTVVKRAHRQQARAVAELMLERVGLGDKFDAFPDQLSGGQQQRVAIARALAMKPSVLLCDEITSALDPELVGEVLGVVEQLAREHMTLIMVTHEMNFARAVSDRIVFMHQGRVWESGSADDIFERPQTVELGRFLGSVRSTEAAAR

SEQ ID NO: 26472 - protein, 329 aa, Burkholderia cepacia R1808
MLAMMFDGTTPTLREARVPDPVPAAGQLLIDVHACGVCRTDLHVVDGELAHPKRPLIPGHEIVGTVRALGAGVTGFAVGDRVGVPWLGATCGHCVYCASGRENLCDSPGFTGYTIDGGYAERTVADHRYCVHLPRRYSDLEAAPLLCAGLIGYRTLRMAGNAQRIGIYGFGAAAHLVAQVAFFEGRKVFALTRPGDAAAQQLALSLGAVWAGGSDEMPPEPLDAALIFAPVGALVPAALRAVDKGGIVVCGGIHMSDIPSFPYAWLWGERRIASVANLTRVDAVEFMRLADAMPLRVEAVRYALTDANRALDDLRAGRVSGAAVLGMGG

SEQ ID NO: 26473 - protein, 461 aa, Burkholderia cepacia R1808
MSREQYPKQLIGVLGADSLLQATVQRMTGFTAGESEVSAPIVVCGDEHRFVTAEQLRASGLAASIVVEPARRDTAPALTLAAAVAHADGQDAIVVAMPADHAIADTPAFHRAIALAVEHARRGAIATLGVPPTRPDTGFGYIKLGEALDGGAHRIERFVEKPAAELAAQYVESRAYWWNSGIFVVRASVWLDTLRALQPDMHAACLTAYVQGKTDGPFFRPHEQAFLQSPADSIDYAVMERLASTAVGAEGVVVPLDAGWSDLGSWDAVWEALDKDADGNVGRGKVVFEGATSSFVHSEGRLVACVGVTNAVVVETADAVLVADRSHVQDVKGLVSRIRAQQAPEADAHRKVRRPWGYYDSIDHGARFQVKRIVVHPGGRLSLQLHHHRAEHWIVVSGTALVTRGDEQFMLGENQSTFIPLGVTHRLENPGKLPLELIEVQSGSYLGEDDIVRFDDTYGRA

SEQ ID NO: 26474 - protein, 461 aa, Burkholderia cepacia R1808
MVSGNEKDGLKRGLKNRHIQLIALGGALGTGLFLGIAQTIKMAGPSVLLGYAVAGVVAFFIMRQLGEMVVDEPVAGSFSYFADKYVGHFTGFLSGWNYWVLYILVSMAELSAVGIYVQYWWPGVPTWVSALVFYVAINLLNLASVKSYGETEFWFSIIKVAAIVGMIGFGGWLLVSGHAGPEASIANLWQHGGFFPNGVSGLVMSMAAIMFSFGGLELIGITAAEADDPKHSIPRATNQVIYRILIFYIGALAVLLSLYPWEKVVTGGSPFVLIFHALSSNLVANVLNVVVLTAALSVYNSGVYSNSRMLFGLATQGNAPKVLCSVNRRGIPLAALGASALATGVCVLVNYFMPGKAFEVLMGLVVSALIINWAMITLIHLKFRQAKRIAGEQTSFRSLGYPFTNYLCLAFMAGILVVMYLTPDLRLSVYLIPVWLAVLAIGYRFRQKNARYALGDGASAR

SEQ ID NO: 26475 - protein, 452 aa, Burkholderia cepacia R1808
MTDTISASQHEDTNLRTDAAWLDAHWMPFTANRQFKSDPRMIVSAKDAYYTDAEGRKIFDGLSGLWCTGLGHGRTEITEAVSRQIAQLDYAPAFQFGHPKSFELANKIKELTPAGLDYVFFTGSGSEAADTSLKMARAYWRAKGKGTKTRLIGREKGYHGVNFGGISVGGIGANRKLFGQGIDADFLPHTQLAENKFSRGMPDNGADLADRLLDLITLHDASNIAAVIVEPFSGSAGVVIPPKGYLKRLRDICTAHDILLIFDEVITGFGRSGAMTGADAFGVTPDIMNFAKQVTNGTQPLGGVIATKEIYDTFMAAGGPDYMLEFPHGYTYSAHPVACAAGVAALDLLVKEDAVARVRDLAPHFEAAVHGLKGQRHIADIRNYGLAAGLTIAALPGEPARRPYEIAMRCWAKGFYVRYGGDTIQLAPPFIAEKREIDNLVNALSDALNEVD

SEQ ID NO: 26476 - protein, 307 aa, Burkholderia cepacia R1808
MATAFYTHPDCMLHEMGEWHPECPARLSAIQDQLIASRIDDLIVHESAPFASEVALGRVHTQAHIDYIRSMTPVDGYVEIDPDTLMNRDTWRAALRAAGAAIAATDAVIEGRYANAFCSVRPPGHHAEPARAMGFCFFNNVAIAARHALDVHGLERVAIIDFDVHHGNGTEAAFANDERVLMCSFFQHPLYPFSGADHQAPNMVNLPMPARSNGMAVREAVDMFWLPRLDAFKPQMVFVSAGFDAHREDDIGNLGLVEADFEWLTAQIVEVARRHAQGRIVSCLEGGYNLSALGRSVVAHLRALAGV

SEQ ID NO: 26477 - protein, 300 aa, Burkholderia cepacia R1808
MAYKTIEDTIGNTPLVQLVRLPDDEIRARNNVVLAKLEGNNPAGSVKDRPALSMISKAEARGRIKPGDTLIEATSGNTGIALAMAAAIRGYKMVLVMPEDLSVERRQSMAAYGAEIILTPVKGGMELARDLAEQMQREGKGVILDQFGNPDNPVAHYESTGPEIWRDTEGRVTHFVSAMGTTGTIMGTSRYLKEQNPAIEIIGAQPEDGSRIPGIRKWPEAYMPTIFDRSRVDRVENVSQAASETMARRLAAVEGIFAGISSGGACEVAMRIARQVENATIVFIVCDRGDRYLSTGVFPA

SEQ ID NO: 26478 - protein, 360 aa, Burkholderia cepacia R1808
MDDELNSRLKPLRDRIDAIDAQLIALLNQRAAVALEVGEVKKHFNAPVFRPERELQVIARLQDMSAGPLAGEHISAIWREIMAASRALEQTIHVAFLGPVGTYSEQAMFEYFGQSIEGLPCPSIDEVFRSVEAGAAAFGIAPVENSTEGAVSRTLDLLLQTQLLISGELALPIHHNLLTQSGTLAGVTRVCAHAQALAQCQQWLAANAPQLERQAVSSNAEAARLAAADPSVAAIAGDRAAAHYGLQVAFSLIQDDPHNRTRFVIVGKQPAGQSGHDQTSLIVSVKNEPGAVFKLLEPLARHGVSMTRFESRPARVGTWEYYFYIDIEGHRDDAAVAAALAELGQKAAFLKILGSYPRAR

SEQ ID NO: 26479 - protein, 482 aa, Burkholderia cepacia R1808
MIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 26480 - protein, 431 aa, Burkholderia cepacia R1808
MTDQASSNWRLETIAVHGGYRPDPTTRAVAVPIYQTVAYAFDDTQHGADLFDLKVQGNIYTRIMNPTTDVLEQRIAALEGGVGALALASGQAAVTYSIQTIAEAGDNIVSASSLYGGTYNLFAHTLPQYGITTRFADPRDPASFDALIDARTKAIFAESVGNPLGNVTDIAALADIAHRHGIPLIVDNTVPSPYLLRPFEHGADIVVHSLTKYLGGHGTSLGGAIVDSGKFPWAQHADRFKRLNEPDVSYHGVVYTEAFGAAAYIGRARVVPLRNMGAAISPFNAFQILQGIETLALRIERISDNALKVAQHLARHENVEWVNYAGLPDHPDHPLVARYLSGRAPGILTFGVKGGRDGGAKFQDALKLFTRLVNIGDTKSLATHPASTTHRQLSPAELAKAGVKEETVRLSIGIEHIDDLLADLDQALAQL

SEQ ID NO: 26481 - protein, 458 aa, Burkholderia cepacia R1808
MTQHFDAIVIGTGQAGPPLAARLAGAGMKVAIVERGRFGGTCVNTGCIPTKTLIASAYAAHLARRAHEYGVSAGPVSVDMKAVKARKDAIAGRSNHGVEQWVRGLDHTTVLQGHARFEQADTVRVGDALLQAERIFINVGGRAQIPPIPGLDTVPYLTNSTMMDVDFVPEHLVIVGGSYIGLEFGQMYRRFGARVTIVEKGPRLIQREDDDVSQAVQEILAGEGIDVQLGANCLRARRDGERVVVGLDCDGGGREVAGSHLLLAVGRVPNTDDLGLERAGVATDSRGYIAVDEQLRTNVPGIWALGDCNGRGAFTHTAYNDYEIVAANLLDDDPRKVSDRIPAYALYIDPPLGRVGMTLAQARQTGRRLLVGTRPMTRVGRAVEKGESLGFMKVIVDADDHALLGASILGVTGDEVVHGLLDVMAARAPYTTISRAMHIHPTVSELVPTLLQDLHPVE

SEQ ID NO: 26482 - protein, 334 aa, Burkholderia cepacia R1808
MLQYESSLDAMRDAVLFPIGQALHMVSFKAMKIVPAHYIISKARDRGDLQPGKTVVETSSGNFALGMAIVCNRLNHPFVAIGDPAIDPAFKRQLEMLGGRVEIVTDKKGSQGYQKARLDRLQEILAAEQGAFWCRQYDNENNGLAYANIARELLEIVGPRLILVAPVGSGGSSCGIAAALRAGGADCTLVGVDTFNSVLFGQIDGPRKLRGLGNTIMPGNLKHMLFDDVHWVSSELADHFTRKLYKTTGHFRGPTTGAAFAVVRFVRNRYPDAPIVFLSPDDGSRYVDTTFASNDDSPAYDQLRPVEIGHPTAYDANTEWAWMKWDRSDIHRFQ

SEQ ID NO: 26483 - protein, 320 aa, Burkholderia cepacia R1808
MTELLHGDGAIRRTTPYGSSIENTYAGVLSFMRRNYSRVLDGVDVAISGVPLDLATTYRSGARLGPAAIRAASVQLAELHPYPWGFDPFDDLAAVDYGDCWFDAHNPLSIKPAIVEHARTILRSGAKMLTLGGDHYITYPLLVAHAERYGRPLSLIHFDAHCDTWADDEPDSLNHGTMFYKAVKEGLIDPATSVQVGIRTWNDDFLGIERLDAAWVHDHGARAAVERIVGIVGARPAYLTFDIDCLDPAFAPGTGTPVAGGLSSAQALAIVRGLGAVDLIGADVVEVAPAYDHADITAIAAAHVACDLLCLWRQKKVAGR

SEQ ID NO: 26484 - protein, 318 aa, Burkholderia cepacia R1808
MNDPLHFQPLGGNEMPRSGGIATMMRLPHVASAAGLDACFVGVPFDLGTSNRTGARFGPRQIRTESVLLRPYNMATRAAPFDSLQVADIGDVAINPYNLHDSIARIEAAYDAILAQDCKPITLGGDHTIALPILRAIHRKHGKVALIHVDAHADVNDTMMGEKIAHGTPFRRAVEEGLLHGDKVTQIGLRGTGYAAEDFDWCRDQGFRVVQAEACWNQSLVPLMEEVRARVGDTPVYISFDIDGIDPAYAPGTGTPEIAGLTVPQALEIIRGAKGLNIVGCDLVEVAPPYDPFGTTALLGANLAYELLCVLPGVAYRD

SEQ ID NO: 26485 - protein, 472 aa, Burkholderia cepacia R1808
MVSSESIPRAAAPSSTIDAGAISARLDRLPPTRSVWKLVVLLSLGFFFELYDLLYSGYVAPGLVKSGILSATTHGLFGTTGVASFIAALFSGLFIGTIACGFLADRFGRRAIFTWSLLWYTAANVVMAFQDTAGGLNFWRFVVGLGLGVEMVTIGTYISELVPKQIRGRAFACEQAVGFVAVPVVAFLAYLLVPHAPLGLDGWRWVVLIGAHGALFVWWIRRELPESPRWLAQQGRVDEADRIMRALEAKVEAEYGRPLPPPAPPEPVPPRGRFRDMWVPPYRSRTIMMTIFNVFQTVGFYGFANWVPTLLIKQGITITSSLMYSSVIALAAPLGPLIGLVIADRFERKSVIVAMAAAIVVCGLLFSQTTVGAFLIVLGIGLTLASNIMSYSFHAYQAELFPTSIRARAVGFVYSWSRFSAIFSSFVIAAVLKGFGTFGVFAFIAGAMVIVMAAIGFMGPRTRGIALEAISK

SEQ ID NO: 26486 - protein, 457 aa, Burkholderia cepacia R1808
MQPTVGVGAEETDFGTKGVIDRYFDISSRGSTQRREIVAGVTTFLAMVYSVFVVPGMLGKAGFDTSAVFVAVCLTTAFGSLLMGLWAKLPIAIGCAISLTAFTAFGLVLGKGLHPSVALGAVFVMGVVFTGISVTGVRSWILRNLPAGVAHGTGIGIGLFLLLIASNDVGLVVKNPGAGLPVSLGQITAVPAIMSIVGLAAIFGLEKRRVPGGILLVVVAVSAIGLAFDPAVKYRGIFALPSLSAPGHASLIGAMDIKGALSMAVLPSVLALVMTAVFDATGTIRAVAGQAGQLDAHGRIVNGGRALTADSVSSIFSGFLGGAPAAAYIESSVGVAAGAKTGLAAAVVGVLFLVVMFFSPLAALVPSYATAPALMYVGLLMLGSVSKLHMDDVVDAMSGLVCAVFIVLTANIVTGIMLGFSTLVIGRVASGEWRKLNVGTVLIAAVLVTFYLGGWAI

SEQ ID NO: 26487 - protein, 371 aa, Burkholderia cepacia R1808
MNHDPLFQPLQFGALTLPNRIVMPPMTRSRATQPGDEANELMAEYYAQRASAGLIVSEGTYIAPLGKGYAWTPGIHTRSQVAGWRKVTDAVHAAQGRIFAQLWHVGRLSHTSLHGGAQPVSSSPIQAKGVNVFIAGDDGSTPGFVQASEPRALTVAEIGEIVAQYRAAARNAMEAGFDGVELHGANGYLVNQFIDSNANTRTDAYGGSLENRLRFLREVAQALIEGTGDASRVGIRLAPLTTLNGCVDDDPETTYLAAATLLGELGVGYLHIAEADWDDAPLMPPAFKQKLRAAFGGVLIYAGKYTAERAREAIAAGWADLIAFGRPFVANPDLPERLRSGAALAPHDRNTLFGGGAKGLTDYPALAQACA

SEQ ID NO: 26488 - protein, 487 aa, Burkholderia cepacia R1808
MSTENLALKDPSLLRQQAYINGEWQSAANGESFEVRNPATGGLLGTVPAMGAAETRQAIDAANAAWPAWRKKTAKERAAILRKWHDLMMENADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGELTSNPIVRKLSFTGSTPVGRLLMSQCAATVKKVSLELGGNAPFIVFDDADLDAAVQGAIASKYRNSGQTCVCTNRFYVHEAVYDAFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 26489 - protein, 427 aa, Burkholderia cepacia R1808
MKNADLHARKNAATPRGVGVMCDFYAARAENAELWDVEGRRFIDFAAGIAVLNTGHRHPKIVKAIADQLNCFTHTAYQIVPYASYVELAEKINARAPGDYPKKTAFFTTGAEAVENAIKIARAATGRPGVIAFAGGFHGRTMMGMALTGKVAPYKLNFGPFPGDVFHAPYPNPLHGVTTADSIKAIEMLFKADIDPKRVAAIIFEPVQGEGGFNPAPADFVRALRKICNEHGIMLIADEVQTGFARTGKLFAMQQYDVLADLITMAKSLAGGMPLSGVVGRADVMDAAAPGGLGGTYAGNPLAVASAHAVLDIIDEEKLCERATQLGDALKAKLNALRADIAPIADVRGPGAMVAVEFVNPATGEPDADFTKRVQARALERGLLLLVCGVYSNVVRFLFPLTIPQAVFDEALTILEEVLKETVGVPA

SEQ ID NO: 26490 - protein, 263 aa, Burkholderia cepacia R1808
MTVADVEIPGYAQDIALRLYRRADKTGLPVVLYFHGGGFVRGTLDDADFAARFLAERLPALVVSVDYSLAPAFPFPAAPEDAYRAAVWAATRARAFGGNPKKIGVAGHDAGGQLANCLAFIARDRGEVPIAAQALFGPMLDPSMTRIGDADRLSSDITARECAACYRAYLPQAAQRMHPYAAPLESVRLAGLPPTLIVTAQNDVLHVEAEKYAGCLISSGVLTQVIRYPDVTHAALATHAAALEEAVRFFQCRFQARQPNRSE

SEQ ID NO: 26491 - protein, 475 aa, Burkholderia cepacia R1808
MSTQPQIVPTILCGGAGSRLWPVSRESHPKPFIRLEDGESLLQKAFKRGAQLPGVTEVVTVTNRELYFKTSDEFSTVNTGHLSTSFILEPFGRNTAVAIAAAALRVAATLGGNAILLVLPADHLVTDDAAFATAVQEAAALALKGALVTFGITPTFAETAYGYIEADGTRVKRFVEKPTVDVARQYVESGSFLWNSGMFCFTAAFLLAEMAKHCPEVLEATRACIAQSRQSEGGGVSLVELNGDQLNRTPDISIDYALMERSDKVAVVRCDIGWSDIGSWNALGDLLKPDDHGNRVDGEALLHDVSNCYIRSDNRLVGAVGVRDLLVVDTPDALLIADRNRAQDVRHVYAALKSQGHETFRVHRTVGRPWGMYTVLEESTRFKIKRIEVKPGASLSLQLHHHRSEHWIVVSGMALVVNNDEEFYLRTNESTYIPAGHKHRLTNPGVVDLVMIEVQSGDYLGEDDIVRFDDNYGRS

SEQ ID NO: 26492 - protein, 427 aa, Burkholderia cepacia R1808
MSNNQILFERAQKTIPGGVNSPVRAFRSVGGTPRFVARAQGPYFWDADGKQYIDYIGSWGPMIVGHVHPEVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADIAKHTTVLEYNNVAALEEAFGAFGDEIAAVIVEPVAGNMNLVRGTPEFLNALRALCTKHGAVLIFDEVMCGFRVALGGAQQHYGIAADLTCLGKVIGGGMPAAAFGGRRDIMAHLAPLGGVYQAGTLSGNPIAVAAGLKTLQLIQAPGFYDALTAQTKRLADGLAAEARAAGVPFAADSIGAMFGLYFAERVPASFAEVTKSDVERFNRFFHLMLDEGVYFAPSAYEAGFVSSTHDDAVIDATLAAARRAFAALAA

SEQ ID NO: 26493 - protein, 135 aa, Burkholderia cepacia R1808
MYGLGDGAKNAQSSIIHIEGDPDHPVNRGTLCPKGASLIDFIHSPNRLTRPEYRAPGSDTWQPISWSDALDRIAKLMKADRDANFVETTDDGARVNRWLTTGMLAASAGSNEVGYLTHKAVRSLGMLVFDNQARV

SEQ ID NO: 26494 - protein, 396 aa, Burkholderia cepacia R1808
MDDSLNFDTLAVRAGTQRSEYNEHSEALFLTSSFCFKSAADAAERFANSEDYFTYSRFTNPTVSMFQDRLAALEGGEACIATASGMAAIMSVVMSALQAGDHLVSSRSLFGSTLGMFSQIFSKFGITTTFVDPTDLNAWREAVRPETKMFFLETPSNPLTELADIEAIGKIAKAANALFVVDNCFCSPVLQQPLKLGADVVMHSATKFLDGQGRVLGGALVGSKEFIMGKVFPFVRSAGPTLSAFNAWVLLKGMETLSLRVEKQSANALEIARWLDAHPAVARVFYPGLESHPQYELAKRQQKAGGAIVSFELKGDTPEQQRANAWRVIDGTQLISITGNLGDTRTTITHPATTTHARVTPEARAAAGITEGLIRLAVGLEYAGDLRNDLARGLGG

SEQ ID NO: 26495 - protein, 272 aa, Burkholderia cepacia R1808
MSNRIQQTFAALAEQGRKGLIPFITAGDPDPAKTVEFMHALAAGGADVIELGVPFSDPMADGPVIQRSSERALARGVTLKTVLADVKRFRETDQKTPVVLMGYANPIERMGVDAFATEAHAAGVDGVLVVDYPPEEAGVFAEKMRAAQIDPIFLLAPTSTDERIADVGKIASGYVYYVSLKGVTGAGNLDVSSIAGKIPAIKSRVPVPVGVGFGIRDAETARAVAEVSDAVVIGSRLVQLLESAAPEGAAAALKSFIAELRAALDGAGKTAR

SEQ ID NO: 26496 - protein, 304 aa, Burkholderia cepacia R1808
MNYQPILERIHTELAPWIGQGRVADYIPELAKVPADKFGMAVVTLDGNVYTVGDARERFSIQSISKLFACTLAFQLLGDALWERVGREPSGTAFNSLVQLESERGKPRNPFINAGALVVTDVLCRRFVKAETALVEFVRRLIGATDVDYDSRVALSELQHAERNRAMAHFMASFGNMQMPPDTVIDAYCRQCAIEMNCIELAQAALFLANGGVAPVTGERIVDASSAKRLSALMLTCGTYDAAGDFVYRVGLPAKSGVGGGIVAVLPGEMAVCVWAPGLDANGNSLAGTLALEWLTTYSGRSIF

SEQ ID NO: 26497 - protein, 304 aa, Burkholderia cepacia R1808
MEDTNMKIGFIGLGHMGAPMALNLLKGGHEVHAFDLSADALRALQDAGAQVAPSPRDAAAGAAFVITMLPAAPHVRSVLAGENGVLAGLGAGATVIDSSTIDPASAQAFGALVREHGGAFVDAPVSGGTGGAAAGTLTFMVGGSDADFERAKPVLAAMGKNIVHCGATGMGQVAKVCNNLVLGISMAAVSEAMSLGVALGIDPKVLAGIVNTSTGRCWSSDTYNPYPGVIDTAPSSRGYSGGFGTDLMLKDLGLANDAARQACQPVYLGALAQQLYQTMSSRGDGQLDFSAVIRLYQPAGKKDA

SEQ ID NO: 26498 - protein, 433 aa, Burkholderia cepacia R1808
MESIKRYFGFAEAGTDFRTEILAGVTTFLTMAYIIFVNPAILGDAGMPKESVFVATCLVAALASIIMGLYANYPIACAPGMGLNAYFAYTVVKGMGFTWQAALGAVFISGCLFLLVTLLRVREAIVNGIPKSLRISITAGIGLFLGIISLKTSGVIVGSPATLVTLGDLHKHDTILAIVGFFTIVTLDYLRVRGAILIGIIGVTVLSFFFGDNQFHGVFSAPPSIDATLFKLDIGAALSTGIINVILVFFLVELFDATGTLMGVANRAGLLVEGKMDRLNKALLADSTAIVAGSVLGTSSTTAYIESASGVQAGGRTGVTAITVAVLFLACLFIAPLAGVVPGYATAPALLYVSCLMLREMVDVPWDDATEAVPAALTALLMPFTYSIANGVAFGFIAYGGLKLLTGQARTVKPIVWIIAAVFLFRYFYLGGE

SEQ ID NO: 26499 - protein, 433 aa, Burkholderia cepacia R1808
MSANDDATFWHNATHHLIRYGGTFEPLIVERARGSFVYDADGRAILDFTSGQMSAVLGHCHPDIVAVIAEYAGKLDHLFSGMLSRPVVELATRLADLTPPGLDRALLLSTGAESNEAAIRMAKLVTGKYEIVGFAQSWHGMTGAAASATYSAGRRGVGPAAVGSFAIPAPFAYRPRFERNGAYDYLAELDYAFDLIDRQSSGNLAAFIAEPILSSGGIIELPDGYMAALKRKCDERGMLLILDEAQTGVGRTGTMFACQRDGVTPDILTLSKTLGAGLPLAAVVTSAQIEERAHALGYLFYTTHVSDPLPAAVGLRVLDVVQRDGLVQRANLMGERLRRGLLDLMERFECIGDVRGRGLLLGVEIVKDRRTKEPADGLGAKITRECMKLGLSMNIVQLPGMGGVFRIAPPLTVSEAEIDLGLSLLEQAIARAL

SEQ ID NO: 26500 - protein, 318 aa, Burkholderia cepacia R1808
MLEAQIAAFVAAVDAAYPAGTAARSPAEQRRIYDRFAAAWTPAELPPGIVRHDALWRAPHGPAIALRRYAPAHGAPRGTVLFFHGGGFVVGSLDSHALITAQLAADTGLAVIAVAYRLAPEHRAPAALEDCLAVTRAARDAAHWPFGPCARPLTLAGDSAGGNLAAAVATALRDAGEAGLDGIALAYPMLGIEPQAPARDTEAHARMLTLDDVRRYRALYWAQADAAALSADPLLRASVPLVASRFDGLPPVLAIGAQHDPLRDDARVYVERIVAAGGVARYWMGEGLVHGCWRALGTSPQAARMHRMIGGFLLAPHA

SEQ ID NO: 26501 - protein, 501 aa, Burkholderia cepacia R1808
MTRRAVANLEILMSVYGLQRLYIGGAYVDATSGKTFDTFDPATGELLAQVQQASAADVDRAVASAQQGQREWAALTAMQRSRILRRAVDLLRERNDELAAIETRDTGKPIGETLAVDIVTGADVIEYYAGLATAIEGLQVPLRAESFVYTRREPLGVCAGIGAWNYPIQIACWKTAPALAAGNAMVFKPSEVTPLTALKLAEIYTEAGVPAGVFNVVQGDGSVGALLTGHPDIAKVSFTGGVETGKKVMSLAGASSLKEVTMELGGKSPLIVFDDADLDRAADIAVIANFFSSGQVCTNGTRVFVQRSIKDAFTAKVLERVKRIRVGKPTDADTNFGPLVSAAQLDKVLGFIASGKAEGAKLLAGGTRLTDGHFADGQYVAPTVFGDCRDDMKIVREEIFGPVMSILDFESEDEVIARANDTHYGLAAGVVTENLSRAHRTIHRLEAGICWINTWGESPAEMPVGGYKQSGVGRENGITTLEHYTRIKSVQVELGRYNPVF

SEQ ID NO: 26502 - protein, 326 aa, Burkholderia cepacia R1808
MQYVKFGSTGLDVSKLVLGCMTFGEPSRGTHPWTLPEADSRPIIRRAIEAGINFFDTANMYSDGTSEEIVGRALRDFAKRDDVVIATKVFYRMRPGPNGAGLSRKAIMTDIDQSLKRLGTDYVDLYQIHRWDDATPIEETLEALHDVVKAGKARYIGASSMYAWQFAKALYTSKQHGWTRFVSMQNHLNLLYREEEREMLPLCEAEGIAVIPWSPLARGRLTRDWSETSGRQQSDAVGQRLYDATADADRAVVEAVAAIAAARNVPRAQVALAWVAHKRGVTAPIVGISKPHHLDDALGALQLKLTDDEIAALEGPYVPHAVAGFN

SEQ ID NO: 26503 - protein, 406 aa, Burkholderia cepacia R1808
MSADPFVIVGAGHAARRTAEALRARDADAPIVMIGAERELPYDRPALSKDALLNDDGEQRAFVRDAAWYDAQRIALRLGTRVDAIEREAQRVRLDDGTTLPYAKLVLATGSRVRTFGGPIDAGVVAHYVRTVADARALRAQLVRGRRVAVLGGGFIGLEVAAAARQLGCNVTVIDPAARLLQRALPEVVGAYAHRLHDERGVGFQMATLPRAIRAAAGGGAIVETDRGDVHADVVVVGIGVLPNVELAQAAGLDVDNGIRVDAGCRTADRAIFAAGEVTMHFNPLLGRHVRIESWQVAENQPAVAAANLLGADDAYAELPWLWSDQYDCNLQMLGLFGAGQTTVVRGDPARGPFTVFGLGDDGRIVAAAAVNLGRDIGAARRLIAAGAMPDPQQLADPTVGLKTFL

SEQ ID NO: 26504 - protein, 502 aa, Burkholderia cepacia R1808
MAADTPPSSAATDAALRVAVQPVILAGGSGTRLWPMSREHYPKQLIGLLGDHSLLQSTALRLDGLAASHPVNDDVLIVCGEDHRFTTAEQLRVTGKRASIMLEPLGRDTAPALTLAALRIVADGSDAVMTVMPADHAVADRARFHAAVAAGVHCAAQGKIATMGIVPARAETGYGYIRVGAPLGDAATGGLDVRRLDRFVEKPHLELARQYVESGEYWWNSGIFIVRASVWLDAIRRLEPEIHAACEQAVANGKQDGDFFRVDRDAFAASPSNSIDYAVMEPLASQPQLCESVVVPLDAGWSDVGSWDAIWQILPKDDAGNVGRGHVLFENADSTFAHAESRLVACVGTQNLVVVETPDAVLVADKSRVQDVKKIVGRIKAERGAEATDHRKVHRPWGHYDSVDMGERFQVKRIVVKPGARLSLQMHHHRAEHWIVVRGTARITRGDETFLLSENESTYIPLGVSHRLENPGKMPLELIEVQSGAYLGEDDIVRFDDTYGRQ

SEQ ID NO: 26505 - protein, 320 aa, Burkholderia cepacia R1808
MPLNPKIAQVLDMIERAKRPSYHHQTPQQARAAYEKSAPILDVAPAPMHSVDACVVPTRDGRTIGARLYLPVAPSLAEPLPALVYYHGGGFTVGSVDTHDALCRMFARDAQCAVLSVDYRLAPEHKFPTAVHDAEDALRWLHREAAAFGIDAARLAVGGDSAGGTLATVCAVLARDAGIHLALQLLIYPGVTGHQATESHARLANGYLLTQDTIQWFFSQYVREPADRDDWRFAPLDGTRGAPSSFAGVAPAWIATAEYDPLSDEGAAYAQKLRAAGNTVALVCYPGMIHEFFKMGGYIPEVRAAHADATAALRAAFDGV

SEQ ID NO: 26506 - protein, 297 aa, Burkholderia cepacia R1808
MAHIGFIGLGIMGAHMARNLLDGDHQLVVNGAFPIPDDLRARAKVVANSTEVARHADVIISMVPDTPDVRNVLFADDGVANGLSAGKLVIDMSSISPLDTQAFAKQINALGCDYLDAPVSGGEVGAREATLTIMVGGPEQAFERAKPLFEKMGRNITLVGDNGAGQTCKVANQIIVALNIEAVGEALLFAARSGADPERVRQALMGGFAASRILEVHGARMTKRTFEPGFRIELHQKDLNLALDGARKLGLALPHTASAQQLFSVCASHGGRAWDHSALVRALEFMSNFEIGQQPDA

SEQ ID NO: 26507 - protein, 478 aa, Burkholderia cepacia R1808
MKIYDQFYIDGAWCKPAGAGTIDVIDSATEAVLGRIPEGAATDARHAVRAAHAAFDAWAATPPATRAGYLRRIVERLQTRSEELAQSITGEVGMPIKLSRAIQVGAPVYNWKVYAKLAESFEFEAKVGNSLVVREPVGVVAAITPWNYPLNQITLKVAPALAAGCTVVLKPSEVAPLNAFMLAEAIHEAGLPAGVFNLVCGYGPVVGEVLATDPEVDMVSFTGSTRAGKRVAELAAATVKRVALELGGKSAAVILDDADFPAAVKGTVNACFLNAGQTCSAHTRMLVPHARYDDARALAKAAAEAYLAGDPRQETTRLGALASAVQQQRVQAYIQRGIDDGAELVTGGTGLPDGLTKGFFVKPTVFGRVDPTSAIAQEEIFGPVLSIITYRDEDEAVRIANDTPYGLGGAVWAGSDERALRVARRLRTGQVDINGGSWNSAAPFGGYKQSGYGRENGVYGLEEYLEYKSMQLRPANPS

SEQ ID NO: 26508 - protein, 302 aa, Burkholderia cepacia R1808
MSGGTFPAFVSAGDILTDMVRAGDAQWTSVPGGAGWNVARAVARLGLPSALAGAIGEDCFSDVLWRASEAAGLDLRFLQRVPRAPLLAIVHETRPPAYFFIGDASADLAFDPARLPQGWAEHVKWAHFGCISLVREPLASTLVALAAQLHARGVKISFDPNYRNLMTAAYRPTLEKMAGLADLIKVSDEDLRHLFGGDGPDAVAAVRALNPRAAVFVTRGAQAATLYAGDDVLEASPPRVEVVDTVGAGDASIGGMLFSLMAAPQRSWREHLAFALAAGAAACRHTGAHAPTLDEVVALLER

SEQ ID NO: 26509 - protein, 491 aa, Burkholderia cepacia R1808
MADWQDKAASLRIEGRAFIDGASRDAHGGKTFDCVSPIDGRVLAKVADCGEADVNAAVAAARRAFDAGVWAGLNPRARKAVLLRWAALMRTHLDELALLETLDAGKPIGDTTTVDVPGAAYCVEWFAEAIDKVGGEVAPADHHLVGLVTREPVGVVAAVVPWNFPILMAAWKFGPALAAGNSVVLKPSEKSPLTAIRVAQLAYEAGIPAGVFNVVPGAGEPGKLLALHRDVDCIAFTGSTAVGKLIMQYAAQSNLKRAWLELGGKSPNIVLPDCPDLERAAQAAAGAIFYNMGEMCTAGSRLLVHRDIKDAFIAKLVAAARAYVPGNPLDPSVSMGAIVDGIQLERVLGYIEAGRSEGTLVTGGARVRQETGGFYVEPTVFEVKPDAKIAREEIFGPVLSVIVFDDVDEAVRIANDTEYGLAAAVWTSDLTTAHDVSRRLRAGTVWVNCYDEGGDMNFPFGGYKQSGNGRDKSLHALEKYTELKSTLIRLR

SEQ ID NO: 26510 - protein, 477 aa, Burkholderia cepacia R1808
MTYRNESAWVQPAAPATAPRTTQARTTAEYRALDAAHHIHPFSDMGALNRAGSRVIVKADGVYLWDSDGNKIIDGMAGLWCVNVGYGRKELADAAYRQLQELPFYNTFFKTTHPPVIELSAMLAEVTPAGFNHFFYCNSGSEGNDTVLRLVYQYWRVQGKPQKKYVISRHNGYHGSTIAGATLGGMDYMHEQMPSKVEHIVHIDQPYFFGEAQAGETPEAFGLARAQQLEAKILELGAENVAAFIGEPFQGAGGVIFPPSTYWPEIQRICRKYDILLVADEVIGGFGRTGEWFAHQHFGFEPDLITMAKGLTSGYVPMGAVGIHERVARPIIDNGEFNHGLTYSGHPVAAAVAVANLKLLRDEGIVERVKRDTGPYFQALMRDTFAQHPIVGEVHGQGMVASLQLAQAPAERRRFANGGEVGTICRDFCFNGNLVMRATGDRMLLSPPLVISRQEIDELVSKAKKAVDATAQQLGLS

SEQ ID NO: 26511 - protein, 451 aa, Burkholderia cepacia R1808
MDFDYDLFVIGAGSGGVRLARMSASYGARVAIAEQEQIGGTCVLRGCIPKKLLVYASHYPHELEDAQGFGWRFDAGTHDWPALIAAKDREINRLSDIYINLLRQSGVDMHAGRATLVDAHTVAVGERTFRARHIAIATGSRPSLPPRPGIEHAITSREALSLPALPGRIAVVGGGYIAVEFAGIFNGFGSRVDLFYRGDRILRGFDDDVRQFLTDEMTKQGVAIHAHAVVESIARADDGTLSVQVGDATHGPYDAVLYATGRVPNVDGLGLERAGVLLDARGAIAVDAYSATSVPSIHALGDVTSRPQLTPVATRDGSLLARTLFGGARVATDHEWVPSAVFSQPEVATVGFTEAHARGVYGDLDIYRTSFRALRHTLSGRDERTLMKLVVARDSQRVVGAHMVGRDAGEIIQGIAIAIRAGATKAQFDDTIGIHPTAAEEFVTMRQKVAD

SEQ ID NO: 26512 - protein, 480 aa, Burkholderia cepacia R1808
MKNDLPELAPQALPSLDALTSLLRDQRAAYLRAPYPEWDTRAQHLRALRTMLIEHADALADAISADFGHRAKQEVLLSEIWMAKEEIDDALKHGKRWMKPMAKRMNKWLRPARAKVVPQPLGVVGIVVPWNYPVLLAAGPLICALAAGNRAIVKMSELTPRTSALFEQLIAKTFSRDHVAVVNGDAELGAAFSALPFDHLLFTGSTHVGRHVMRAAADNLTPVTLELGGKSPAIIGPNARFDAAVDAIIGGKTLNAGQTCIAPDYVLLPRGMEGAFIERARARFAKLYPDLSNNGDYTTIVSPRHYARLQQLASDAQAAGAQLHPLSDAQSDPASRRFVPCALTHVPDASQVMQEEIFGPLLPLVPYERLDEAIGYVNARPRPLALYLFDEDRGTIDRVLRETISGGVTVNETLMHIACGSLPFGGVGASGMGAYHGYDGFVTFSKMKPVLTQSRLNTRGLIAPPYGKRFAAVIRMMLKF

SEQ ID NO: 26513 - protein, 350 aa, Burkholderia cepacia R1808
MSTTYAYAATDARSPLAPFELQRRALRDLDVQIEVLYCGVCHSDLHQARNEWRNTIYPVVPGHEIVGRVSATGPQVSRFKVGELVGVGCLVDSCRTCPSCAEGLEQYCENGFVGTYNGQDRVTGEVTYGGYSTRIVVDEAFVLRVPESLDPAGAAPLLCAGITTYSPLRQWNAGPGKKVGIVGLGGLGHMGVKLARAMGAHVVLFTTSPSKIEDGKRLGAHEVVVSKDEAQMNAHLNSFDFILNTVAAQHDLNPFLNLLKRDGTMTLVGAPEHDHPSPQVFNLIFKRRRLAGSLIGGIAETQEMLDFCAQHGITSDIEVIPMQQINAAYERMLKSDVKYRFVVDMASLAQ

SEQ ID NO: 26514 - protein, 1137 aa, Burkholderia cepacia R1808
MMKREDSLDDVRRAQFASVAPAGTARARRARRREPALSTDDPLWYKDAIIYQVHVKSFYDSNNDGIGDFPGLIMKLDYIAELGVDTIWLLPFYPSPRRDDGYDIADYRGVHPDYGTLADVRRFIREAHARGIRVIAELVINHTSDQHPWFQRARRAKPGSTHRDYYVWSDTDTKYAGTRIIFLDTETSNWTHDPVAGQYYWHRFYSHQPDLNFDNPAVVREVIQVMRFWLDLGIDGLRLDAVPYLVEREGTNNENLPETHAILKRIRATIDAEYPNRMLLAEANQWPEDVQEYFGNEDECHMAFHFPLMPRIYMSIASEDRFPILDIMRQTPALAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAINVEAQTRDPHSLLNWTRRILATRRATQVFGRGTIRFLRPENRKVLAYLRELDGHEPVLCVANLSRASQAVELDLSEFAGRVPIEMTSDSPFPPIGQLTYLLTFPPYGFLWFVLSEHGREPSWRQPQAEPLPEYVTIVMRRGEQRPDVGQLHTLAHDALSSWLTRRRWFASKDRKIGDARLNVVTPMPDEPFQYAEAWVTTHGGDVERYVVPLAAAWGGETSNPLFAQLALARVRRGHTVGYLTDAFALPAFGRGMLRMLRDGATVPTSDGGRLEFLPEQALAALDPGDDAEVRWLAAEQSNSSLVIGDAIVLKLVRKVAHGVHPEAEMSRYLTRIGYANTATLAGEVVHVDPDGTPHTVAILQRYVDNQGDAWTRSFDFLKRAIDELALPAVGDGEPAERDGEPDALLGYAAFAGVVGTRLGELHVALAQPSDDAAFAPERATPEHVDGWCVDAIASFGHALDVLATRLDALDPSARDAAETLLASRDAAVQALGALVPRTLDAVCTRIHGDFHLGQVLDVQGDALLIDFEGEPARALERRRAKSHPLRDVAGLLRSLSYVSATAQFAIEKVPPQAAGRKRALFDRFGQAAADRFVECYRAAAEHAPERFVDPRYADRLLALFLIDKASYELCYEAANRPDWLGVPVGGLAALVERLLDAHAASDHGGTR

SEQ ID NO: 26515 - protein, 421 aa, Burkholderia cepacia R1808
MAVHQANAGLPAQAQTVPLRAWSVLAASTLAFMVCFVVWMMFGVLGVQLRADLGLNSTEFGLLTSTPVLTGALMRLPLGTWTDRFGGRIVMTVLLVVCAVPVYVVSYATQLWQFLVIGLFLGCVGASFAVGTPYVARFFPPQRRGLAMGVFGAGTSGAAVNLFVTPLLLNAYGWRVVPRIYAIALLATAVIFWLASAPDPGAGKRGGSLLDSFKVLRDPRVWRLCQYYSIAFGGFTALSLWIPQYLKNEYGMSLVMASAFAAGFSLPGSVLRALGGALSDRFGAHAVTWWGLWVAWISLFLLSYPATDFVIHTIDGTAALKLSMPVAGFVALTFVLGAVFAFGTASTFKYVADDFPDNMGVVTGIVGLAGGLGGFLLPILFGMLLDFARVRTTCFMLLYGIVWVSLILIYLTEVRRTPVTG

SEQ ID NO: 26516 - protein, 508 aa, Burkholderia cepacia R1808
MGELASIGNARIADSDLHEPGRGGAAAAVVPVILAGGAGTRLWPMSREQHPKQLTQLVGDESLLESTLRRVRGLSATFELAAAQVVCGDAHRHITVRQLAASELRAQVIVEPARRDTAPAMTLAAELARVRHGDAVLAVMPADHAIADTAAFERAMETALRYAQLGCLATLGVRPTHADSGFGYLRTGMPVALDGAAGAFALDAFVEKPAPEIAAHYVASGSHWWNSGIYVVRASVWLRAIAALAPEIHHACVAAIRDGAAAADCFHPAAQPFAACPSNSIDYAVMERLSSLAEPPAAVAVPLDAGWSDLGSWDAVWAALDKDANGNAGRGRVMFEDAAACYAHSEGRLVACVGVSNVAVVETPDAVLVVNREQVQGVKSLVARIKAERGAEADTHRLVRRPWGCYDSVDRGERFQVKRIVVDPGARLSLQMHHHRAEHWTVVKGTAAVTRGDEQFLLGENESMYIPMGVRHRLENPGRLPLEIIEVQTGSYLGEDDIVRFDDAYGRV

SEQ ID NO: 26517 - protein, 481 aa, Burkholderia cepacia R1808
MMKIQNLIGGRHCDASTGRTFDKLAPATGDRICTVPASSADDVDRAVRAAHDALHDDAWARAGGAARARWLYRLADLVERESEALESLLAVEQGRPPAEMRMMDLPMTIDTLRYFAGWADKLEGRTIPTDGFMGRPTLSYTRRAPVGVAGQIVPWNAPLMIAVWKLAPALAAGCPVVIKPSEDAPLAVARLGKLACEAGLPAGVVNIVHGMGAEVGAALVAHPLVSKISFTGSTEVGRTIACDAARTFKRVTLELGGKAAQIVFADADLDRAIPSLVAGMFANQGQTCAAGSRVLAHRSIADALEARLADAARTIRVGPPTEAGVQMGALINPRHLARVRAHVAAALAEGAVMLAGDEQVPPRGCFMRPTILGGVHPGMRIAREEVFGPVGMVMPFETEDDAIRIANDTPFGLSASVWTQDVGTAHRVAERLDVGAVAINAWSPIDARLPWGGTRQSGIGRDLSKAALDSYLEEKIVTAAL

SEQ ID NO: 26518 - protein, 441 aa, Burkholderia cepacia R1808
MSSAAAGHTTPTVIIARGDGNYVYDVEGHRMLDGVGGLWNVNVGHNRPEVKAAIARQMDELSYYQTFDGVAHPRVYDLADRLCAMFEQEDMQRVMFGSGGSDAIETALKMARQYWVAAGEPSRTKFLSLRNGYHGVHMGGTSIGGNGVYHYNHGPLLPGCVLLDTPWLYRNPWNCDDPDQLVEHCIRQLEDTIAFHGQQTIAAFVAEPVQGAGGLIVPPASYWARVRNVCDRHGILLIADEVVTGFGRTGSMLGSRGWGVAADILCVAKGISAGYVPLGATLYNGRIAQAIEHGAGFSHVVMHGYTYSGHPLACAASLAVLDIVEAEDLPGNAARMGQRLLEQLLPLTRDFETVGDVRGKGLMLALDLVTDKASRTPLDPGKGFAARVADAARKRGVLVRAIANKIVMSPPLTLQPKETDLIAHALRDALQECCADARAIA

SEQ ID NO: 26519 - protein, 483 aa, Burkholderia cepacia R1808
MSSGVRHDYAPLRLYIDGRFHDADGRRTQPVVDPGTTRVLGELPHATAHDIDAAVQAAHRAFVTWRHESPLVRSDLLRRAAALARERAETIGRHITMDQGKPLREAIAEVVSAAEQLEWHAEEGRRTYGRVVPARSPDVMQTVLREPIGVCAAFSPWNFPFSQAMHKIAAALASGCTLVLKGPEESPSAIVALAQLFHDAGLPPGCLNIVWGVPGDVSKQLIEAPQVRKISFTGSVPVGKQLAALAASLMKRMTMELGGHAPVLVCADADVERAAAMLAAYKFRNAGQVCVSPTRFFVQRAAFDRFVCAYLDAVGTIRVGYGLDAGVTMGPLAHARRVDEIDAFVADATAKGAQIATGGMRLPGPGHYFAPTVVLGPTRDTRLMNDEPFGPIVGIVPFDDLDDALAEANRLPFGLASYAFTTSARNAHRISRALEAGMVNINHFGMGPAEIPFGGVKDSGFGSEGGMEAFDGYLVTKFVTQMN

SEQ ID NO: 26520 - protein, 263 aa, Burkholderia cepacia R1808
MNTAAPVALSVKNIHKSFGDHHVLKGISLDAHEGDVISILGASGSGKSTFLRCLNLLETPDDGSVALAGEELKMKRTRDGKLQPGDRRQVDRIRSQLGMVFQNFNLWSHMTVLDNLVEGPLRVLKRSRAEAVEEAEALLARVGLADKRGYYPAHLSGGQQQRVAIARALAMHPKVMLFDEPTSALDPELVGEVLRVMRSLAEEGRTMLVVTHEMGFARHVSNRVMFLHQGEVDCDGPPAALFGGECSARFGQFVSSHHDRAAN

SEQ ID NO: 26521 - protein, 345 aa, Burkholderia cepacia R1808
MLTIYSSDHHLHRGVELKDGAITDSFENPLRAETVLAQVRAAGLGDVLVPRAFDPACYAGAHSARYVEFLAGAWDEWAASGRSCQALPLVWPVRAMPSAAALPDFIDGKLGFFAMDAGAPINAGTWDAVRASANSALTAADLLSNGGARAAFALCRPPGHHAGREYMGGYCYLNNAAIAAQRGIASGAARVAIVDVDFHHGNGTQDIFYDRADVLFASIHGEPAVCYPYFSGYAHERGSGAGDGFNLNLPLPKGTQWDAYARALEHAAAAVAAHAPDLLVVSLGVDTFEHDPISHFKLRSPDYLRIGEALARLRVPTLFVMEGGYMVDEIGVNAVNVLLGFEGRA

SEQ ID NO: 26522 - protein, 338 aa, Burkholderia cepacia R1808
MNLQRFPRYPLTFGPTPIQPLKRLSAHLGGKVELYAKREDCNSGLAFGGNKTRKLEYLIPDALAQGADTLVSIGGVQSNQTRQVAAVAAHLGMKCVLVQEHWVNYDDPVYDRVGNIQLSRMMGADVRLVADGFDIGIRRSWEDAMESVRQAGGKPYPIPAGCSEHPLGGLGFVGFAEEVREQEAQLGFRFDYVVVCSVTGSTQAGMVVGFAADGRADRVIGIDASATPERTREQITRIARHTAELVELGRPIADADVVLDTRYAGPEYGLPNDGTLEAIRLCARLEGVLTDPVYEGKSMHGMIDMVRRGEFEPGSKVLYAHLGGVPALSAYAEIFRDG

SEQ ID NO: 26523 - protein, 454 aa, Burkholderia cepacia R1808
MESPKQYEYLFLGGGKGGKSLAMDLARSGKRVAIIERGMIGGSCINVACIPSKTLIQNARNMHAWRSADATAHPVADMARVHANVRAVVDGMVDVNRRAFEQSGLDLVIGSGRFVAPRRVAVRAADGSEQLFEGENVYINTGTVATIPDVPGLRDAAPLTHVEALGLDVLPARLIVIGGGYIGLEMAQAFRRLGSEVVVIHDAPRVAVREDEDVSIEIQNAFEADGIALRLSARIASVEGRSGTGVTVALADGTAVEGSHLLVATGRRPVTDDLGLDLAGVERDARGFIKVDDTLATTAQRTWAIGEVAGTPMFTHASFDDYRVLKAGIDGRGGSTASRVIPYALFTDPELARIGLNETDAKARNTPVIVAKLPMAAVPRARTNGTTRGFMKALVAPDSGQILGFTMVGSGAGEVMSAVQMAMIGKLPYTSVRDAILAHPLLAEGLNLLFATIK

SEQ ID NO: 26524 - protein, 500 aa, Panax ginseng
MFPLAYPLLFVLLGALSWWILPIISPLKRHHKLPPGPRGLPIIGSLHTLGALPHRTLQTLAKKYGPIMSMRLGSVPTIVVSSPQAAELFLKTHDNIFASRPKLQAAEYMSYGTKGMSFTAYGPHWRNIRKFVVLELLTPAKINSFVGMRREELGMVVKSIKEASAANEVVDLSAKVANIIENMTYRLLLGRTKDDRYDLKGIMNEALTLAGRFNIADFVPFLGPLDIQGLTRQFKDTGKRLDKILEFIIDEHEQNSSNGNASGDFIDDMLSLKNKPSNTHDELSKVIDRSVIKAIMIDIISAAIDTSDTSIEWILTELIKHPRAMKKCQEEIDAVVGVDRMVEETDLPNLEYVYMVVKEGLRLHPVAPLLGPHESMEDITINGYFIPKQSRVIVNSWALGRDPNVWSEDADEFLPERFEGSNIDVRGRDFQLLPFGSGRRGCPGMQLGLITVQLVVARLVHCFDWNLPNGITPDNLDMTEKFGLTTPRVKHLLAVPKYRL

SEQ ID NO: 26525 - protein, 399 aa, Populus tomentosa
FARESDVKVMRVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGETCIRGDQIMKGYLNDPEATSRTIDKEGWLHTGDIGYIDDDDELFIVDRLKELIKYKGSQVAPAELEALLIAHPEISDAAVVGLKDENAGEVPVAFVVKSEKPQATEDEIKQYISKQVIFYKRIKRVFFIEAIPKAPSGKILRKNLKEKLPGI

SEQ ID NO: 26526 - protein, 1057 aa, Ostreococcus tauri
MSVTHTSLSSINESLPRLARARAHVDAGRRRDGLIIRKSFGRSRTPIARARAVSDVDVPDATILRVRYHRTDGSSYAGWGAHAWGDVRAPTTWDAPLAATLDDYSTWATFDVELVSGASRVSVLIHRGEDQDCRAEDLDVSAGTREVWLVSGYSCAFEQEPDLKALPKGDVDKHRAIWVSASVIAVPPDFALSAAARESVKYSLVSSESAELRVTGEGVEGGDGEPQTLELIPTGLSKGAREKFPHIAAADYRALELPPSAPVRDLLRRQLAVAAVDEDGAPVDATGVQLQGALDELYAYDGPLGAEFGSDNLVTLRVWAPTAQNVTLSVFDEPRGDATRIEKSMTRDSRTGVWSVSGEFDGKFYNYNVTVFNPSTGQVSTNVSSDPYARSLAADGRRAHVCDISKDDLKPAGWESFEKPTFTHPVDCAIYELHIRDFSAMDDTVSSAARGKYVAFTESSSTCVSHLRKLAQAGLTHVHLLPSYDFGSVPELPENQKSVDFEQLAALPSNSSKQQELIEECNWCDAFNWGYDPVHYGVPEGSYSTDADGSRRVLEYREMVKSLAENGLRVICDVVYNHTLSSGPSDVNSVLDKIVPGYYHRRNFDGFIEASTCCNNTASEHYMMDRLIVDDLVHWARSYKVDGFRFDLMGHLMLSTMLKAKKALNSLTLERDGVDGKSLYLYGEGWDYAEVAQGRVGKNASQLNLAHTGIGSFNDRVREGCIGGSPFADPRLQGFLTGLYYSPNGVVQQGDEESQRYRMMEDGERILAALAGNVRDFAYVDRHGVEVMASSAVWPNSNVAYAGEPEETVNYVSAHDNETLFDSITLRVADSISLAERCRINHVATAIVALAQGVPFFHAGDEILRSKSLDRDSYSSGDWFNRLDYSGETHNFGVGLPPARKNGDRYAFITEMLADLSMRPTKENIHAATKNLCELLSIRRSTPLLRLRSSHDIQRRMKFYNRGPAQTPGLIIASINDGDASTPGLQALDSNYKRIVLAINATPRRISHEEAGLKVDFAGVELKLHPLISDAVAAESSVVDGAYTIPPYTWAVFVQCR

SEQ ID NO: 26527 - protein, 399 aa, Ostreococcus tauri
MVRSGMRYGYRINGEGGWDTGQRFDATKVLMDPYAPLVEARRKVFGEWSKHKVSGDTNDPDMLSGYDFESAPFDWRGVESPQIDEKDMIVYEMTVRAFTADASSGLDADARGSYAGVAAKVEHLKSLGVNVVELLPVFEYDEMEFQRIPNPRDHMVNTWGYSTMSFFAPMTRFGKKGCSAREASREFKEMVRALHAAGIQVILDVVYNHTGEMNDELPNTCSMRGIEYKTYYMTDTNQYVQMLNFTGCGNTLNANNPYVSQFILDSLKHWVKEYHVDGFRFDLASALCRDEQGHPMNSPPLIRAIAKDPELAHVKLIAEPWDCGGLYQVGSFPNWDRWSEWNGAYRDVLRRFIKGDEGMKSDFARRISGSSDMYHHNNRKPYHSVNFITAHDGFTLRDL

SEQ ID NO: 26528 - protein, 495 aa, Taxus canadensis
MDAMDLTVAKFKEFTQLQSSAILLTVVSGIIVIVILLLRSKRRSSLKLPPGKLGLPLIGESLSFLWALRSNTLEQFVDKRVKKYGNVFKTSLLGQPTVVLCGAAGNRLILSNQEKLLSRTVSDRVAKLTGDTSISVIAGDSHRIIRAAVAGFLGPAGLKIHIGEMSAHIRNHINQVWKGKDEVNVLSLARELVFAMSASLFLNINDREEQHQLHKTLETILPGYFSVPINFPGFAFRKALEGNSKRRKHFSVLQEKRRRDLSVGLASRTQDLLSVLLAYEDDKGNPLTDEEVLDNISALIDGSYESTSSQMAMLLKLLSDHPECYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRKCPGWEFAKTEILLFVHHFVKTFSAYTPIDPHESIWGRPLPPVPANGFPIKLISRS

SEQ ID NO: 26529 - protein, 435 aa, Kineococcus radiotolerans SRS30216
MSEPATVSQRLDALPFTRRHTRLLLGSGVGWALDALDVGLVAYVLVALRQQWGLDAAQLSWIASVGFAGMAVGAALGGLLADRVGRRQVFALTLLVYGLATGAAALSWSLTALLVFRFLVGLGLGAELPVASTLVSEFAPRRIRGRVVVALEAFWAVGWTLAALIGYLLVPASDDGWRWALALGALPAVYAIVVRRGLPESVRFLLAKGRTAEAEAVVRDFEASAGVTSTAPLVPDPPAGARRGIWSAGLRRRTAGLWLVWFFVNFSYYGAFTWIPSLLVEDGFTVIRSLQFTLIITLAQLPGYALAAVLVEVWGRRRTLAVFLVGSALSALAYAGAGTTTTILLAGMALSFCNLGAWGALYAVTPEVYPTAVRGRGAGAAAGFGRIASILAPLSVPLLLDAGGSGAVFVVFGVAFAIAAAASFLLPERRGVALD

SEQ ID NO: 26530 - protein, 299 aa, Kineococcus radiotolerans SRS30216
MRFERWGGPDVLHVVDVPSPAPGAGEVRVTVRAAGVTAAESAAREGALAQLYPTAFPAGTGVEFAGVVTGTGPGVESVAVGEEVLGWSPERGGHADVVVVPAEAVVPKPEGVSWEVAGALYVTGVTAYSCVESAGVRDGDRVLVLGATSDVGTLAVQLARLCGATVVGVADPADHAWLHAHGADAVAPTDDVEGLARLLRVRGTRVDAVVDTTGVDLEPLTRALGVLPARAVAAPPVEADLEFGPHPARCPEVLAELAALVAADRLHVPIAGSFPLSRVQEAFAMAERPHPQGRIVLLP

SEQ ID NO: 26531 - protein, 345 aa, Kineococcus radiotolerans SRS30216
MTAAAPDLPTRPLGGSGLRVPVLGFGGAGVGNLYAAVPDDVAAATVRAALDAGVHYVDTAPHYGLGLSEERLGAVLRTRPRESFVLSTKVGRLLVPQPPPHGRDGIFDVPAHRRRVWDFTAAGVRRSLEESLERLGLDAVDVLLVHDADDHEDEARAGAFPELLRMREEGLVRAVGAGMNATAPLTRFVREFPLDVVLVAGRYDLLDQSALDDLLPAAAQRGTSVVLGGVFGSGVLAVDRPGDDATYRYRPAPADVLARARRLADIAREHGTTLPALALQAVLAHPVVAAAVVGVRSPQEVARNVGLLGADVPAEVWAAVRAEGLVDPRTPLPELPPEPGGADRR

SEQ ID NO: 26532 - protein, 163 aa, Kineococcus radiotolerans SRS30216
MTSPLDVPLTALTGGPLDPAQLTGRAVLVVNVASRCGSTPQYAGLQELQEEYGERGFTVLGVPCDQFGGQEPGTEEEIAEYCSATWGTTFPMTAKVEVNGPGRHPLYGALTATPDADGTAGDVAWNFEKFLVSPAGEVVARFRTRTTPQDPALRAAIEARLPA

SEQ ID NO: 26533 - protein, 155 aa, Oryza sativa (japonica cultivar-group)
GDDPSAISKDRVKGSLKVTRAFGAGFLKQPKWNDALLEMFRIDYVGSSPYISCNPSLFHHKLSTRDRFLILSSDGLYQYFTNEEAVAQVEMFIATTPEGDPAQHLVEEVLFRAANKAGMDFHELIEIPHGDRRRYHDDVSVIVISLEGRIWRSCV

SEQ ID NO: 26534 - protein, 341 aa, Fragaria x ananassa
MGLGAESGSVCVTGASGFVGSWLVMRLLEHGYTVRATVRDPANLKKVRHLLELPQAATRLTLWKADLDVEGSFDEAIKGCTGVFHVATPMDFESEDPENEVIKPTINGMLDIMKACLKAKTVRRLVFTSSAGAVAIEEHPKEVYSENNWSDVVFCRKVKMTGWMYFVSKTLAEQAAWKFAKENNIDFITIIPTLVIGPFLAPSMPPSLISGLSPLTGNEAHYGIIKQCQYVHLDDLCQSHIFLYEHPKAKGRYICSSHDATIHDIARLLNEKYPKYNVPKKFKGIEENLTNIHFSSKKLKEMGFEFKHSLEDMFTGAVDACREKGLLPLPQEEEAEKSRAG

SEQ ID NO: 26535 - protein, 224 aa, Burkholderia cepacia R18194
MLLGNGAVANVLLAKTKGKGADLIVIVMGWAMAVFVAVYVTASFSGAHLNPIVTISLALAGKFAWSKVGGYILAQMLGGMAGALLVWLAYRQHFAKEADADLKLAVFCTAPAIRSVTHNVLTEAICTFVLILGVLYLASPQVGLGALDALPVGLLVLGIGISLGGPTGYAMSPARDLSPRIMHALLPIPGKRDSDWRYAWVPVVGPLLGGAAAAGLYLRLHAMA

SEQ ID NO: 26536 - protein, 382 aa, Aspergillus flavus
MSTSAPLLSRYRQLSPTASIRVSPLCLGAMTFGVSDGEMFGECSKETAFAILDHFYQQGGNFIDTANGYRAGESEMWLGEWMASRKNRDDIVLATKYAAGYRGHEKDRIQVNYGGTGTKSMRLSVDASLQKLQTSYIDLLYVHWWDYTVSIPELMHALNDLVASGKVHYLGISDTPAWVVSKANQYARDHGLRQFVVYQGLWNAAKRDFERDILPMCRDEGMGLCPYGVLNQGRFRTEEGFRERDQANNAGGRNIIPLSEHDRNVSRVLEIVATSKGVPLLQVALAYVMQKAPYVFPIVGVRKVDHLTGVEPAVHISLTDEEVNAIENAYEFDPGFPHTFLSGSMFAQGPPKGGYSPDVVWWTKMLGTFDWVEGAKPICPHP

SEQ ID NO: 26537 - protein, 314 aa, Aspergillus flavus
METPFAAPWRQFVEDLGQTPCLEGKDLNSVLAGWGQLAGTLATRYGFPPPDESVTTEDVQLDGLWLRCYTPPNATGQEPVGLYFHGGGWVMGGVKEEDGFCRVISRQCQMRLVSVEYRKAPETRYPGALNDGVSAALWALSRYENQPLVLMGTSAGGNLAFGTALRLIDQDMADKVSGVVALAPITVHPDAVPDHLKEQYTAYEENAELTVNSRAAMQVFFDCYKAPVDDVYTSCILHPKLHALPKVYIAELGLDTLRDDARLMKGALDTAKVPVMYDAYPGYPHCSFMFPFKSLGEHQKAFLEGVAKAVRWMS

SEQ ID NO: 26538 - protein, 388 aa, Aspergillus flavus
MVLPTAPEPPTLLGYHRILSPSAGVRVSPLCLGTMSFGKGWKGVMGECDQATSFNMLDTFYESGGNFIDVANFYQGGDSERWVGEWMAQRQNRDEIVLSTKYTMGYTMFGPQMIKSNFQGNHAKSLRLSVNASLEKLQTDYIDLLYVHMWDFTTSVEEVMRSLNHLVANGKVLYLGISDTPAWLVVKCNAFARANGLTPFSVYQGHWSCAFRDFERDILPMCESEGMGLAPWGVLGRGQFRSAEDFSREGRKMGPQDEKHRRLGEKLDQMAQQKNTKATSIAQAYVMHKAPYVFPVIGGRKVEHLKENIEALGLVLSEEEIREIDDAEPFDVGFPMNFLFETPTQRYRTNMTSKDIWQLSCNTRLETVPKQQPIEPLQGAKYFGSASK

SEQ ID NO: 26539 - protein, 388 aa, Aspergillus flavus
MVLPAAPEPPTLLGYHRILSPSAGVRVSPLCLGTMSFGNGWKGVMGECDQATSFNMLDTFYESGGNFIDVANFYQGGDSERWVGEWMAQRQNRDEIVLSTKYTMGYTMFGPQKIKSNYQGNHTKSLRLSVKASLQKLQTDYIDLLYVHMWDFTTSVEEVMRSLNHLVANGKVLYLGVSDTPAWLVVKCNAFARANGLTPFSVYQGHWSCAFRDFERDILPMCESEGMGLAPWGVLGRGQFRSAEDFSREGRKMGPQDEKHRRLGEKLDQMAQQKNTKATSIAQAYVMHKAPYVFPVIGGRKVEHLKENIEALGLVLSEEEIREIDDAEPFDVGFPMNFLFETPTQSYRTNMTSKDIWQLSCNTRLETVPKQKPIEPFQGAKYFGSASK

SEQ ID NO: 26540 - protein, 382 aa, Aspergillus nomius
MSTSAPLLSRYRQLSPTASIRVSPLCLGAMTFGVSDGEMFGECSKETAFAILDHFYHQGGNFIDTANGYRAGESEMWLGEWLASRKNRDDIVLATKYAAGYRGHEKHRIQVNYGGTGTKSMRLSVDASLQKLQTSYIDLLYVHLWDYTVSIPELMHALNDLVASGKVHYLGISDTPAWVVSKANQYARDHGLRQFVVYQGLWNAANRDFERDILPMCRDEGMGLCPYGVLNQGRFRTEEEFRERDQTNNAGGRNMVPLSEHDRNVSRVLEIVAASKGVPLLQVALAYVVRKAPYVFPIVGVRKVEHLMGVEPAVHISLTDAEVNAIENAYEFDPGFPHTFLSGSMFARGTPKGGYAPDDVCWTKMLGTFDWVEGAKPIRPQP

SEQ ID NO: 26541 - protein, 314 aa, Aspergillus nomius
METPFAAPWQQFVEDLGQTPCLPGKDLKSVLTGWGQLAGTLATRYGFPPPDESVTTEDVQLDGLWLRCYTPPNATGQGPVGLYFHGGGWVMGGVKEEDGFCRIISRQCQMRLVSVEYRKAPETRYPGALNDGVRAALWALSRYGNHPLVLMGTSAGGNLAFGTALRLIDQDMAGKVGGVVALAPITVHPDAVPDHLKEQYTAYEENAELTVNSRAAMQVFFDCYNAPVDDVYTSCLLHPRLLALPKVYIAELGLDTLRDDARLMKGALDTAKVPVMYDAYPGYPHCSFMFPFQSLGEHQKAFLEAVAKAVRWMS

SEQ ID NO: 26542 - protein, 388 aa, Aspergillus nomius
MVLPAAPEPPTPLGYHRILSPSAGVRVSPLCLGTMSFGNGWKGVMGECDQAASFNMLDTFYESGGNFIDVANFYQGGDSERWVGEWMTQRQNRDEIVLSTKYTMSYTMFGPQKIKSNFQGNHAKSLRLSVKASLEKLQTDYIDLLYVHMWDFTTSVEEVMRSLNHLVANGKVLYLGVSDTPAWLVVKCNAFARANGLTPFSVYQGHWSCAFRDFERDILPMCESEGMGVAPWGVLGRGQFRSAEDFAREGRKMDPQDEKHRRLGEKLEQMAQRKNTKATSIAQAYVMHKAPYVFPVIGGRKVEHLKDNIEALRLVLSEEEIHEIDDAEPFDVGFPMNFLFETPTQRYRVNMTSKDIWQLSCNTRLETVPKQQPIGPQQGAKYFGSASK

SEQ ID NO: 26543 - protein, 388 aa, Aspergillus flavus
MVLPTAPEPPTLLGYHRILSSSAGVRVSPLCLGTMSFGNGWKGVMGECDQATSFNMLDTFYESGGNFIDVANFYQGGDSERWVGEWMAQRQNRDEIVLSTKYTMGYTMFGPQKIKSNYQGNHTKSLRLSVKASLQKLQTDYIDLLYVHMWDFTTSVEEVMRSLNHLVANGKVLYLGVSDTPAWLVVKCNAFARANGLTPFSVYQGHWSCAFRDFERDILPMCESEGMGLAPWGVLGRGQFRSAEDFSREGRKMGPQDEKHRRLGEKLDQMAQQKNTKATSIAQAYVMHKAPYVFPVIGGRKVEHLKENIEALGLVLSEEEIREIDDAEPFDVGFPMNFLFETPTQSYRTNMTSKDIWQLSCNTRLETVPKQQPIEPFQGAKYFGSASK

SEQ ID NO: 26544 - protein, 314 aa, Aspergillus flavus
MGTPFAAPWHQFVEDLGQTPCLPGKDLDSILAGWGQLAGTLATRYGFPPPDESVTTEDVQLDGLWLRCYTPPNATGQEPVGLYFHGGGWVMGGVNEEDGFCRVISRQCQMRLVSVEYRKAPETRYPGALNDGVSAALWALSRYENQPLILMGTSAGGNLAFGTALRLIDQDMADKVSGVVALAPITVHPDAVPEHLKEQYTAYEENAELTVNSRAAMQVFFDCYKAPVDDVYTSCLLHPRLLALPKVYIAELGLDTLRDDARLMKGALDTAKVPVMYDAYPGYPHCSFMFPFKSLGEHQRTFFGGVAKAVRWMS

SEQ ID NO: 26545 - protein, 314 aa, Aspergillus flavus
METPFAAPWHQFVEDLGQTPCLPGKDLDSILAGWGQLAGTLATRYGFPPPDESVTTEDVQLDGLWLRCYTPPNATGQEPVGLYFHGGGWVMGGVNEEDGFCRVISRQCQMRLVSVEYRKAPETRYPGALNDGVSAALWALSRYENQPLILMGTSAGGNLAFGTALRLIDQDMADKVSGVVALAPITVHPDAVPEHLKEQYTAYEENAELTVNSRAAMQVFFDCYKAPVDDVYTSCLLHPRLLALPKVYIAELGLDTLRDDARLMKGALDTAKVPVMYDAYPGYPHCSFMFPFKSLGEHQRTFFGGVAKAVRWMS

SEQ ID NO: 26546 - protein, 493 aa, Aspergillus flavus
MPEFKLLAGHFGTLKKTIQGMPSDATLHSIMLKISKQFQSGIFYINMWPFSGTWMIVSTPSAATQIQKLNLTKPAILRQPLETVTGGPSMMTMHGETWKKWRALFNPGFNPAYIIGLAPNISDEVAIFCAQLRKIAQQGEVFPLESLTTRLTVDSICSVVLDTQLHHQIKDHPLATALQRQIDWTSFGTTFNPFKRYLTIRPLVLWYNNKVMDRIIDGEVDRAYCTPPGHPSKSVISLALREYLQEQASSNSTRSLAEFKRLVAPQLRVFLFAGRNTTSSTLIYTYYLLAQHPEVLAKIRAEHEDVLGADPAEAQGRIKEDVQLLNKLPYTTAVIKETLRLFPPSASMREGRPDAEIIGADGQRYPTVGCNVWTLTVALHHNSDHWNQVESFIPERWLVGPEDPLYPVKGAWRAFEFGPRSCIGQTLAMLELRIALAMTIRQFDITPAYDEWDSIHPATTSKEVNGHRAYQAERGAGGAHPADGFPCRVKERF

SEQ ID NO: 26547 - protein, 497 aa, Ammi majus
MDVIIIVLSVMLAYVLVKHLLLSRDRGKNLPPGPFQLPIIGNLTNLGKLPHRSLAKLSQNYGPIMHLQLGRVTTIVISSSAIAQQVFQKKGRAFSRRFIPDSLCACDHSLYSFVWLPIGPQWRNLRKISNSNLFSANKLDANQHLRGRKVNELIAYVQKCSQTGDAVDIGRAAFRTSFNLLSNTVFSKDMVDPYQDSAQEFKDLAWNIMVEAGSPNLVDYFPVLKKMDPQGVKRRMTGYFQKVIKMLDGLINERLALKGSGTTVDKTDMLDELINISQVNPNEMDKILMEHLFVDIFVAGTDTTSNTVEWGMAEILRSTETMMKVKAELRHLVGKGVILEEGDIYRLPFLQCIVRETLRLHPPFPLLLPRQTEEETELNGYTIPKNSQVLVNAWAIGRDPVSWKNPSSFRPERFLDSEVDVKGQDFELIPFGAGIRICPGLPLVMRMVPVMLGSLINCFDWELEGGIPLNELDMEEKCGLSVAKLHPLRVLATSQVV

SEQ ID NO: 26548 - protein, 185 aa, Chlamydia trachomatis
SERIALLADKDSWNPLFSDLRSQDPLNFVDTDTYPNRLEKARKDNTDSEGVLVGVCTIGSHPVALAVMDFSFMAGSMGAVVGEKLTRLIEKAIDSRLPVIIVSASGGARMQESVFSLMQMAKTSAALAKLHEAKLPYISVLTNPTSGGVTASFASLGDVIIAEPKALICFAGPRVVSQVIGEDLP

SEQ ID NO: 26549 - protein, 185 aa, Chlamydia trachomatis
SERIALLADKDSWNPLFSDLRSQDPLNFVDTDTYPNRLEKARKDNPDSEGVLVGVCTIGSHPVALAVMDFSFMAGSMGAVVGEKLTRLIEKAIDSRLPVIIVSASGGARMQESVFSLMQMAKTSAALAKLHEAKLPYISVLTNPTSGGVTASFASLGDVIIAEPKALICFAGPRVVSQVIGEDLP

SEQ ID NO: 26550 - protein, 185 aa, Chlamydia trachomatis
SERIALLADKDSWNPLFSDLRSQDPLNFVDTDTYPNRLEKARKDNPDSEGVLVGACTIGSYPVALAVMDFSFMAGSMGAVVGEKLTRLIEKAIDSRLPVIIVSASGGARMQESVFSLMQMAKTSAALAKLHEAKLPYISVLTNPTSGGVTASFASLGDVIIAEPKALICFAGPRVVSQVIGEDLP

SEQ ID NO: 26551 - protein, 411 aa, Chlamydomonas reinhardtii
MQIGFVSAESGQGRAKNVRNILLKNSVNIMLCAICWWAVGYAFAYGNSGGGFIGTSRFFSDGESFGSKPWFFTWTFCLSCVTIASGCLAERTHLFVYPVYTAVVSIAVHPVIAHWVWAPDSWLNSMTGSPCRFLDFAGGAVVHTVGGLTGLIGAMLCGPRLGRFEDGVGKDIPGHDVSSVSLGSLMLWFGWYGFNCGSTYIYMAQGGSEASAAVSRVALNMTLCASVAGMTSLVVSSIQTGTFDLAVCCNGLMAGLSASTSNVGFLTPWAACITGALAGLLYVGISRLLVRMGVDDPLDSSAIHCGSGILGVLVSGFLARPSYVMQMVGCNCGGVVYATNGGMQLGMQLLGLSCSMVWTAMWALLTFGILKKLQLLRVDQQTELAGIDNMEHGGPAYPEFLQRVQSTRPGY

SEQ ID NO: 26552 - protein, 391 aa, Corynebacterium crenatum
MSTLETWPQVIINTYGTPPVELVSGKGATVTDEQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLRAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVTRKGELFKELLAKVDGVVDVRGRGLMLGMVLERDVAKQAVLDGFKHGVILNAPADNIIRLTPPLVITDEEIADAVKAIAETIA

SEQ ID NO: 26553 - protein, 452 aa, Gallibacterium anatis
SLLDYIRKAKVAAGEAGGITQHIGAYHVHTPNGDITFLDTPGHAAFTSMRARGAQATDIVVLVVAADDGVMPQTIEAIQHAKAANVPLVVAVNKIDKPEADPDRVKTELSQYGVISEDWGGDTQFVNVSAKKGIGIDELLDAILLQAEVLELKAVKDGMATGVVIESYLDKGRGPVATVLVQSGTLNRGDTVLCGLEYGRVRAMRNEIGKEVKSAGPSIPVEILGLSGVPSAGDEMTVVRDEKKAREVALYRQGKFREVKLARQQKAKLENMFSSMTEGDVSELNIIVKADVQGSVEAICQALLELSTDEVKVKIVGSGVGGITETDATLAAASNAIIVGFNVRADASARKVVEAENLDLRYYSVIYDLINEIKAALSGMLQPEFKQEIIGLAEVRDVFRSPKFGAIAGCMVIEGVVKRHNPIRVLRDNVVIYEGELESLRRFKDDVTEVRN

SEQ ID NO: 26554 - protein, 452 aa, Pasteurella multocida subsp. multocida
SLLDYIRKAKVASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYLDKGRGPVATILVQTGTLHRGDIVLCGFEYGRVRAMRNENGKDVASAGPSIPVEVLGLSGVPAAGDEATVVRDEKKAREVALYRQGKFREVKLARQQKAKLENMFTNMAEGDVAELNVIVKADVQGSVEAICQSLNELSTAEVKVKVVGSGVGGITETDATLAAASNAIVLGFNVRADASARRIIESESIDLRYYSIIYELLNEIKAAMSGMLQPEFKQEIIGLAEVRDVFRHPKFGAIAGCMVTEGIVKRNNPIRVLRDNVVIFEGELESLRRFKDDVAEVRN

SEQ ID NO: 26555 - protein, 453 aa, Volucribacter psittacicida
SLLDYIRKAKVAAGEAGGITQHIGAYHVETDDGKMITFLDTPGHAAFTSMRARGAKATDIVVLVVAADDGVMPQTIEAIQHAKAAGVPIVVAVNKIDKPEANPERVETELLQHDVVAEKFGGDTQFVYVSAKKGTGVDDLLEAILLQSEVLELTAVKEGMASGVVIESYLDKGRGPVATILVQSGTLNRGDIVLCGFEYGRVRAMRDENGKDIQSAGPSIPVEVLGLSGVPAAGDEATVVRDEKKAREVALYRQGKFREVKLARQQKAKLENMFNNMTEGDVAELNVIVKADVQGSVEAIVQALQELSTSEVKVSVVGSGVGGITETDATLAAASNAIILGFNVRADASARRVIENENIDLRYYSIIYELLNEIKAAMSGMLAPEFKQEIIGLAEVRDVFRSPKFGAIAGCMVTEGVIKRNNPIRVLRDNVVIFEGELESLRRFKDDVNEVRS

SEQ ID NO: 26556 - protein, 452 aa, Lonepinella koalarum
LFLDYIRKAKVAAGEAGGITQHIGAYHVETKGKVITFLDTPGHAAFTSMRARGAKATDIVVLVVAADDGVMPQTIEAIQHARAAGVPIVVAVNKIDKPEANPERVEQELLQYEVVAEKFGGDVQFVYVSAKKGTGVDELLDSILLQSEVLELTAIKDGMASGVVIESYLDKGRGPVATILVQSGTLNRGDIVLCGFEYGRVRAMRDENGKEIDSAGPSIPVEVLGLSGVPAAGDEATVVRDEKKAREVALYRQGKFRDVKLARQQKAKLENMFSNMAEGDLAELNVIVKADVQGSVEAIVQSLQELSTDEVKVKVVGSGVGGITETDATLAAASNAIMVGFNVRADASARRIIENEHIDLRYYSIIYELLNEIKAAMSGMLQPEFKQEIIGLAEVREVFRHPKFGAIAGCMVTEGVVKRNNPIRVLRNNVVIFEGELESLRRFKDDVSEVRN

SEQ ID NO: 26557 - protein, 453 aa, Mannheimia haemolytica
SLLDYIRKAKVAAGEAGGITQHIGAYHVETDDGKMITFLDTPGHAAFTSMRARGAKATDIVVLVVAADDGVMPQTIEAIQHAKAAGAPLVVAVNKIDKPEANPDRVEQELLQHEVISEKFGGDVQFVPVSAKKGMGIDDLLEAIILQSEVLELTAVKDGMASGVVIESYLDKGRGPVATILVQSGTLNKGDIVLCGFEYGRVRAMRDENGKDVESAGPSIPVEVLGLSGVPAAGDEATVVRDEKKAREVALYRQGKFREVKLARQQKAKLENMFSNMAAGDVAELNIIVKADVQGSVEAISQSLMELSTDEVKVKIVGSGVGGITETDATLAAASNAIMVGFNVRADASARRVIENENIDLRYYSIIYELLNDVKAAMSGMLQPEFKQEIIGLAEVRDVFRHPKFGAIAGCMVTEGIVKRNNPIRVLRDNVVIFEGELESLRRFKDDVSEVRN

SEQ ID NO: 26558 - protein, 453 aa, Histophilus somni
SLLDYIRKAKVAAGEAGGITQHIGAYHVETNDGKMITFLDTPGHAAFTSMRARGAKATDIVVLVVAADDGVMPQTIEAIQHAKAANAPLVVAVNKIDKPEANPDRVEQELLQHEVISEKFGGDVQFVPVSAKKGLGIDDLLEAILLQSEVLELTAVKDGMASGVVIESYLDKGRGPVATILVQSGTLNRGDIVLCGFEYGRVRAMRDENGKDIQSAGPSIPVEVLGLSGVPAAGDEATVVRDEKKAREVALYRQGKFREVKLARQQKAKLENMFSNMAEGDVAELNVIVKADVQGSVEAIVQALHELSTAEVKVKVVGSGVGGITETDATLAAASNAIMVGFNVRADATARRVIENENIDLRYYSIIYELLNEIKAAMSGMLQPEFKQEIIGLAEVRDVFRHPKFGAIAGCMVTEGLVKRNNPIRVLRDNVVIFEGELESLRRFKDDVSEVRS

SEQ ID NO: 26559 - protein, 158 aa, Phocoenobacter uteri
SLLDYIRKAKVAAGEAGGITQHIGAYHVETDDGKMVTFLDTPGHAAFTSMRARGAKSTDIVILVVAADDGVMPQTIEAIQHARAAEVPLVVAVNKVDKPEANPDRVEQELLQYEVVSEKFGGDIQFVHVSAKQGTGVDELLDAILLQSEVLELTAVKE

SEQ ID NO: 26560 - protein, 453 aa, Actinobacillus genomosp. 1
SLLDYIRKAKVAAGEAGGITQHIGAYHVETDDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKDGMASGVVIESYLDKGRGPVATILVQSGTLNKGDIILCGFEYGRVRAMRDENGKEVDSAGPSIPVEVLGLSGVPAAGDEATVVRDEKKAREVALFRQGKFREVKLARQQKAKLENMFSNMTAGDVAELNVIVKADVQGSVEAICQSLAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26561 - protein, 453 aa, Actinobacillus pleuropneumoniae
SLLDYIRKAKVAAGEAGGITQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKEGMASGVVIESYLDKGRGPVATILVQSGTLNKGDIVLCGFEYGRVRAMRDENGKEVDSAGPSIPVEVLGLSGVPAAGDEATVVRDEKKAREVALFRQGKFREVKLARQQKAKLENMFSNMTAGDVAELNVIVKADVQGSVEAICQSLAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26562 - protein, 453 aa, Actinobacillus lignieresii
SLLDYIRKAKVAAGEAGGITQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKEGMASGVVIESYLDKGRGPVATILVQSGTLNKGDIVLCGFEYGRVRAMRDENGKEVDSAGPSIPVEVLGLSGVPAAGDEAPVVRDEKKAREVALFRQGKFREVKLARQQKAKLENMFSNMTAGDVAELNVIVKADVQGSVEAICQSLAELSTDEVKVKVVGSGVGGITETDATLAAASNAIIVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26563 - protein, 453 aa, Actinobacillus genomosp. 2
SLLDYIRKAKVAAGEAGGITQHIGAYHVETEDGKMITFLDTPGHAAFTSMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKDGMASGVVIESYLDKGRGPVATILVQSGTLNKGDIVLCGFEYGRVRAMRDENGKEVDSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26564 - protein, 453 aa, Actinobacillus arthritidis
SLLDYIRKAKVAAGEAGGITQHIGAYHVETEDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDELLEAILLQSEVLELTAVKEGMASGVVIESYLDKGRGPVATILVQSGTLNKGDIVLCGFEYGRVRAMRDENGKEVDSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26565 - protein, 453 aa, Actinobacillus capsulatus
SLLDYIRKAKVAAGEAGGITQHIGAYHVETDDGKMITFLDTPGHAAFTSMRARGAKVTDIVVLVVAADDGVMPQTIEAIQHAKAAGAPIVVAVNKIDKPEANPDRVEQELLQHEVISEKFGGDVQFVPVSAKKGMGIDDLLEAIILQSEVLELTAVKDGMASGVVIESYLDKGRGPVATILVQSGTLNKGDIVLCGFEYGRVRAMRDENGKDINSAGPSIPVEVLGLSGVPAAGDEATVVRDEKKAREVALFRQGKFREVKLARQQKAKLENMFSNMTAGDIAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMITEGVVKRNNPIRVLRDNVVIFEGELESLRRFKDDVSEVRN

SEQ ID NO: 26566 - protein, 453 aa, Actinobacillus hominis
SLLDYIRKAQVAAGEAGGITQHIGAYHVETDDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDDLLEAILLQSEVLELTAVKEGMASGVVIESYLDKGRGPVATILVQSGTLNKGDIVLCGFEYGRVRAMRDENGKDINSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26567 - protein, 453 aa, Actinobacillus suis
SLLDYIRKAKVAAGEAGGITQHIGAYHVETDDGKMITFLDTPGHAAFTSMRARGAKATDIVVLVVAADDGVMPQTIEAIQHAKAAGAPIVVAVNKIDKPEANPDLVEQELLQHEVISEKFGGDVQFVPVSAKKGLGIDELLEAILLQSEVLELTAVKEGMASGVVIESYLDKGRGPVATILVQSGTLNKGDIVLCGFEYGRVRAMRDENGKDINSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26568 - protein, 447 aa, Actinobacillus equuli subsp. haemolyticus
SLLDYIRKAKVAAGEAGGITQHIGAYHVETDDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDELLEAILLQSEVLELTAVKEGMASGVVIESYLDKGRGPVATILVQSGTLNKGDIVLCGFEYGRVRAMRDENGKDINSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRSKTT

SEQ ID NO: 26569 - protein, 453 aa, Actinobacillus equuli subsp. equuli
SLLDYIRKAKVAAGEAGGITQHIGAYHVETDDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDELLEAILLQSEVLELTAVKEGMASGVVIESYLDKGRGPVATILVQSGTLNKGDIVLCGFEYGRVRAMRDENGKDINSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARRVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26570 - protein, 453 aa, Actinobacillus ureae
SLLDYIRKAKVAAGEAGGITQHIGAYHVETDDGKMITFLDTPGHAAFTSMRARGAKATDIVVLVVAADDGVMPQTIEAIQHAKAAGAPIVVAVNKIDKPEANPDRVEQELLQHEVISEKFGGDVQFVPVSAKKGLGIDELLEAILLQSEVLELTAVKEGMASGVVIESYLDKGRGSVATILVQSGTLNKGDIVLCGLEYGRVRAMRDENGKDINSAGPSIPVEVLGLSGVPAAGDEATVVRDEKKAREVALFRQGKFREVKLARQQKAKLENMFSNMTAGDVAELNVIVKADVQGSVEAICQALAELSTDEVKVKVVGSGVGGITETDATLAAASNAIMVGFNVRADASARCVIEAENIDLRYYSIIYELLNEIKAAMSGMLQPEFKQEIIGLAEVRDVFRHPKFGAIAGCMVTEGVVKRNNPIRVLRDNVVIFEGELESLRRFKDDVSEVRN

SEQ ID NO: 26571 - protein, 465 aa, Mesorhizobium sp. BNC1
MIGAGSGGLTVAAAAASLGASVVLIERGKMGGDCLNYGCVPSKALIASARQAHRLSHGGSLGIAAVEPSIDFARVAGHIEQAIAAIAPNDSKERFTALGVEVISAQGHFKDPRTVVAGGSEIRARRFVIATGSSPAIPPIPGLSDVPFLTNETTFGLKQSPAHLIIVGGGPIGMERAQAHRRLGADVTVLEADTVLGKEDPELALGVKQALLKEGVAILEHARAERVERYKGTGIRVHVADEKGAHSIDGSHLLIATGRRPNVEALALENAGVAYGPGGITISPKLRTTNRRIFAIGDVAGGPQFTHVANYHAGLVIRAILFRLPVKANHEHIPRVTFTDPELAQIGLTENEARRRGLQVKVLRSSFSENDRAHAEGHTDGFIKLIVGRRGRILGVSILGRGAGEMMHFWSLALSRRMRVHDISQYVAPYPTLGEIGKRAALSYFAEAARSSSVRGILGFLRLFG

SEQ ID NO: 26572 - protein, 192 aa, Pirellula sp.
MRIVFIGPPGAGKGTQCELLSKALKVPHIGTGGMLRALEPESGEQIHLRIDRGHFAPDDFVLQMVAERLSQPDSRTGYLLDGFPRTQVQASAFDKQLVAASLKLDHVLHLQVSADVLIERLRKRGETENRADDSEEFIRERFRIYEDRTAPLLDHYRCQGLVRDIDASDSESLVHASICECLNFTLASPAES

SEQ ID NO: 26573 - protein, 377 aa, Vibrio vulnificus YJ016
MKILVDENMPYAEMLFSQLGEVILKPGRSLTADDLVDIDALMIRSVTKVNAALISKASKLKFVGTATAGMDHVDQALLKEKGIYFTAAPGCNKVGVAEYVFSVMMVLAQQQGFSVFEQTVGIVGAGQVGSYLQQCLQGIGIKVLINDPFKQEEGDEREFTSLDRLLQEADVITLHTPITRDGKYPTHHLINKEILNSLRADQILINAARGPVVDNQALKHRLQQADGFTAALDVFEFEPEVDMELLPLLAFATPHVAGYGLEGKARGTTMIFNSYCEFIGNELRAHASDLLPTAPVPKVVLDRKWDEATLHTLTQMVYDVRRDDAQFRREIGAPGAFDLMRKEYWDRREYSAVTLVGSAQCRLKPLAKLGFQVEVSQ

SEQ ID NO: 26574 - protein, 378 aa, Wigglesworthia glossinidia endosymbiont of Glossina brevipalpis
MKILIDNNIIFSYSLFKKIGKVNLINSIDINAKNISGFDALIIKSSTNVNENLLKNSNIKFIGSATSGKDHVDVDWLKKNKINFDFAPGCNSVAVAEYVFSSMLYFAYRDKFSLLKKTVGIVGFGNIGKCLNKKLSAIGVKTILCDPILEEKNNIKLKSLNEIVQNSDIITLHVPLTYSGKYPTWHLINKKILLDLKDNCILINTSRGSVIDNNSLLNILKEGKPIRVVLDVWENEPLICSKLLSLIDIGTPHIAGHSLEGKIKGTISIFNSLCNFVGKKNKKYFISSFIDPYEIEYISMKGRIDQSKIYLLSLLSNNILYDDHELRKNFNKKNCFVNLRNSYRKRREWSSLFIKSNNILFSNLLNKIGFNSKFFKEK

SEQ ID NO: 26575 - protein, 377 aa, Vibrio vulnificus
MKILVDENMPYAETLFSQLGEVILKPGRSLTADDLVDIDALMIRSVTKVNAALISKANKLKFVGTATAGMDHVDQALLKEKGIYFTAAPGCNKVGVAEYVFSVMMVLAQQQGFSVFEQTVGIIGAGQVGSYLQQCLQGIGIKVLINDPFKQEEGDEREFTSLDRLLQEADVITLHTPITRDGKYPTHHLINEEILNSLRADQILINAARGPVVDNQALKRRLQQADGFMAALDVFEFEPEVDMELLPLLAFATPHVAGYGLEGKARGTTMIFNSYCEFIGNELRAHASDLLPTAPVPKVVLDRKWDEATLHTLTQLVYDVRRDDAQFRREIGAPGAFDLMRKEYWDRREYSAVTLVGSAQCRLKPLAKLGFQVEVSQ

SEQ ID NO: 26576 - protein, 381 aa, Vibrio cholerae
MKILIDENMPYAQALFSQLGEVILKPGRTLTADDLIDVDALMIRSVTKVNDALLAKANRLKFVGTATAGMDHVDQALLRERGIFFTAAPGCNKVGVAEYVFSVLMVLAQQQGFSVFDKTVGIIGAGQVGSYLAKCLSGIGMKVLLNDPPKQAQGDEREFTELETLLKQADVITLHTPITRGGEWPTHHLIDAAILEQLRSDQILINAARGPVVDNAALKARLQQGDGFTAVLDVFEFEPQVDMELLPLLAFATPHIAGYGLEGKARGTTMIFNSYCEFLGSAHCANPASLLPKAPVPKVYLERAWDEETLRTLTQIIYDVRKDDAQFRREIHQPGAFDLMRKHYWDRREYSAVTLAGGADCHLAPLAKLGFQVEVCDEPTI

SEQ ID NO: 26577 - protein, 340 aa, Schizosaccharomyces pombe
MKQSRTKRVLAIGELKFATNTLKRLSEKYHFEFIVPDPHDRSKTIEKIHEAASKSTFDACFWLFRNAAISPFTEEMLGPLLPTCKLFVTGAAGYNNVDVDWATRNGVYVANTPNGPTEGTANMNLMLFMCTLRGAREAEQSLRLGKWRQNLSLTDDPYGKRVGIIGMGAIGKSFAQKILPLGCEIVYHNRNRLEAEEEKRLGASFVSFDELLSSSDVISINCPLTPATHDLISTKEFEKMKDGVYIINTARGAIINEDAFIKAIKSGKVARAGLDVFLNEPTPNKFWLECDKVTIQPHCGVYTNFTVAKTEECVLASIETFLDTGIPTNPVNGPFGMNGC

SEQ ID NO: 26578 - protein, 396 aa, Arabidopsis thaliana
MEAKIVKVLDSSRCEDGFGKKRKRAASYAAYVTGVSCAKLQNVPPPNGQCQIPDKRRRLEGENKLSAYENRSGKALVRYYTYFKKTGIAKRVMMYENGEWNDLPEHVICAIQNELEEKSAAIEFKLCGHSFILDFLHMQRLDMETGAKTPLAWIDNAGKCFFPEIYESDERTNYCHHKCVEDPKQNAPHDIKLRLEIDVNGGETPRLNLEECSDESGDNMMDDVPLAQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFRYLPRIHLFFSCLDRIFYLPLQ

SEQ ID NO: 26579 - protein, 397 aa, Arabidopsis thaliana
MEAKIVKVLDSSRCEDGFGKKRKRAASYAAYVTGVSCAKLQNVPPPNGQCQIPDKRRRLEGENKLSAYENRSGKALVRYYTYFKKTGIAKRVMMYENGEWNDLPEHVICAIQNELEEKSAAIEFKLCGHSFILDFLHMQRLDMETGAKTPLAWIDNAGKCFFPEIYESDERTNYCHHKCVEDPKQNAPHDIKLRLEIDVNGGETPRLNLEECSDESGDNMMDDVPLAQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFRYLPLLDTVMLTKTEYVTWFYAV

SEQ ID NO: 26580 - protein, 1215 aa, Parachlamydia sp. UWE25
MIENALFQIHSVKGKKLSLQERQDLAISLAAKMLKEAQYIQTKVEKRQQAELAGMMNDSVGKIFTTVLTDQCFRSLQNSRVADQLAQVIHKYGIPIYLSDKKRLALKAFSLVGKILSSLAVPITIRLIQKETRHIILPGEPQAFAKHMKKRCQEGVRINLNHLGEAILGEDEARRRLQIYLDDLANPLIEYISIKISTIYSQIHLLAWEETLEILSERLRLLYRAAIKNKYRRATGEVISKFVNLDMEEYRDLNLTVALFKKVLDEPEFFQYQGGIVLQSYLPDSFLIQQELTQWAMQRVNRMGAPIKIRLVKGANLAMEQFESAVRLWPQAPYTTKADVDANYKRMVTYGCEFQRAQAAHLGIASHNLFDIAYALLLRSENHVEKEVCFEMLEGMADHIRRVVQTLADDMLLYCPTATKEEFQSAVAYLVRRLDENTAPENFLRHAFDLRPGTDDWNNQVHLFKQACQNYEQVSDQPRRLQNRLHKDRLLNQRKCFQNVADTDWSLSHNRQWAKIIIDQWKNKKHPDVPLVINGFHYTSENRWGIGEDPSFPGKILYRYALASKEQVDEALDAAQNAYLKWSATTSQERANLLIKIAQGLELHRADLIGAMIADTAKTLIEADIEVSEAIDFANYYRFNLLEWMYLEDVKWSAKGVVVIAPPWNFPCSIAAGGILAALVTGNTVILKPAFESVLVCWHLAQIFWEAGISQQVLQFVVCEDEPVGSALIQDSRVNAVVLTGATETAKLFLRLRADLDLMAETGGKNTMIITSMADRDLAIKDLVQSAFSHAGQKCSACSLAIVEAETYDNLHFRQQLKDSVESLSIGSPWKLKSKVNPLIREANPNLLRGLTQLEEGEEWLVQPKQDPQNPYLWSPGIKLGVKPGNFTYNTELFGPVLGLVRAENFDEALHMMNQTGYGLTAGIHTLDEREQKQWFQKIEAGNCYINRTMTGAIVERQPFGGCKESSFGKGSKAGGPNYLVQFMQTSQKNLPTEQKELKEMPLAFLKNVQRLKYLSSEEYEIFSLSMKNYAFYYDLYFSRSHDPSLVRGQDNLQTYRPHNQISVRVQSPDRLVDLLRLIAASIICSTPLMLSTDNQETYQKFQSLRLPPFISFKLEAESTFIERLERGEIKRMRVLSPFSKSLENTLANAACHLNRGEVMANGRLELLHFLREVSLSFDYHRYGNLAEREKEYRHPLPGHKGKTCLPCGACCCDG

SEQ ID NO: 26581 - protein, 499 aa, Parachlamydia sp. UWE25
MQVLSAQAVSELEKSAIKQGFSALDFMEKAGYGIALAIKEFILKHPLINHIVLLCGKGNNGGDAYVAGCYLLNYGYSVSSIQLESLENCSELCKKNALRFENLGGTISQQIQFDSNQLLIDGLFGTGFKGKIQELYTKLIEKANQSHAPILSIDIPSGLNGSTGEINGLAIRANETICLGFPKTGFFLQQGWNVVGQLKFVDFGLPLNVFSKENASFVLLTKSFIKNLLPKLVRNRHKYQAGYVMGLAGSRSMPGAALLSSLAALRAGSGMVHLLYPEDMRCELNNSPYELIKTPYALGDTQKVLQELQKAKAIFVGPGLGLTQPIDHLLRSCLPHLNASCVLDADALTLYTKTPFLLPKRTIFTPHTGEMQKLLQETSHLILNENILKKCQQYAEQHDITLILKGAPTFIFHPNQPIYVNPTGNCGMATAGSGDVLTGIIASFLSQGLESHQAALLGVFLHGLAGDIAKSKRLTERGMIASDLIDHLNLAYHALEQSV

SEQ ID NO: 26582 - protein, 434 aa, Parachlamydia sp. UWE25
MSYIRSVKGREILDSRGNPTVEVELITDQNVMVKASVPSGASTGENEALELRDGDLNYYFGKGVLKAIANINGPIAQILVGEQVYDQERLDRMLIEADGTDNKGHFGANAILGVSLALARAGALTANLPLYRYIGGVHAHLLPCPMMNIINGGAHADNSLDFQEFMIRPVGASTLREAVRWGAEIFHTLKGILKKAGHVTAVGDEGGFAPNLSSNEEALELILLAIEKAGYQPGKQVVLAMDCAASEFYDKTTKQYFEKKKKQKNQVFAERTAEEQIAYLETLCQNYPIDSIEDALAEGDWCGWQRLTERLGRKIQIVGDDIFVTNPKFLEKGIELGVGNAILVKINQIGTLTETLQTIRLAQTNNYACIISHRSGETEDSIIADISVAANTGQIKTGSLSRSDRIAKYNRLLAIEAELESTALYQDSNRFQIF

SEQ ID NO: 26583 - protein, 469 aa, Parachlamydia sp. UWE25
MMEIKKFDVAVLGGGPGGYPAAIRAAQRGKSVALIEAKELGGTCLNRGCIPSKALIAGAEVVDRIHEAKEFGIHVGEVNIDYAQLAFHKDRVIERMRKGLEGLMATNKITVFKGFGQFISPREIKIKGQDNTSITADQIIIATGSEPRNISAFPFDYERIHDSTSLLAMKTLPEKLIIVGGGVIGCEFASLYATLGVHVTILELLPRLISSEAIEVSQALTKAFIKRGIQVETGVKVQKIEQVEMGIQVQVEEGKHYVADCCLVAVGRSLNTKNIGLDKAGILVQENGMIAVNDKMQTNVDGIYAVGDIASKWWLAHVASHQGLIAADQICGKSSRMYYHAIPSVIFTHPEIATVGLSLEEATKRGYKAKLASFPFQALGKSQAALQAEGFAQIVVEEKSGQILGAQVVGYEASVMIAEMTLAIANELTVECVAETIHAHPTLPEAWLESALLGEGLPLHLPPKTQKKG

SEQ ID NO: 26584 - protein, 226 aa, Parachlamydia sp. UWE25
MVKLILMRHGQSQWNLANLFTGWVDIPLSFKGIEEAIEAGKQIKNYPIDLIFTSSLIRAQMTAMLAMSVHTSGKVPVILHTGEGRLEEWASIYSSESQSQTIPVIRAWELNERMYGELQGINKEEMAKKYGAEQVHIWRRSFDVPPPNGESLQMTAARTIPYFENTIVPHLKEKKNIFIAAHGNSLRSIIMKLDGLTTDQVVKLELATGVPVIYDFNHDEYIKQQK

SEQ ID NO: 26585 - protein, 384 aa, Parachlamydia sp. UWE25
MNYSTYNKQNPFLATIRNRYQLSKSGSQKNTQHLVLDLRGSQLTYEAGDSIGVYPKHDPELINKTLIAARASGEEYIQSKQTGETISLRDFFSKQGNITDVSQKLLKELYNRQTNLDKKHQLELLLDENNRVALKAYLALHEVWDLLLFHVEVHFTPQELADLLMPLLPRFYSISSSQKYVGEEVHLTIAHLEYETNGHKRRGVCTHYLCELVKLHNPEVPVFIQPSHSFRLPEDLHAPLVMVGPGTGVAPFRAFLQERVLHHQTKGKHWLFFGERNRSSDFFYEEDWRLFEQHGHLRLDAVFSRDQEEKVYVQHKMFEHGEELFKWLEEGAYLFVCGDAERMAKDVEITLLAIIQEFGKKDFQEAREYVKRLRQQKKYLRDVY

SEQ ID NO: 26586 - protein, 402 aa, Parachlamydia sp. UWE25
MRVKDKLSIRDLNLKDKKALIRVDFNVPLEKGLITDDSRIQASLPTIQYVLDQEGAVILMSHLGRPKGLFDSKFSLAPCAKRLSELLNKPVKMAADCCGLDVEQMVRQLKSGEVLLLENLRFHKGEERPDDEPNFTSALSELGDVYINDAFGTAHRAHASTTKIAKFFPNRAAAGLLLEKEISYLGCALTNPKRPFCAVLGGAKISTKFKVIEALQSKADVLLIGGAMAFTFFKSEGIPIGDSLYESEFVAVARELLGVETQSRCRLLLPIDLVIAKKMDESFTETRIISVKEGIPDGYQGVDIGPDTIKLYQEELNRAATIFWNGPLGVFEVPAFSKGTQTIAQTLAVVNAITIVGGGDSLAAIEQAGVSKQINHLSTGGGASLEYIEFGQLPGIEALSDK

SEQ ID NO: 26587 - protein, 456 aa, Parachlamydia sp. UWE25
MAKQKTVWYCSECGHKQLKWLGQCPSCTNWNTFQEELELSSLPKRFESQTAITTRPIKLKEVKLQETPRIQTKIGECDRLLGGGLVPGSLTLVGGDPGIGKSTLMLQLSYALAKQGLIVLYICGEESVDQTSLRANRLGIQTDNLFLLSETNFSLIKSQIDQLNPDVLIVDSIQIVYKSEITSAPGSVTQVRETTTEFMHLAKGRGISTFLIGHVTKSGEIAGPRVLEHLVDTVLYFEGDKQHHYRMIRVVKNRFGPTDEIAVFQMKQSGLVEVPNPSEIFLEERRKDSIGSVIIPTLEGSRPILIEVQALVTQTVFSTPSRRCTGLDQNRLALLLAVLEKRMGYQLHKCDVFVSVAGGLRIIEPAIDLGLLLASASSMRNSIIDPETTVVGEVGLGGEIRSVSRIESRLKEAIHMGFRRCIIPKRNAKGIAEDILRKIVVQGVEFVEEAIDALLK

SEQ ID NO: 26588 - protein, 484 aa, Parachlamydia sp. UWE25
MHMTQADIGLIGLAVMGQNLVLNMNDHGYTVAVYNRTTSKVDEFLDGPAKGTKVIGAHSLKDLISQLKRPRRVMLMVKAGEPVDNFIEQCLPYLEKGDILIDGGNSLFTDTNRRCNSLKEKGIIFIGTGISGGEEGARHGPSIMPGGNPEGWPHIKEIFQSISAKVEGEPCCDWVGDQGAGHYVKMVHNGIEYGDMQLISEAYYLLKEALHLNQNELYQVFADWNKGDLDSYLIEITSKIFKVNDEDGKPLVDKILDVAGQKGTGKWTVINALDLGMPLTLIGEAVFARCLSALKDERVAASELLKGPDAKFEGNREEFIQAIREALYSSKIISYTQGFMLMQQAAAEYKWQLNYGAIALMWRGGCIIRSQFLGKIKEAFKLNPNLKSLLLDEYFLQEIQKRQKGWRKVVSKSVELGIATPCFNTALVFYDGYRTAKLPANLLQAQRDFFGAHTYERGDRARGQYFHTDWSGTGGKVSSGSYNA

SEQ ID NO: 26589 - protein, 290 aa, Parachlamydia sp. UWE25
MFKQTKLLALASFGMFIGCGVLHANDANIATNQTNKSVQASTETPKSDQIDMQKLSEAFGHFIGRNLQAPGLQFDLEAIIKGIREGAAGKPAPLSEKEYEEMMAAVQERAFKEMSTKNLKNANDFMIKNSQSTDVTEIVPGKLQYSVEKEGTGPVVEPHSSPKIHYTGKYQDGTVFGTSEEMDGPITIPLDQTIPGFSKGIVGMKEGEKRRLYVHPDLGYGTTGQLPPNELLIFDIEVIKANSDDAKTKTGKSADDADEEDLFIDEEEYELEPAQKNAKTPEASNTSAKN

SEQ ID NO: 26590 - protein, 460 aa, Parachlamydia sp. UWE25
MNKLLNLLQPAPHIPELKDQELVKDQYKYWRIRILYSMFIGYAFYYFTRKSFTFAMPGLIQDLGFDKSQLGILGSILSITYGVSKFASGIIGDRTNSRYMMAIGLMLTGICNICFGLSSSIFFFALFWGLNGWFQGFGWPPCARFLTQWYSHSERGSWWSTWNVSHNVGGFLIPWIAGITLQYFGWRYAMYIPGILCILISFFLINRLRDTPQSLGLPPIEKYRNDYVDKAEADKEAEQLTTKQLLVNFVLKNSYIWILALAYFFVYAVRTGINDWTALFLVESKGYSSIGANGCVSLFEVGGFFGSLAAGWSSDKLFGAKRGPINVLFTLGMFAFIAIFWMIPSGYLLFDSVLMFCIGFSIFGPQMMIGLAAAELSHKKAVATSTGFVGFFAYIGAAFAGYPLGYITQQWGWQGFYWALMGCCIIALFLLIPLWSVSATTLKPKNKSSSPVSSPALASK

SEQ ID NO: 26591 - protein, 420 aa, Parachlamydia sp. UWE25
MNFLKSGSLMVKRNVHLTKLQSGYLFPEINRRKNEFLKKHPSAQLINLGIGDTTQPIPLYISEAMQNFAKQLASEKTYRGYGTEQGSILLREAIAEQYYQGKIDPQEVFVSDGSKCDVGRLQILFGSDATIAVQNPTYPAYVDTGVINGQASFFQTSTKQYQRITYMSCLPENNFFPDLANLPKTDLIYFCSPNNPTGSAATNEQLRELVQFAKKRQSIIIFDAAYASFVRSSHIPRSIYEIEGAKEVAIEVGSFSKMIGFTGVRLGWSVVPKQLRFEDGHSVQQDWERIVCTFFNGASNIAQAGGLAALQKEGLQAIDELSSYYMKNSNILKKAFEECGYKVYGGENVPYLWVHFPQLTSWEAFEILLKQSQLVSVPGSGFGSAGEGFLRFSAFGKQSDITVALPRIKHALLKIKPTVY

SEQ ID NO: 26592 - protein, 465 aa, Parachlamydia sp. UWE25
MEEIKTDIVIIGSGPAGQKAAIQAAKLGKNVIVIEKEPELGGACLYSGTIPSKTFREAVVDLTRFHDRHFAGKDYILPNVTIDELNVRLHTVINEERNIITRQFKKNSIRVIQGSARFENQHTLIVVDNDFRLKYQIKATSFIIATGSNPRNPPDVPFDQQVILDSTTLLGIGRVPKSMIVLGGGIIGSEYASFFAALGTEVTVIDRKDHMLPLLDAEIGIHLQTALTDIGLKFLGKKEPVEISRVEDHAYVKFKDGSSLEADVLLYALGRLANIEALHVENTGIIVDAKGYIPVNALFQTVIPHIYAVGDVIGGPCLASTSMEQGRLAARHACGVQTHHFPTFYPVGIYTIPEISSCGYTEEELKAWGFHYEVGRAHYYEIARSHIAGSNTGLFKILFHAETLEILGVHVIGRNATEVIHIGQMGISFRAHIDYFIDHVFNYPTYAEGYRVAALNGVNKIKFKK

SEQ ID NO: 26593 - protein, 243 aa, Parachlamydia sp. UWE25
MKREPQAVKIAPSILAGDFGHLADEAKKAEQAGADSLHLDIMDGHFVPNLTMGSQAVSAINRATNLFLDVHLMIYNPFDYIERFVQAGADSITFHMEATEDVEETLAYIRKCNIRAGLAFNPETSVSMIPKYLDKCDMILLMTVNPGFGGQKFIEKVLDKVQFTRDLCNQLNIRAGGVTLKDNSSTGHQLPPFDIQVDGGITHLNVRRCVEAGANVIVAGTSLFKSPNFADAIKQMRQSAEGH

SEQ ID NO: 26594 - protein, 375 aa, Parachlamydia sp. UWE25
MLFQYIRVLIGLICLKTLKELTMVKVSGYAAQQATTPLTPFTFDRRELRSEDVQIEILYCGVCHSDLHTARNEWKSTIYPFVPGHEIVGRVLEVGKDVKDFKKDDVVAVGCMVDSCRTCSSCKEHLEQYCENGPVFTYNSYDKYDQSITQGGYSTQIVVDHQFVLHVPKEFKEKDYPGVAPLLCAGITTYSPLKHWNVGKGSKVGVVGLGGLGHMAIKLAHAMEAHVVLFTTSKNKEQDAKRLGADEVVISKNEEDVKKHNATFDFILDTVAASHNLDPLIALLKREGTLCLVGAPEFPHPSPTVSQLIFKRRQIAGSLIGGIQETQEMLDFCAKRRITADVEVIPIEKINDAYERMLKGDVKYRFVIDSVSLKK

SEQ ID NO: 26595 - protein, 232 aa, Parachlamydia sp. UWE25
MNLAWLLAEFIGTFTLIFIGVGAICLNEMNPGSVGLVGIALAHGLAIAVMVSNVGHISGGKLNPAVSIGVLIGGRSDWKTTVAEIFAQLAGAVFAALCLKIIFPTDVTEVTKLGTPVLADGVSMGIGIMAEAILTFLLVFTVYAAAVDPKGAFKSIAGFTIGGVIIFDILVGGGLTGAAMNPARAFGPALVSGEWIDQIVYWIGPILGGLLAGLLYSKLMLKDLTTLSTPSV

SEQ ID NO: 26596 - protein, 264 aa, Parachlamydia sp. UWE25
MSPSHRPVVITGNWKMYKTVKEACTFAKALLPVVEVSPIQVWIAVPFTAIYPVKQEIRNSRLVIGAQNMNDASEGAFTGEIAGKMVKEAGASFVLLGHSERRHLYKEDNAFINRKVKKALEIGLTPVLCVGETFEERKSGETQQIIRTQIQECLAGLTAEDLKTLIIAYEPVWAIGNGQNAKPEGAQEIHQFCRKIIKEIFSEELAEQIVIQYGGSVNPSNAISLLKQPDIDGLLIGGASLSLETFVEIVNDGGSIFNLKAKLL

SEQ ID NO: 26597 - protein, 373 aa, Parachlamydia sp. UWE25
MVEGIVFEHVSKKFADSIALNDVSFAINKGEFFSLLGPSGCGKTTLLRILAGFEKPDQGRILLDGQDITKLPANKRPINTVFQNYALFPHLTIWENIAFGLRIAQRSETEIKREVEQMLGLIQMKEHGHKKPDQISGGQKQRVAIARALVNHPRILLLDEPLAALDLKLRQKMLLDLDRIHDEVGITFIFVTHDQSEAMAVSDRIAVLHKGSLEQIGNPIEIYEMPKSSFVADFIGDTNFFDGWVKETAQKEYSLVDVEGFPQIYCFNDKQLSKGDAVHLSVRPEKIHISREQIQAHPLQNVFQGIVDDVIYKGDHTHFGIQVGDRKISVNQQHSRFLLDEAPIKWKDVVWIWWHSDDGFILERCQKLENNNE

SEQ ID NO: 26598 - protein, 435 aa, Parachlamydia sp. UWE25
MATNKMGLMSAILLGINMILGSGIFLLPGKVSELTGASSLYVYVFVSLLILSIAWCFAQCAALFDRNGGAYLYAKEAFGDFIGFEIGFMRWIAGAMAWASLIVGFVTALSSIWPNALTEPLRGFLILIFLALLILFNMGGTEKLKNINNVVTIAKVLPLLFFVLIGFFYTKGNFQAIDVSLSHLDSISFGNAAIVIFYAFGGFETLVIAAGEIKNPHRNLPIAVMAVISFCSFLYFLIQIIAMEILGPHLAESSIPLADATEQMIGSAGRWIVTLGMIISIGGVNLTASFITPRSGAALAEDGLVPRWIAKNNKAGVPVVAIFLTASLTTIAALSGSFTQLAVISVVSRFVQYGATCLAVFVLYYRNRATLKMLKKISLVIIPSLSLIGLIWMLFQASSSQLYWGLGALLPGIPIYFFQKWKNNLTLATVSEMGD

SEQ ID NO: 26599 - protein, 231 aa, Parachlamydia sp. UWE25
MIMIKSTKPLVSTQAAVALILLGPPGSGKGTQAKRLAHEYQIPHISSGDLFREHMSKETIIGLKAKEFIQAGKLVPDEFVMDMLFDRLAHPDCARGYLLDGFPRTVAQAEALAGKRDIKIPLIVLYLEVPDAVIVKRAEGRLVCKNCGMVYNLYSSSPRLPGVCDKCGGEIYRRPDDDANIVLKRLEVYHELTSPLIQYYTDQGILLKFDGNQNSDTVYYQLKKSINEKYL

SEQ ID NO: 26600 - protein, 465 aa, Parachlamydia sp. UWE25
MVEHYDLAVVGAGPGGYVAAIRAAQMGLKTICIDKRETLGGTCLNVGCIPSKTLLHSTDLYSTLKQHGLEQAIEVSDLKVNFTKLMERKRNVVKGLIEGIALLFKKNGVIYLKGEAQFLDAHTLQVKNGTHIDEIKANYILLATGSESTSLPHLPFDEKNIVSSTGALNLATVPPRLLVIGGGVIGVELASVYNRLGSSVTIIEMSDRLCPAMDIALSKYLFQILKKQGIEIKLSTKMMTAVLQPNETILTIEQNEQLQNISGEVVLVAVGRRPYTQGLALDKVGIQIDKKGFIPVDGFFRTSQPHIFAIGDLIEGVMLAHRASQEGITVVEWLKGERQSINYLAIPNVVYTNPEVASVGLTEQEASESGLTLLTGTTYFRGNSRARCTDEIEGFVKLIGEKKSGRLLGMHIIGAHASELIAVGTLAIQKQINLKDLAETVQAHPTLSETIKEAALQALGKAVHG

SEQ ID NO: 26601 - protein, 432 aa, Parachlamydia sp. UWE25
MISRPISQQIYSNLNRVIPGGVNSPVRACANMGQIPMIIDHAYRDTLVDVDGKTYVDYCGSWGALIHGHAHPSILEAVQQRMKKGTSFGITTSIEGELAQEVIKLIDSVEKIRFVSSGTEATMSAVRLARGYTNKEFIVKFNGNYHGHADFFLVQAGSGVLEVSPSASSAGIPADIVKQTLCLPYNDIEACRQIFHHSDYRHKIAAIILEPIAGNMGVIPASQEFMQFLRKETLAMGALLIFDEVMTGFRVALKGAQDIYPVEPDLTCFGKIIGGGFPAAAFGGREEIMNLLAPLGSVYQAGTLSGNPIAMEAGLQSLRLIQQPGFYEELHRKTDLLLNPIKETIKKNNWPICIQQAGSMFTLFFCKNRVRNLEDALKANTTIFANFFRKLFDQGIYIPPSQHEAWFISQAHEESNLIKTQSAILTFLEENF

SEQ ID NO: 26602 - protein, 237 aa, Parachlamydia sp. UWE25
MIVNEGETLVILGRSGVGKSVLLKQIIGLETPDKGFVEIEGEKVTNLNTRAYQTKIKPMGMLFQGAALFDSMNVGENTAFYLRQHPESAYSEFEILERVAESLKMVGLEGTQKKMPSELSGGMRKRAALARLIVYRPQIILYDEPTTGLDPITSMQISELINQTKAELNATSIVVTHDIRSALEVGDRLAFHNDGKIAQIAPKNDFLKIDDPLLNDFFNNAFIDKKIFYKPKQSGDS

SEQ ID NO: 26603 - protein, 329 aa, Leptosphaeria maculans
MSPSAHPDAPIIIFGTANFGSPEDSKGKLFGPVTVEQGREYLDVLQEFNVDVLDTARIYSGGESEKLLGALDASREFKMCTKASGTLDGCGTRDAVLSAFKASSEALGVKEVDTYYLHTPDRTTSLEETMDTINELHKAGSFKTFGISNLRADEVQHLHTYARSKNYILPTIYQGTYNLLSRQCETKLLPLLRTLGIRFYAYSPLCCGLLINAEAKLQASTGRWDTSHFGGKFMNALYNKPSYIAASNAFQDMCGKYGVRPAGAAYRWVRYHSELEGGLGDGMVVGASSARQLEESLGEIEKGPLEEGLVGELEGLWDLVKEDAPAYSL

SEQ ID NO: 26604 - protein, 501 aa, Centaurium erythraea
MEITDFSTFLLAFLLLSYLLVTGRRLISKKSTGKLPPGPKKFPIVGNLPQLALAGTLPHRAMRDLAKTYGPLMHLRLGEVSQLVVSSPEMAKEVLKTLDPMFASRPDLILADIMLYDNAGLTFAKYGDYWRQLKKIFATELLSAKRVKSFRSLREEETLNTIRWISSNEGKPINMTNTLLNLVFGVLSRATFGKKSPEQDKLVYIVNKAAELATGGNISDLFPSIKFFRLISVVNYKLKSMFAESNRLLDMIMKEHKKGNGSGESKDLVDVLLGYQRENAEFSLTDENIKAVLLDIFIGGTDGSFTTLDWAMSELMRAPTVLKRAQEEVRQAFETDGYIDEEKFEDLKYVTSIIKETLRLHPPAPLLVPRSNDETAHILGYEVPAKSKILVNVWAINRDPRYWEDAESFKPERFLGSSVGYKGTDFHFLTFGAGRRMCPGMVYGYANIVHPLVKLLYYFDWNLPSGIKPEELDMTEEHGLSVKRKADLYLIPSVRNSISHL

SEQ ID NO: 26605 - protein, 498 aa, Hypericum androsaemum
MEFLLITQCSLLFVATYLLVNHVILRGRSKNNGSTKLPPGPRPLPIIGNLLALRDKPHKSLAKLARVHGPLVTLKLGQVTTVVVSSPATAREILQKHDATLSNRYIIDAIRAQGHHEAGLAWVPVGPTWRKFRKVCYSHIFTNQKLNSSQHVRQRTIQQLLAEARESCRVGEAMDVGKAAFRAALSSLSISVMSLDLADAASDTAREFKELARCIMNDVGEPNLADYFPVLKRFDPQGVRGRVEISFGRILDLFGSIIADRMEKRGADEDILDTLLTTHDENPELVEINDIKHLLLDLFVAGTETTSSTLEWAMAELLHKPTTMAKAKAELEQIIGKGNSIDQESEVSRLPYLQAVIQETLRLHPAVPLLLPRRAGEEVHVSGFTIPKDAQVLVNVWAMGRDPEVWEDPCSFTPERFLGSSIDVIGTCFELIPFGAGRRICPGLPLAMRMLQMMLGNLLLSFDWKLPDGVTPECMDMEDRFGITLQKAQPLLAIPLSL

SEQ ID NO: 26606 - protein, 449 aa, Centaurium erythraea
MDVIFPLLVAFITWAIASSLTFRRFGRLPPGPFPVPVIGNIHQLGKHPNQSLAKLSKIYGPLMSLKLGTQTAIVASSSTVVREILQKHDQVFSSRTIPSALHAHDHHKFSMALLPASSRWRHLRKITKEQMFSVQRLDESQGLRQDKLKELRDYLHSCCVTGQAVNIGEAAFTTTLNLMSCTLFSVNFASFDSKFSDELKRDICAFVQVIAAPNLADFSPVLRHVDPQGLLKRTKTYMQKVFDSFEDIITKRLQERGTSQQDSLRRHDLLEALLDEMEKNDSAFTINDMKHLILDLFIAGADSTSSTTEWGMAELLHNPEKMEKAKAELNEVIGQKNLVEESDISRLPYLQAVVKEVFRLHPPGPLLVPHKADADVEIDGYVVPKNANVLVNVWALGRDSSSWADPEAFMPERFLDNEIDVKGQHFELIPFGAGRRMCPGLPLSYRMLH

SEQ ID NO: 26607 - protein, 491 aa, Hordeum vulgare subsp. vulgare
MAGGGGKAKPLEFTPTWIVALVCSVMVIISLLFERLLHRLGKRLIRSRKKPLYEALLKVKEELMLLGFISLLLTVFQGPMGKVCVSPITMLHLQPCKPPPDETDHLGDAVFAGVLGGGRRLLAGGASSDEYCLKKDKVPLLSSEAIHQLHIFIFVLAVTHFLLSAITVLLGMAQTRNWRHWETKIQEKDDSAPQMIKHVREFKFIQDHFKDHRKRSRIFAWMRSFFKQFYGSITEEDYTTMRLGFIMKHCKGTPKFNFYSYMIRALEVDFKKVVGISWYLWAMLMIFLLLNVEGWYVYIWITLVPFIMLLVVASKMEHIITELAYEVAHKHTAIRGDLVVAPSDDFFWFHRPKLVLLLIHIVLFQNAFQIAFFFWLLVTYGFKSCIMGKPAYVITRVVISVICQILCGYSTLPLYAIVSHMGNSFKKTIFDENVTEGLVNWAEKARRGTRTPNKITTDASSSPIDEANGGIVQMTNTRANSSVDQGTARLI

SEQ ID NO: 26608 - protein, 503 aa, Muscari armeniacum
MSFTDHHYLLLILFLIPILVYTIRRKISSTKSKLPPCPPKLPLIGNLHQMGTLPHQSLHALSVKYGPLMLLKLGQIPTLIVSSADMAREIMKTHDHIFASRPSLMTAGIILYGSMDVVFAPYGEHWRQMRKLCVNHLLSPKAVQSFRRMHEEEVATMVAKISEVSSSSGVVNMSETLNLFASNAMLKAISRKLFRDERRSRVICELNEETAAILGQFSVSDFMPLLAWFDMVFGVGARAKKTARLWDRVLHEIIEDCRNRRDSEVNTDFVNVLLALLEDNDMDFSLNKDIIKAVLQDMIAAGTETSSTAMDWCMAELVRNPEAMKKLQDEVRGIANTKPMITDDDLSKMGYLKAVIKELLRLHPPVPLLIPRESMDHCEVQGFDIPKQTRVIVNAWSIGRDPNVWEAPEEFRPERFLDCAINFRGHDFELIPFGAGRRICPGMQFAVSTLELALANLVRSFDWELPDGMNNEDLGMGDGPGLSARRRQSLLLVAKPFLGLKCM

SEQ ID NO: 26609 - protein, 416 aa, Virgibacillus pantothenticus
MQIFEELESAVRSYSRGWPTIFEKAKGYKLWDIDGNMYIDFFAGAGALNYGHNHDTMQEKLIAYIQDDHIIHSLDMGTTPRKTFLETFHNTILKPRNLDYKIMFPGPTGTNTVESALKIARKVTGRDTVISFTNAFHGMTIGSLSVTGNSFKRHGAGVPLHHSVSMPYDKYVNDQDSIAYLERFLEDSGSGVALPAAIILETVQGEGGINAASIEWLQKIASICERWDILLIIDDVQAGCGRTGTFFSFEPAGIAPDIVCLSKSIGGIGLPMAITLIKPEYDQWGPGEHNGTFRGNNLAFIAATEALTAFWQDNTFSKSIIQKSKLVRQRIDRIIDKFPSLQGEARGRGLMQGIVIPEPNCASEICKAAFDIGLIVETSGPNDEVVKFLPPLIIDKEGINQGFDILEVSMEHVLKK

SEQ ID NO: 26610 - protein, 287 aa, Raphanus sativus
EFMNEVRLIARLQHINLVRILGCCIDADERMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWVLGSEATAIPQPKPPVYCLIPSFYANNPSSSRPSDDDESWTMNEYTCSVIDAR

SEQ ID NO: 26611 - protein, 290 aa, Raphanus sativus
EFMNEVTLIARLQHINLVQILGCCIDADEKMLIYEYLENLSLDSYLFGKTRSSKLNWKERFDITNGIARGLLYLHQDSRFRIIHRDLKVSNILLDKNMIPKISDFGMARIFARDETEANTKRVVGTYGYMSPEYAMKGIFSEKSDVFSFGVIVLEIVTGKRNIAFNNLNYENNLLGYAWSNWKEGKALEIVDPDIVDSLSPLSSTFQPEEVLKCIQIGLVCVQELAEHRPTMSSVVWMLGSEAAEIPQPKPPGYWVRRSSYEIDPSSSRQCDDDDSWTVNQYTCSVIDAR

SEQ ID NO: 26612 - protein, 287 aa, Raphanus sativus
EFMNEVRLIARLQHINLVRILGCCIDPDEKILIYEYLENSSLDYFLFGKKRSSNLNWKDRFAITNGVARGLVYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWMLGSEATAIPQPKPPVYCLIPSFYANNPSSSRPSDDDKSWTMNEYTCSVIDAR

SEQ ID NO: 26613 - protein, 290 aa, Raphanus sativus
EFMNEVTLIARLQHINLVQVLGCCIDGDEKMLIYEYLENLSLDSFLFGKTRSSKLSWKERFDITNGVARGLLYLHQDSRFRIIHRDLKVSNILLDKNMIPKISDFGMARIFERDETEASTMKVVGTYGYMSPEYAMNGIFSEKSDVFSFGVIVLEIVTGQRNRGFYNLNYKNNFLSYAWSNWKEGRALEIVDPVIIDSLSPLSSTSQPKEVLKSIKIGLLCVQEHAEDRPTMSTVVWMLGSEETEIPQPNPPGYCVRRSPHELDPSASRQLDDDESWTVNQYTCSVIDAR

SEQ ID NO: 26614 - protein, 287 aa, Raphanus sativus
EFMNEVRLIARLQHINLVRILGCCIDADEKMLIYEYLENSSLDYLLFGKKRSSNLNWKDRFAITNGVARGLLYLHQDSRFRIIHRDMKAGNILLDKNMIPKISDFGLARIIARDQTEASTDNPIGTYGYMSPEYAMYGVLSEKTDVFSFGVIVLEIVTGKRNRGFYQSNPENNLICYAWTHWAQGRALEIVDPVIVDSLSSTFQPKEVLKCIQIGLLCIQERAVHRPTMSSVVWMLGSEATAIPQPKPPVYCLIPSFYANHPSSSRQSNDDESWTMNEYTCSVIDAR

SEQ ID NO: 26615 - protein, 290 aa, Raphanus sativus
EFMNEVRLIARLQHINLVRILGCCIDADEKILIYEYLENSSLDSHLFGEKRSSKLNWKDRFDITNGVARGLLYLHQDSRLRIIHRDVKVSNILLDKSMIPKISDFGMAIIFAREETEANTRNVVGTYGYMSPEYALDGVFSEKSDVFSFGVIVLEIVSGKRSRGFYSLNHENNLLSYAWSHWTEGKALEIVDPVITDSLSSLPSTFQPKEVLKCIQIGLLCVQERAEHRPTMSSVVWMLGSEATEIPQPNPPGYYVGRCPYENNPSSRRLCDDYESWTVNQYTCSVIDAR

SEQ ID NO: 26616 - protein, 290 aa, Raphanus sativus
EFMNEVTLIARLQHINLVQVLGCCIEADEKMLIYEYLENLSLDSYLFGETRSSKLNWKERFDIINGVARGLLYLHQDSRFRIIHRDLKASNILLDKNMIPKISDFGMARIFERDETEAKTRKVVGTYGYMSPEYVMDGIFSEKSDVFSFGVIVLEIVSGKKNRGFYNMSNENNLLSYVWSHWKEGRALEIVDPVILDSLLSLPSTYQPQEVLHCIQIGLLCVQEHAENRPMMSSVVWMLGSEATEIPQPKPPGYCVIRSPYELDPSSSKKCDDNESWTVNQYTCSVIDAR

SEQ ID NO: 26617 - protein, 289 aa, Raphanus sativus
EFMNEVRLIARLQHVNLVRVLGCCIDADEKMLIYEYLENLSLDSYLFGKKRSFKLNWKDRFAITSGVARGLLYLHQDSRFRVIHRDMKVSNILLDKNMIPKISDFGMARIFAREETEANTSKVVGTYGYMSPEYALNGVFSEKSDVFSFGVIVLEIVSGRRSRGFYHLDHENNLLSYAWSHWTGGSALEIVDPVIVDSLSSLPSTFQPEEVLKCIQIGLLCVQERAEHRPTMSSVVWMLGSEATEIPRPNPPGYYVGRSPYENNPSSSGPGDDESWTVNQYTCSVIDAR

SEQ ID NO: 26618 - protein, 287 aa, Raphanus sativus
EFMNEVRLIARLQHINLVRILGCCIDADEKMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQESAEHRPTMSSVVWMLGSEATAIPQPKPPVYCLIPSFYANNPSSSRPSDDDESWTMNEYTCSVIDAR

SEQ ID NO: 26619 - protein, 290 aa, Raphanus sativus
EFMNEVTLISRLQHINLVQVLGCCIEGDEKMLIYEYLENLSLDSYLFGKTGKSKLSWKERFDITNGIARGLLYLHQDSRFRIIHRDLKVSNILLDKNMIPKISDFGMARIFARDETEANTMKVVGTYGYMSPEYVMHGTFSEKSDVFSFGVIVLEIVTGKRNRGFNNLDNENNLLSYAWVNWKEARALEIVDPVIVDSLSPLSSTSQPQEVIKCIQVGLLCVQELAEHRPTMSSVVWMLGSEATDIPQPKPPGYCVRRTPYELDPSSSRQYNDDESVTVNQYTCSVIDAR

SEQ ID NO: 26620 - protein, 430 aa, Aspergillus oryzae
MAAASRLPFLFRSTSRSLGSIRKPLIQIPASRTFASKHPKGFVPPTEDELLELRERVQEFTRREITEEVAAKTDAQNEFPAEMWKKLGDAGFLGITANEDYGGLGMGYQAHCIVMEELSRASGSIALSYAAHSQLCVNQLSLNGSPEQKERFLPGLLSGDKIGALAMSEHSAGSDVVSMKTTAKEVDGGYVLNGTKMWITNGPDADFIVVYAKTEPQKGSKGITAFVVEKTFDGFSCARKLDKLGMRGSNTGELIFEDVFVPKENVLGEVNRGVKVLMEGLDLERLVLSAGPLGIMQAALDLVLPYTHVRKQFGTPIAHNQLIQGKLADMYTKLQASRAYTYSTARHIDNSASLSEVSIRTQDCAGAILYAAERATECALDAIQLMGGNGYINELPAGRLLRDAKLYEIGAGTSEIRRMVIGRAFNKEYA

SEQ ID NO: 26621 - protein, 345 aa, Candida albicans SC5314
MSGETVFVTGATGYIAQHIIKQLLSKGYSVIGSVRSQSKGEQLKELITAHHQDTTGDAKFDYVIVESLIEPGAFDSILQNHKEVGVFIHSASPIPFATDSVEKDILQPAIDGTKNVLTSIKKYGNENIKKLVITSSIAAVEPLGTGQTEPKTISEKDWNPITFEQGLANPAVAYYASKTLAEREVWKFVDENKNQLNFDVAVINPSFVFGPQAFGIKDKSAALRSTGEIINSVLKLKSNDPIPSLVASFIDVRDVARAHIIAFEDDDAIGQRLILDNEIFTKELIAHLIKKNFPSLDIPEGDIVKSEEEIANYPWRVDSTKTEKILGFKYISLDKSVVDTVNQLI

SEQ ID NO: 26622 - protein, 388 aa, Candida albicans SC5314
MTDKTNFPTTVFVSGASGFIAQELIKQLIIKGYNVIGSVRSTTKGESIKSNLTSSSTTQSLNSDLFNYTIIKDISSPGAFDNVLKQYPEIEIFLHTASPFHFKAGNIEQELLIPAINGTKNALLAIKQFGHKIKHVVITSSVVAVGKFGKFPRTSTGSTSLSSSVVVADENSWNPITWEMSLKNPFYGYFGSKTFAEKEVWIFLQIENPKFNITTINPGMVLGPQAFPINNHNGGGAGAGGTNNLELNTSSQEIVRLLNLSTVDDVNKVKISTKVENTFIDVRDVAKAHIIAFEKPQLTKNKRLLLIEDIYNEQTLLNIINNNFPQLNLPKGEPITGQIDESKLNNTWNTTQTKTIFGDKYIGIEKSVIDSVNQILEAKNEGNPQCKL

SEQ ID NO: 26623 - protein, 222 aa, Candida albicans SC5314
MADNSDDYSYDYEYLYKIVLIGDSGVGKSNLLSRFTRDEFNLESRSTIGVEFATRTLEIDGKRVKAQIWDTAGQERYRAITSAYYRGAVGALIVYDIAKTESYESVSRWLKELKEHADANIIIELVGNKSDLDHLRAVPTEEAKNFAMENNLLFTEASALSSDNVDLSFHQLLKNIYEMISKHQLENNDSKQTNTAGGPTISLTPAPQEKKNKNNGWLLLRH

SEQ ID NO: 26624 - protein, 197 aa, Candida albicans SC5314
MSTFFDEMSKSFADVKVSDGKIDTADFLQASESLVKLFDLLGSSAFTVVKSDMTGNITKIRNKLLEDPANSATLQDLVLTEAKTKTKTATQGLLWLSRGLQFTAQAMRETVDAPGKELTVTFTDAYTKTLSKFHGMLVKPVFKLAMKACPYRKDFFEKLGADQTKVAEQLQKWLEALEGIVKIIMDFFASGNYGKGL

SEQ ID NO: 26625 - protein, 1100 aa, Candida albicans SC5314
MLESLNRRNSIDSNQGDNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFALDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIQKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 26626 - protein, 379 aa, Candida albicans SC5314
MVLDLLGSGTFGQVVKCQNLNNQTVCAVKVIKSKPAYMNQSLTEVRLLEFLNANSDGKNFIRLLDTFMHKEHLCLVFEILASNLYELIKQNQFQGLNMKLVKLLTKQLLDSMAQLKNFQMIHCDLKPENILLCQPDKPNIKVIDFGSACFTRNTIYTYIQSRFYRSPEVILGLPYTESIDMWSLGCIVGELFLGLPMFPGTSEYNQIFKIVDMLGPPPRHMIEVGKNSFNFFKKKVNTTTTTINNNNNNTSETKPIYELKSFDEYCQFLEYKRQKQEGATSTTNNNTNSSSSSNHHNNNHKKEQPNKNYFKHKLLKDIIINYKLPSKKMTNSMIEKEYHDRLLLIDFLTKVLNLNPLERLTPQEALKHPFIIDVNTTDL

SEQ ID NO: 26627 - protein, 398 aa, Candida albicans SC5314
MFLKNIFIALAIALLVDATPTTTKRSAGFVALDFSVVKTPKAFPVTNGQEGKTSKRQAVPVTLHNEQVTYAADITVGSNNQKLNVIVDTGSSDLWVPDVNVDCQVTYSDQTADFCKQKGTYDPSGSSASQDLNTPFKIGYGDGSSSQGTLYKDTVGFGGVSIKNQVLADVDSTSIDQGILGVGYKTNEAGGSYDNVPVTLKKQGVIAKNAYSLYLNSPDAATGQIIFGGVDNAKYSGSLIALPVTSDRELRISLGSVEVSGKTINTDNVDVLVDSGTTITYLQQDLADQIIKAFNGKLTQDSNGNSFYEVDCNLSGDVVFNFSKNAKISVPASEFAASLQGDDGQPYDKCQLLFDVNDANILGDNFLRSAYIVYDLDDNEISLAQVKYTSASSISALT

SEQ ID NO: 26628 - protein, 247 aa, Candida albicans SC5314
MSIVSLTGIEVLNNPAKFTDPYEFQITFECLEPLKEDLEWKLTYVGSSDSLDHDQELDSILVGPVPVGINSFLFKADAPSPELIPASELVSVTVIILSCSYNDKEFVRVGYYVNNEYDTEELRENPPAKVAIDHVVRNILAEKPRVTRFNIVWDNEEGADEYPPEQPEDEEEEEEEEEEGEEEEEDEDEEDDDDDEDLNGDAVVDLEKEEISTPRDNDEDIEIDIASESEVEEGGVEEEAKVNTPKD

SEQ ID NO: 26629 - protein, 501 aa, Candida albicans SC5314
MTIPLSVDVTLPDGKKFTQPTGLFINNEFIKSKSGKTLESINPGTSEINGEVYAAESEDIDYAVECASKAFKSWKKITGVERGKYLYKLADLVEQQRDLLGAMEAWDSGKTKSTNAVFDVDECIAVIRYAASWADKITGKVIQNDPKKFAYTIHEPWGVCAQIVPWNYPLLMSMWKIPIAVAAGNTVVLKTSEITPLSMLYFASLVKQVGFPPGVINIVSGFGATAGAALASHKKVAKIAFTGSTATGKIIQKLAAENLKAVTLECGGKSPLIIRSDADIDQAVKWGAIGIMSNQGQICTSTSRIYVHESIYDKFIEEFAAHVKSDYKQGDVFDDEAVVGPQVSKMQHDKILNYIDIGKKEGARCVLGGEKNIEGELSKGYFVKPTIFADVKPEMRIVNEEIFGPVVVVGKFSTDEEAITYANQTDYGLGAAIFTKDITAAHNMASDIEAGMVWINSSNDSDYHVPFGGVKMSGVGRELGEYGLNMYTQAKAVHVNLGTRL

SEQ ID NO: 26630 - protein, 148 aa, Candida albicans SC5314
MSGILFEDMFIVDSTDPGRYNKVCRITGHSSTSKDITITLDINKELFPVQNHDSLTITLASSLGNESSMITSNGSWRPPKPDERSLADDYDYVMYGTVYKFEENADNDKMAVYISFGGLLMRLEGGYRSLSNLKQENAYILIRHYKDN

SEQ ID NO: 26631 - protein, 508 aa, Candida albicans SC5314
MVVDTTYYDLLNIETSATSLEIKKAYRKAAIKLHPDKNPNDPDAAAKFQEVGEAYQVLSDETLRAKYDKYGKQESIPQEGFEDPAEFFSMIFGGEAFKDWIGELSLLSELSKSAELSGYSDNADKKKDTKTAGTGSDESKESNESKKQKLDTTENGHKSSTEPRLLANGENTPGNQLTEKELEEKKRKEELEKFEEECRVKKIETRNELSKKLINKLSLFTETDMKDDVVESFQTKIKYEAESLKMESFGLEILHTIGHIYKTKSKIFLKNQTFFGWGGFWWSMKEKGGVVKDTFKTVSAALDAQRTMEEYTQMQQDNEYHAKKEAEEEEAKKQANEEVSKLEKELEEVKKEQQQQKSQDKPAAETEGSSTGDSQLKEGQEAEGSVSKFETKEPAKHTAEELAEMEKYLMGKVLAAAWNGSKFEIQGTVRAVCDNILEDKDVSLETRVARAKALRLIGDVFVSMTRTEAEAEEARVFEELVAEASKKREKKKTPTEAEQQQERAEHAS

SEQ ID NO: 26632 - protein, 377 aa, Candida albicans SC5314
MCGPLHVSDIFIFNQTDAGNITLRIGKLPRGPNLQFKINNYSLCKDVRKILKHPKSISKDNSIFQSPPLLVLNGFGKISEMSQHEKLMVTIFQNMFPPIQPQQTKVSSIKRVLLISKNKVTNEIELRHYAINTKLVDENRNVKKLIQSHHNLKKKLPKLTNNQDVSDLLLNPYSIGGLTSDSEFEDDAVVEIQQETFVKKEPTKAITTTITATTEKEVESQSQPQPQPQPQQGKSKRAIKLTELGPRLNMSLIKIEEGLIGSSKTIYHSSIQKTEDEIKSLEKKHLLKQQLKLERRSKQQAAVKAKLDKKEAKKARRKAREEGREKDNDDNNNEEEEEEEDSADEEQVDDDDSDSDAVDINPEDYENDSDLYSDVDV

SEQ ID NO: 26633 - protein, 475 aa, Candida albicans SC5314
MSLISFLFVTTICFSVTQSLGEMATYIPVSGSFVQFITRWVSKSCGAANGWLYGWSWAITFGLELSIVGQVIQFWTDAIPLAAWISIFFVLLTALNLFPVKFYGEIEFWMASIKLTAVIGWIIYAFCMVCGAGKTGPVGFRYWRNGYAWGDGMIVSNNGKYAISFINGLINAVFTFQGTELVAITAGEASPKALKSAIRKVMFRILVFYVLCMLFIGLLVPYNDPKLTEDGGFTRNSPFLIAMENSGTKVLPHIFNAVIVTTIISAGNSTVYAGSRIFYGLAESGVAPKIFLSTTKAGVPYVAVLFTAAFGALGYLVVSNDGTVVFNWLLNIAATAGLVAWGFISVSHIRFMQVLKQRGISRDTLPFKAFFMPYSAYYAAIVVFTVALIQGFTVFWDFNATDFFTAYVSLIVFVVWWIMFHFFFFGFGKQAWKWSNVLIPLEECDIDTGVRDINDIEFDVPPPKNLWQKFWLIIA

SEQ ID NO: 26634 - protein, 417 aa, Candida albicans SC5314
MSLSNKLSVKDLDVAGKRVFIRVDFNVPLDGKTITNNQRIVAALPTIKYVEEHKPKYIVLASHLGRPNGERNDKYSLAPVATELEKLLGQKVTFLNDCVGPEVTKAVENAKDGEIFLLENLRYHIEEEGSSKDKDGKKVKADPEAVKKFRQELTSLADVYINDAFGTAHRAHSSMVGLEVPQRAAGFLMSKELEYFAKALENPERPFLAILGGAKVSDKIQLIDNLLDKVDMLIVGGGMAFTFKKILNKMPIGDSLFDEAGAKNVEHLVEKAKKNNVELILPVDFVTADKFDKDAKTSSATDAEGIPDNWMGLDCGPKSVELFQQAVAKAKTIVWNGPPGVFEFEKFANGTKSLLDAAVKSAENGNIVIIGGGDTATVAKKYGVVEKLSHVSTGGGASLELLEGKDLPGVVALSNKN

SEQ ID NO: 26635 - protein, 340 aa, Candida albicans SC5314
MTKDLVVGKKGISLTDGNELLRSSKKGKLPIVDAEGNLVSLISRTDLQKNQDYPNASKSFHSKQLLCGAAIGTIDADRERLDKLVEAGLDVVVLDSSNGSSVFQLNMIKWIKEKYPELQVIAGNVVTREQAALLIEAGADALRIGMGSGSICITQEVMACGRPQGTAVYGVTEFANKFGVPCIADGGIGNIGHITKALALGASCVMMGGLLAGTAETPGDYFYRDGKRLKTYRGMGSIDAMQQTNTNANASTSRYFSEADKVLVAQGVSGSVVDKGSITKFVPYLYNGLQHSLQDIGIKSIDELRENVDNGEIRFEFRTASAQFEGGVHGLHSYEKRLHN

SEQ ID NO: 26636 - protein, 154 aa, Candida albicans SC5314
MVFETSKATSYLKDYPKKDGLSVKELIDSTNFGGLTYNDFLILPGLINFPSSAVSLETKLTKKITLKSPFVSSPMDTVTEENMAIHMALLGGIGIIHHNCTSEEQAEMVRKVKKYENGFINDPVVISPEVTVGEVKKMGEVLGFTSFPVTGMFL

SEQ ID NO: 26637 - protein, 191 aa, Candida albicans SC5314
MQTIKCVVVGDGAVGKTCLLISYTTSKFPADYVPTVFDNYAVTVMIGDEPFTLGLFDTAGQEDYDRLRPLSYPSTDVFLVCFSVISPASFENVKEKWFPEVHHHCPGVPIIIVGTQTDLRNDDVILQRLHRQKLSPITQEQGEKLAKELRAVKYVECSALTQRGLKTVFDEAIVAALEPPVIKKSKKCTIL

SEQ ID NO: 26638 - protein, 337 aa, Candida albicans SC5314
MVTRLGKSGLKVNTVAVGTMRLGSSWRGFNGDIDECLKILKFCYDNGFRTFDTADTYSNGKSEELLGLFIKKYNIPRERIVILTKCYFSVKDDAEDSSLEIDPIDYMNGKGLSRKHILAAAEASVKRLGTYIDVLQIHRLDHEVTYEEVMRSLNDVVEQGLARYIGASSMKTWEFVELQNVAKANGWHQFISMQSHYSLLYREDERELNDYCKKNSIGLIPWSPNGGGVLCRPFDSEKTKQFLDNKQWSSLFGLENVRDADKIIVDRVKELSVKYNASMMQVSLAWCISKGVIPIAGVSKFEQAEELVGIFKVNLTEDDIKYLEEPYHAKDLARVAA

SEQ ID NO: 26639 - protein, 341 aa, Candida albicans SC5314
MSKGDLEELDIQKLIVEKRLEQSNGSGFATMKRNKRALGTCLFVSLGGILYGYNQGMFGQVSSMHSFGETVGIGKIQDNPTLQGLLTSILELGAWVGVLMNGYVADALGRRASVVIGCILFNIGVIIQAVARDADYGYILGGRFVIGLGVGVLSMVVPLYNSEISRAEIRGANTAIYQLSITFGIMISYWITYGTNFIGGTGDNQSQASWLVPMCIQAAPAIILAVFIYSFPESPRWLINVGQEDKALEVLAWLRETEQENVGLQIEFLEMKAQKIFEQTLETEAYPHLQDGTKMSKFKINLNQYKSMVTHLPTFKRVSVACLTMVFQQWTGAYVSNTFFF

SEQ ID NO: 26640 - protein, 345 aa, Candida albicans SC5314
MGQLLSHPIEEKELDYKSYTNLTYCIGSMQGYRMTMEDAHDVKINEHENLAVFGIFDGHGGKNCSQYLAEHLPKLVFTKLNKIASAVYLKQVKDIDLKDVFDILKNSFFKIDKDLSHHANMVNCGSTATVVTIIANYIVVANTGDSRCIVSRNGHAKPLSFDHKPSNMGERVRIENSNGYILNNRINEVLALSRAFGDFKFKLPYLSSSRNKYIKENQKLLGDKLITLPPELFQVTVEPDIMLYDMQKLDSPEFLVIACDGVWDCFKNGQLVKLIRDKLSLGWRLNKIVEYILNDSLTMANNYTGIGFDNMTLIIVAIHKKEGETMDDWYESMKEKILKEKGITR

SEQ ID NO: 26641 - protein, 300 aa, Candida albicans SC5314
MYNPYGNAADAYQQQQQQQYQQQQQQPHSTNLQHPQPIHHVSSHQPPPGAAGGQFNFLNDPAAALASQFARSGFEQSNQYLQENFGSLQGDIKYYFQVSNSYVFKKIILILMPYNHKDWNRVSTKETGTNQFLPPNLDINAPDLYLPLMSFVTYILLWAAFQGINGDFHPQLFGYLASQTIAFSVLDVVIFKTGLYLLNCPQSKIYDIISFSGYKYVSIIVLLILKYLVGNYLGLFYYIVVLLLIANLSIFLMRSLRFLILPQSTSMNNTITSKQRKIRIQFLFVYSVIIQGLIILYMSK

SEQ ID NO: 26642 - protein, 491 aa, Candida albicans SC5314
MLRSFKSIPANGKLAQFVRYASTKKYDVVVIGGGPGGYVAAIKAAQLGLNTACIEKRGALGGTCLNVGCIPSKSLLNNSHLLHQIQHEAKERGISIQGEVGVDFPKLMAAKEKAVKQLTGGIEMLFKKNKVDYLKGAGSFVNEKTVKVTPIDGSEAQEVEADHIIVATGSEPTPFPGIEIDEERIVTSTGILSLKEVPERLAIIGGGIIGLEMASVYARLGSKVTVIEFQNAIGAGMDAEVAKQSQKLLAKQGLDFKLGTKVVKGERDGEVVKIEVEDVKSGKKSDLEADVLLVAIGRRPFTEGLNFEAIGLEKDNKGRLIIDDQFKTKHDHIRVIGDVTFGPMLAHKAEEEGIAAAEYIKKGHGHVNYANIPSVMYTHPEVAWVGLNEEQLKEQGIKYKVGKFPFIANSRAKTNMDTDGFVKFIADAETQRVLGVHIIGPNAGEMIAEAGLALEYGASTEDISRTCHAHPTLSEAFKEAALATFDKPINF

SEQ ID NO: 26643 - protein, 506 aa, Candida albicans SC5314
MLIDNKKLNLLETQTTNTEKELQEVDGEDEISYDTEDLSAPPTPSTIYNWRIVIIAITASFAAVIVGYDAGFIGGTVSLASFQGEFKMNELSPSQKTEINSNVVSVFQAGAFFGALFFYPIGEIWGRKLGLILSAFLLVFGAGISLEAKHSTGLASIYAGRVITGLGVGGCSGMAPIYISECSPAKIRGKLVGMWEMSWQIGGIVGYWINYGVLQNLPPSRKQWLIPFAIQLIPSGVFFIGTIFIPESPRFLVYKGQIDKAKVNLSQLRSIPTDHPYSVYEMENIIKDVEDKKSKLANDGFFAPILKLFLSKKLLYRLLLSTSLFPMQNGAGINAITYYSPAIFASFGITGSKAGLLSTGIFGILKAFAALVWMFCIVDRLGRRTALIYFSFPCSICMWYIGAYIKIAKPGLRVANGDTHQDAGGKAAQAMLYIWTIFYGSSWNGTPWVINSEIFSQEVRTLTQAINSMSNWFWAFIMGRFSGEAVKAIGYKFYFIFATCMAVFQL

SEQ ID NO: 26644 - protein, 433 aa, Candida albicans SC5314
MDLRVGKKYRIGRKIGSGSFGDIYLGTNIISGEEVAIKLENTKAKHPQLEYEAKVYKALSGGVGIPFVRWYGTECDYNAMVIDLLGPSLEDLFNYCNRKFTYKTVLLLADQLICRIEYIHARCFIHRDIKPDNFLMGIGRRGSQVNVIDFGLAKKYRDPRTHLHIPYRENKNLTGTARYASVNTHLGIEQSRRDDLESLGYVLIYFCRGSLPWQGLKAATKRQKYDRIMEKKMTTPNNILCKGLPSEFLEYMNYVKTLRFDDKPDYPYLRKLFRDLFKKENYRYDYVFDWTLYKFQQEKQRAQQGKVADGDNQDQQQQQNNQNQTQTQNQQGQITAPQPPVPVSQQQQQQQQIPQHIPTPQQISQQQQQQQQQQQQLPPQQQKTSVTPQLQQYTDQRLQNQRAVYQSNQNYSGTKSAQPQAQQPPQQGNPAWL

SEQ ID NO: 26645 - protein, 132 aa, Candida albicans SC5314
MSGGKGKAGTSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQNLLPKKSGKGGVKASQEL

SEQ ID NO: 26646 - protein, 358 aa, Candida albicans SC5314
MSYITPTKRIFTPEDLSKWVGSPTYNTVLDFIVELQSSVTGKSNDSSYETSSIIDKLSKLLSKVDNLITLHPAHDSVSRFGKIEFRDFYSDLSSKAEEYISEITATAIQETSAYFIESWGNSTRIDYGSGHELNFICFLLCLKELGQITSADYEGLVLKVFTQYMSIMRKLQKEYWLEPAGSHGVWGLDDYHFLPFLFGAAQLSTHPHMKPKSIHNDELVEMYSTKYMYFECINFINKIKTIPNHQGKLSLRWHSPMLDDISAAKNWDKIREGMVKMYKVEVLGKLPIMQHFMFGSLLKCPEGIPEHTDENGHGENPEDHCGHAHVNTWGDCCGIKIPSGIAASESLKHERKGNIPFD

SEQ ID NO: 26647 - protein, 338 aa, Candida albicans SC5314
MSVSKSATTVFVSGASGFIAQNVIKQLLANGYKVIGSVRSESKGKELTDIIQSNDFQFAAIPDISAVGAFDDVLKSNSQISVFIHTASPVTYSAKDVQNELIKPAVEGTRNALNAIKSYGPQIKRVVVTSSFTAIASGKDFDHDKYYTEKDWNPVTIEQALSNPEAAYAYAKKMAEKTVWDFVETESPTFKVTVVNPTVVFGPQAFGVKDKSKLNLSIEMINDILTLKPDDEIPPYASRCIDVRDVAKAHLVAFEKEEAINQRLVLINQPFSNDLLAYIIKKSFPVINIPEGNLERSRECIAKSCIKTDLTKTQEILGFDYVPVEKTILDTIQQLYDA

SEQ ID NO: 26648 - protein, 336 aa, Candida albicans SC5314
MPSFELDSLPYLNPNVDRRIAFITGGSSGLGFYSVLQLYLHGYTVYIAGRSKSRCLKSIKELKNKAIDIRSEYTSSQLNERFLGDLRFLEVDLSNLNSVISAVENFKKLEDHLHILINNAGAMALPYTLTIDKFEIQLQTNFVSPLVLTTKLLPILQKTADKFPKLPTPRIIYLGSFGHQFALPYFNLSNNLNHYPNFIFTWIRYGMAKVAGIHFMKMLTLRNPKVLFLTVHPGLVMNTNLFSYWTRLPIVGIIFWFAFYLFGYFFGVTSKEGADVVIKCALDENLTVENDNGKYFGPDGKESQPSSIATNMDYAARTWIWTIKELSQRGIDIPNP

SEQ ID NO: 26649 - protein, 496 aa, Candida albicans SC5314
MTSTNKPPALKEDILELIGNTPLVKLNKIPQSLGIKAKVYAKVELFNAGGSIKDRIAKNMVLEAEKQGKIKPGYTLIEPTSGNTGIGLALVGAVRGYRTIITLPEKMSNEKVSVLKALGAEIIRTPTEAAWDSPESHIGVAKKLEKEIPNSIILDQYGNPANPDAHYYGTGYEIWEQTEGKITHLVAGAGTGGTITGISKYLKEKNSKIHVTGADPKGSILAEPESLNNSTEGYLVEGIGYDFIPDVLNRKYVDDWIKTDDAESFKLARRIIREEGILVGGSSGSALQAALQVAKDLTEDDTVVVVFPDSIRSYLSKFADDEWLISNGFEVEDSPGANKADEFLNGKTIKDLVAGKAPVVTVTLSDTVAKTFDLLQSNGFDQLPVLNNSGRLVGLITLSKILKSLSTKKIQTTNSISSIIIDFRKLADFEKSFTITKKSGFTKRSYEPIKLDTPLAALNKFFETNSNAIITDDELKPVQIVTKVDLLSYLTKNASF

SEQ ID NO: 26650 - protein, 509 aa, Candida albicans SC5314
MITKRLYSTIESSKKVLGTLSNPNLVKTEAYINGKWVPSSSGETFTVTNPALYPNPESELATMQSMSEEDFNSAIESADIAFNKFKKTTGRYRSELLLKLYNLMISNKDDLAKLVVLENGKPYADALGEVNYAASFFQWFSEEAPRIYGDIIPSANGTNRILTFKQPIGVCGILTPWNFPLAMITRKLGAAIATGCTAVIKPASETPLSATALAFLAEEAGFPPGVINVLPSADASGSGKYLTEHPLIKKVSFTGSTPVGKILMNQSASTLKKLSFELGGNAPFIAFDDVDVDKAVNGAIASKFRSSGQTCVCANRIFVHEKIYDEFAKKFVDKLKNETVLGNPLASGVTHGPVIHDRSMKKVRQHIEDAVDKGATILLGGSKRPDLGENFHDLTVLGDVTTEMLITQEETFGPVAPLIKFKTDDEVIKMANDTTVGLAGYFYANDVAKVFKIAEALNVGMLGVNTGAISEAALPFGGVGESGFGREGSKFGVEDYLVIKSAVLGGIEN

SEQ ID NO: 26651 - protein, 419 aa, Candida albicans SC5314
MQLSLSALTTVALALTSSLVDAKAHSIKLSKLSNEETLDASNFQEYTNSLANKYLNLFNTAHGNPSNFGLQHVLTNQEAEIPFVTPKKGGKYDAPLTNYLNAQYFTEIQIGTPGQPFKVILDTGSSNLWVPSQDCTSLACFLHAKYDHDASSTYKVNGSEFSIQYGSGSMEGYISQDVLTIGDLVIPGQDFAEATSEPGLAFAFGKFDGILGLAYDTISVNHIVPPIYNAINQGLLEKPQFGFYLGSTDKDENDGGLATFGGYDASLFQGKITWLPIRRKAYWEVLFEGIGLGDEYAELHKTGAAIDTGTSLITLPSSLAEIINAKIGATKSWSGQYQVDCAKRDSLPDLTLTFAGYNFTLTPYDYILEVSGSCISVFTPMDFPQPIGDLAIVGDAFLRKYYSIYDLDKNAVGLAPSKV

SEQ ID NO: 26652 - protein, 496 aa, Candida albicans SC5314
MAISIPSGLTLNLISSVSVICLGSLQFGYHMAELNSPELVLSCKRSQPGPVPYRDSFFGRNGFKQCIPMTPDQIGLVTSIFSIGGLFGSFYVGHLADKYGRKKTSLLHCLLYIIGSTINGLSNTYASLLLGRFICGLGAGSALVITSIYINEVSPIETKGLLGSMNQFSINIGILFTQLLSLNWSNDNDWRWLLFMAAFIAVANVIVVSSYLNESPVWLANQGDTAEAFTILHRLRGGSYSVATDEVNSWKSQGRGTTPESDMLLEEGNGNEHNSGTGSSGAPGGNSNKNLVTVVDYVTLPEYRNSLIASTGILVLQQFDGINSIIFYGVSVLVSIFPNHSIIINCLISLVNVIVTFISATIVDKLGRKPLLLLSVSFLGIATVLMGLGIIWTSSLLSIAGTFTYITFFAIGMGPIPFLLVGEVTQPIAKASAQSWGTSMNWIATFIVGYTFPVLKEWLGGSVYFIFTVMCCASVWFIKTKVPETKGKHSYQEVWN

SEQ ID NO: 26653 - protein, 436 aa, Candida albicans SC5314
MSSTPDFKVSSETAREYETKYSAHNYHPLPVVFSKAEGAHVWDPEGKEYLDFLSAYSAVNQGHCHPKIVAALVDQASKLTLCSRAFSSDVFGVYAKYITEYFNYEMVLPMNTGAEAVETGLKLARKWGYDKKGIPSGEAIILSAVNNFHGRTLGVISMSTDPDATTNFGPYLRGVGPQIPGEPEGTLLRYGVIEDVEKAFANAGDKIAAILLEPIQGEAGIVVPPEDYLPRVQELCKKHNVLLICDEIQTGIARTGKMLCYEHSKGVKPDIVLLGKAISGGVMPVSAVLSSKEVMSTLEPGSHGSTYGGNPLACRVAIAALDVVRDENLVERAQKLGALLREKLEELQKESNGMISEVRGKGLLSAIVIDESKTNGRTAWDLCLLMKNHGVLAKPTHDNIIRLAPPLVISEEDLLKGVDSIRKSLKELPNVAKTEH

SEQ ID NO: 26654 - protein, 440 aa, Candida albicans SC5314
MPSHFDTLQLHAGQPVEKPHQPRAPPIYATTSYVFNDSKHGAQLFGLETPGYIYSRIMNPTNDVFEQRIAALEGGIGALATSSGQSAQFLAIAGLAHAGDNIISTSYLYGGTYNQFKVAFKRLGIETKFVNGDAAEDFAKLIDDKTKAIYIETIGNPKYNVPDFEKITKLAHEHGIPVVVDNTFGAGGFLVNPIAHGADIVVHSATKWIGGHGTTIAGVIVDSGNFPWTEYPEKYPQFSKPSEGYHGLVLSDALGKAAYIGHLRIELLRDLGPALNPFGSFLLLQGLETLSLRVERQSENALKLAQWLEKNPNVESVSYLGLPSHESHELSKKYLNNDAKYFGGALAFTVKDITNTSSDPFNEASPKLVDNLEIASNLANVGDSKTLVIAPWFTTHQQLSDEEKLASGVTKGLIRVSTGTEYIDDIINDFEQAFKKVYNN

SEQ ID NO: 26655 - protein, 327 aa, Candida albicans SC5314
MLQPIGKPEVLDPYSIKNLPPLIIGGAVFNYQYSSDPHSLPVQELIERAFQLGLNALDTSPYYGPSEEIIGQALQKISFSRDQYYICTKAGRVKLDEFDYSRASVRSSVERSLQRLGTSYIDLVYMHDIEFVEPDQIMDALKELHLLKSEGLIKNFGISGYPVKFLYEIALRCKNEIAPLDAVLSYCNGCIQNTLLFEYHDKFLQDCGVQTVLNGSILSMSMLRSDITHSFHPASPALKQRVADIAEKLKEENVELADLATRFAIKEWLFKYKSGIVLGVSNLHELESAVQCYWDVKSGVFNDGKLVEQVQTSLAEHFNETWPSGNH

SEQ ID NO: 26656 - protein, 308 aa, Candida albicans SC5314
MSSISNVYHDYSSFSNATTFSQVYQNFNQLDNLNVFEKLWGSYYYYMANDLFATGLLFFLTHEIFYFGRCLPWAIIDRIPYFRKWKIQDEKIPSDKEQWECLKSVLTSHFLVEAFPIWFFHPLCQKIGISYQVPFPKITDMLIQWAVFFVLEDTWHYWFHRGLHYGVFYKYIHKQHHRYAAPFGLAAEYAHPVEVALLGLGTVGIPIVWCLITGNLHLFTVSIWIILRLFQAVDAHSGYEFPWSLHNFLPFWAGADHHDEHHHYFIGGYSSSFRWWDFILDTEAGPKAKKGREDKVKQNVEKLQKKNL

SEQ ID NO: 26657 - protein, 384 aa, Candida albicans SC5314
MSKVPAIYQLGHLPIKDHVFSPDRSILAITKGNDVEVYQISPSNLSSKPQLIAVLKDHDKTVTSVDISPDGSKILTCSQDRNALVWEYANGEYKPTLVLLRINRAATVCRWSPDGSKFAVGSSDRIIAVCYYEEENDWWVSKHLKKPLKSTITTIDWHPNGVLLACGSTDGHVRVFSGYIKGIDAKPDPSVWGTKLPFQTLCGDYTNETNAWIHGVKFSPDGNALAYVSHDSSVGFVYPQGEGLPPRAIFNVKTDNLPFKSVVWLNDQQVCAGGFTCNLVVFQGDEHGWQQAYQVEEQKDLTKEVPHSKLGEGDDDDEEISSHQALNMFKQMDLKGRVSKPSAGGKPAKALNTIHQNTINSIRNFDQGRVSTSGIDGKVVIFNV

SEQ ID NO: 26658 - protein, 343 aa, Candida albicans SC5314
MVKDKKLYDLLGVDPSANDQEIKKAYRKAALKYHPDKPTGDTEKFKEISEAFDILSNADKREIYDNYGLEAARGNAPAGDAGNPFAGAGGAGGPQFNFNTGGPGGFRSSTFSNADAFNIFSQMGGFGMGDDHGFTYSSSGAGGNPFGGAGFGGGMPGGFGGGRARQRPEPDVVSMPLPVSLEDLYKGATKKLKITRKNSNGTKEQKMIEVNIKAGWKSGTKINFANEGDYQPECGARQTIQFVIEEKPNPVFKREGNNLKMNVTLTFKESLCGFDKDVTTLDGRRIPLSRSQPIQPGTTSTYPGLGMPISKSPGQRGDLEIVYKVDYPVSLTPAQKKAIQDNF

SEQ ID NO: 26659 - protein, 384 aa, Candida albicans SC5314
MSKVPAIYQLGHLPIKDHVFSPDRSILAITKGNDVEVYQISPSNLSSKPQLIAVLKDHDKTVTSVDISPDGSKILTCSQDRNALVWEYANGEYKPTLVLLRINRAATVCRWSPDGSKFAVGSSDRIIAVCYYEEENDWWVSKHLKKPLKLTITTIDWHPNGVLLACGSTDGHVRVFSGYIKGIDAKPDPSVWGTKLPFQTLCGDYTNETNAWIHGVKFSPDGNALAYVSHDSSVGFVYPQGEGLPPRAIFNVKTDNLPFKSVVWLNDQQVCAGGFTCNLVVFQGDENGWQQAYQVEEQKDLTKEVPHSKLGEGDDDDEEISSHQALNMFKQMDLKGRVSKPSAGGKPAKALNTIHQNTINSIRNFDQGRVSTSGIDGKVVIFNV

SEQ ID NO: 26660 - protein, 386 aa, Candida albicans SC5314
MDIVLEICDYYLFDKVYADVFPKDGAVHEFLKPAIQSFSQIDFPSLPNLDSFDTNSTLISSNNFNISNVNPATIPSYLFSKIASYQDKSEIYGLAPKFFPATDFINTSFLARSNIFRETLSLFIITTIFGWLLYFIVAYLSYVFVFDKKIFNHPRYLKNQMSLEIKRATTAIPVMVLLTIPFFLLELNGYSFLYLDINECTGGYKAILWQIPKFILFTDCGIYFLHRWLHWPSVYKVLHKPHHKWIVCTPFASHAFHPVDGFFQSLPYHLYPLLFPLHKVLYLFLFTFVNFWTVMIHDGSYWSNDPVVNGTACHTVHHLYFNYNYGQFTTLWDRLGNSYRRPDDSLFVKDAKAEEEKKIWKEQTRKMEEIRGEVEGKVDDREYVEQ

SEQ ID NO: 26661 - protein, 426 aa, Candida albicans SC5314
MSNLTPIATYNLALQPFQPVPAIEDDFPISIRITLASLDPEAADDKAEPSSLRILKKSNSLLSDDYFEDDDDDEEEDDEEDELDDEEEEEEAEEEKSSKKSNGKKSSKKDEDEEEDDEEEDDEDNDEDDVSEYIVCTLSPKHQYQQTLDLTITPDEEVYFVVTGSYPIHLTGNYIEHPADQDEEDYDNEDEDYDDEYDLSPDEDEIIYGAPLDDEYDDEEESEEEGTPKIEEIVEEKEKVKESPKESKKRVAEESTSKKSKKAKKDEKKSVQFSKELEQGPTGSTLVEKDNKKATPTKDKKETPVKDDGDKKKKFPTKTLLGGVITEDRKIGSGATAKSGAKVGIRYIGKLKNGKVFDKNTSGKPFSFKLGKGECIKGFDLGVTGMAVGGERRVIIPPKMGYGSQALPGIPANSELTFDIKLVSLK

SEQ ID NO: 26662 - protein, 344 aa, Candida albicans SC5314
MSIDKSKMVTRLGKSGLKVNTVAIGTMRLGSNWMGYNGDIDECLKILKFCYDNGFRTFDTADVYSNGKSEELLGLFIKKYNIPRERIVILTKCYFPVNDSDDKNWEDFDPVDSLNGKGLSRKHILAAVEDSVKRLGTYIDVLQIHRLDHEVTYEEIMHSLNDVVEKGLTRYIGASSMKAWEFVELQNVAKANGWHQFISMQSHYSLLYREDDRELNDYCKKNGVGLIPWSPNSGGVLCRPFDSEKTQKFFENKDWASVFGLGEPREADKTIVNRVEELSVKYNATMMQISLAWCIAKGVIPIAGVSKFEQAEELVGIFNVNLTEEDIKYLDEPYHAKDLAKEVN

SEQ ID NO: 26663 - protein, 428 aa, Candida albicans SC5314
MSNLTPIATYNLALQPFQPVPAIEDDFPISIRITLASLDPEAADDKAEPSSLRILKKSNSLLSDDYFEDDDDDEEEDDEEDELDDEEEEEEAEEEKSSKKSNGKKSSKKDEDEEEDDEEEDDEDDDEDEDDVSEYIVCTLSPKHQYQQTLDLTITPDEEVYFVVTGSYPIHLTGNYIEHPADQDEEDYDDEDEDYDDEYDLSPDEDEIIYGAPLDDEYDDEEESEEEGTPKIEEIVEEKEKVKESPKESKKRVAEESTSKKSKKAKKDEKKSVQFSKELEQGPTGSTLVEKDNKKATPTKDKKETPVKDDGDKKKKFPTKTLLGGVITEDRKIGSGATAKSGAKVGIRYIGKLKNGKVFDKNTSGKPFSFKLGKGECIKGFDLGVTGMAVGGERRVIIPPKMGYGSQALPGIPANSELTFDIKLVSLK

SEQ ID NO: 26664 - protein, 131 aa, Candida albicans SC5314
MSGGKGKAGSSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQSLLPAKKAKAGAASQEL

SEQ ID NO: 26665 - protein, 261 aa, Candida albicans SC5314
MGVHKLIILRHGESQWNHENKFCGWIDIPLSQKGKQEAIYAGELIKKNHLDPDILYTSKLMRSIETGLTILEVLHKPWIDHIKTWRLNERHYGQYQGRDKHEVFVELGKDKEKFQYIRRDYHGLPPLIEYGQDKSIDEKYKDVLNKDILPRGESLSMVMDRLIPFFKYEILDNQMIQLNKTVLIVTHGSIVRSLIKYLNHVSDDDISKINVPTGIPLVFELNDRGELIKPYYYLDQEKAEKGIAKVKMEGLERKGQTDEKL

SEQ ID NO: 26666 - protein, 336 aa, Candida albicans SC5314
MKTKTTSSVTKVKSIRSSASASVATSTSTSPINPIWYILILIYLFGCFLLFLSAIGIQPHTITLPQFKFSNIPSASFIMSATAPFKTLSAKAAFQLDQELMSTGEFSIDQLMELAGLAVAKTIYKEYPPNEATTTTKNKFNPNKVLVLVGPGNNGGDGLVAARHLKLWNYDPIIYYPKRPASNQLYSRLIKQLQDLNVPELTTLTEVKHLLDSRDSKIKIIIDSIFGFSFKPPIREPFKDLINYLGQNHDHLPPIVSVDIPSGWDVDEGPGTEIDIQASCLISLTAPKPCAKLFVNSGPDKIHYLGGRFINPRIAKEYGIEDIVNKYQGDELIVKL

SEQ ID NO: 26667 - protein, 1349 aa, Candida albicans SC5314
MPHSRQPSISSSIMSQSNHNHPQKIGPWKLGKTLGRGATGRVLLATHQTTGQKAAVKVVSKSELQDEETEKNGDGLPYGIEREIIIMKLLTHPNVLRLYDVWETSKALYLVLEYVEGGELFDLLVERGPLPEVEAIKYFRQIILGTAYCHALGICHRDLKPENLLLDSQLNVKLADFGMAALESNGKLLETSCGSPHYAAPEIVSGLKYHGAASDVWSCGVILFALLTGRLPFDDENIRNLLLKVQAGNFEMPVDEVSREARDLIARMLEVDPMRRISTEKILRHPLLTKYPMSNEDLISEKSLPHPQTGYKSLGSVRNIDKQILSNLTILWNDRPEEEIVDCLLKDGSNPEKTFYALLMRYKHNQEDNTNNNSPKKSTSFNNKVVRSGSKYSLNGTPRRKRASHISVSRPTSFQYKSNPGAGATANRNSVARHSVASSANNSPRKSPYKSPYRSPYRSPYKSPSKRYSYNQSPTKSPYGRRSNSQRQFENEPLKAKPRNIYNEIVDAQSNFSLPPSLPPSLPSKDSRYMIDEPNQPQLQQPALSQVPENPIVDESPDLMQSAKISSGKRNSIIGKNNNNSNSNKRMSKRKSIRASMTTGLKRNSITMKLLSTYAKLSGDDDWEYMDKQTKRTSATFAALCDKIFNQEDYDEEDEQLVDPEEKEAKEYERLMELERKKHEAELKARRELEKKKRRQKRRSILSSKKLSIIVKNDADPNNSEQELVDEGIKQPKRQSKNLTALRALSEGNHASEELTLEDVENLKRRSASQPVPKRRQTPVLTRRPVSRLDPLWQAHENEQLDRAKDALEQEWRDSQKRSSTVSRKKVNRESMISVMDDIVEEDQGRVNRRSTRNTYYERERDYELPEPTVEDSNLTDDYMTEIRKSRLLNSQLNVRDPLNEKRKSEPKTLISNVQIPSVTRKSRNFTTSNKRLSVLSMYSTKESYRDLNSIINSPDENPEQHQNMNKPALRTSIADRLDKAGLAEPEYETETDGEDKVSVIDLDDHLADRRTSYYDGSGKRASRASTTKRYNVHSSSGQRPKSKVPDLPKNDYDDTFVSNSDEVHKRQYKSMVSDESSASDDVFDKIKLPDGKSTKSSIDELANGTSTSGHRKPKIRHSQPGPEMLIPHLNGGIESSQPMSKVRGNNSSGHDDSVPPPPPAHKVNKKPLDDKTNFPPPEVDPKRKGSFFRKLSWGSKKTIENNTNAATNTTTQQQLPSPAESKEEKPKSSFFRWFSSSNTPSAAEIRKFNTILPKHEMSTALFALLNSWSNFGLKDLRNDQVGYYITGAISKHNSFNLKSCKFRIKINQRDFNQKSEIVCVRVKGSKVTTDTLFSEIEKVLLKEGVLDK

SEQ ID NO: 26668 - protein, 369 aa, Candida albicans SC5314
MENNNTIPALFQPIKISDSITLPNRIGVSPMCMYSSSPTDNQATSFHFVHYGSFAVRGPALIILESIFVSENSGLSIHDLGLWNDDQAHSLRKIVDFIHDQDGICCIQLNHAGRKIVEGVPFQQIQHGWQEHCVGPSTEPFSDSHNTPRELTVNEINSIVEDFANAAWRAVEISKFDAIEIHCANGCLIHQFLSKLTNKRADQYGGSFENRVRFLLQIIENIKRKIETPIFLKFPMSDNCSDPEAWSTEDALKLADLVIDLGVKVIDVTSGGNVAHCKSRYLLNDDKQLPSQVPLARKLKSHIRNRCLIACSGGLDRDIFKLDEFIANGDFDIALIGKGFLKNTGLISRIADQLQAQFRTAPQYKLALS

SEQ ID NO: 26669 - protein, 298 aa, Candida albicans SC5314
MVVGESRAELLNWLNSTLGLNYTKIEQCGSGAAFCQLMDTIVGDVPLSKVKFNAKTEYEFRHNYKILQHVFVKNSITKTIDVEKLIRCKLQDNLELLQWIKRYASSNNVPMKTTVARQPPKQTTKPTTSSPGSSPINAGPSAAPLISKPRERKSNTPIGSRKTSSNGPINLTPTAVRSTNIAASKNNNRSGNGTIVNNGHVGAVSASEPEAVDAAAVGAAAAAAAPIDSGATSSIPEDFAIYSQHVESERDFYFNKLRAIEILVQHAKEMEGLSGDVLQFANEIEKIMYEEYVEDDEF

SEQ ID NO: 26670 - protein, 249 aa, Candida albicans SC5314
MSIEDLKNTVTKLQERIQELEKKAGIIPDVPKSVRMVLIGPPGAGKGTQAPNLKEKFCACHLATGDMLRAQVAAKTALGVEAKKIMDQGGLVSDEIMVNMIKSELENNQECSKGFILDGFPRTIPQAEKLDSMLESRKTPLEKAVELKIDDELLVARITGRLVHPASGRSYHKLFNPPKKDMTDDVTGEPLVQRSDDNEDALKKRLVTYHKQTEPIVAYYQKTGIWSGVDASQKPTKVWSDILKCLGQN

SEQ ID NO: 26671 - protein, 178 aa, Candida albicans SC5314
MVEFYFHDNKDTLENFTEDHNSGEPVSFDQLAEIGVIYKYITTQEELDALATEREYKNRDVVTLNLPAFNNDIDAYNAKMQQFYKEHYHEDEEIRYIAEGEGYFDVRDKQDRWIRAKLSPYDLLILPAGIYHRFTLTNAAKHVKAVRLFKDEPKWEAINRDTGKNTEARELYAKTIAV

SEQ ID NO: 26672 - protein, 229 aa, Candida albicans SC5314
MVKSNVESAWETMEDTFSEIQNKFHQIYKPIDTGKPDEDDETTKKESLDITDDSTLSVSPITQLLYLARSKFYDLTPLDNQKSPFPFKNLRGKVVLIVNVASRCGFSFQYNGLEQLNKRFANDDFVLLGVPCNQFLWQEPGTNDQIVTKCKKKYDVSFQILDKINVNGEQADPVYKFLKAQKEGLWGTNRVKWNFEKFLIDKNGRVVERYSTFTRPVAIIPKIEQLLES

SEQ ID NO: 26673 - protein, 144 aa, Candida albicans SC5314
MPEDYEKYRMGSSNESHQRSVQPISSSISKSNDKTKHQTDFVQDSDIIEASSINDEFGEVKRDLKARHVSMIAIGGTIGTGLFISTGSLLHTTGPVMSLISFLFVTTICFSVTQSLGEMAYLYPYFWFICSIRHSLGLQELWCC

SEQ ID NO: 26674 - protein, 348 aa, Candida albicans SC5314
MVCGAGKTGPVGFRYWRNGYAWGDGILVNNNGKYVAAFVSGLINSIFTFQGTELVAVTAGEASPRALRSAIRKVMFRILVFYVLCMLFMGLLVPYNDPKLTQDGGFTRNSPFLIAMEDSGTKVLPHIFNAVIVTTIISAGDSNIYSGSRILYGLAQAGVAPKFFLRTNKGGVPFFAVAFTAAFGALGYLACSSQGNKAFTWLLNITATAGLISWGFISVSHIRFMKTLKRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWAIVA

SEQ ID NO: 26675 - protein, 407 aa, Candida albicans SC5314
MTIESTNSFVVPSDTKLIDVTPLGSTKLFQPIKVGNNVLPQRIAYVPTTRFRASKDHIPSDLQLNYYNARSQYPGTLIITEATFASERGGIDLHVPGIYNDVQAKSWKKINEAIHGNGSFSSVQLWYLGRVANAKDLKDAGLPLIAPSAVYWDENSEKLAKEAGNELRALTEEEIDHIVEVEYPNAAKHALEAGFDYVEIHGAHGYLLDQFLNLASNKRTDKYGCGSIENRARLLLRVVDKLIEVVGANRLALRLSPWASFQGMEIEGEEIHSYILQQLQQRADNGQQLAYISLVEPRVTGIYDVSLKDQQGRSNEFAYKIWKGNFVRAGNYTYDAPEFKTLINDLKNDRTIIGFSRFFTSNPDLVEKLKLGKPLNYYNREEFYKYYNYGYNSYDESEKQVIGKPLA

SEQ ID NO: 26676 - protein, 171 aa, Candida albicans SC5314
MGNELLSTARIYTFKIPDAYNNVIDFDQFKNKVILIVNVASLCGFTPQYKELQLLYEKYHERGLEILGFPCNQFGNQEPLQEEEIVESCRRNFGVSFPIMKKTKVNIDCDGHESELYKYLKSEKPGEVGFKGVRWNFEKFIVNRKGEVVARFNSLITPLQLEGFIEQLLSE

SEQ ID NO: 26677 - protein, 1087 aa, Candida albicans SC5314
MLLKQIFLPFFVLFNAINAIDIYQNQVSRGTIDLSIGAITIHSGAYWSIIDNAISALVGTLTVQQDAGFYITGLNPLLGLQVELLGVLNSIKNDGIVSFNGLNSLVGPIYNLVGLSFQNNGEFYLSASGVAPPVFSITAADWHNNGLLVLAQAKRTSALANLGFPTGSIENQGSICLFGTAYQQLTSITGSGCISADRDSTIYIFSSLLPIATTQTLYLADRASSIVIQPVTLPATYTVRGFGNGNKVGISLPLLSVPLLGQPAYSYDPSSGVLTLRGLGVGLLSQRFQIGTGYDSSLLEIVTDDGAGLPTTLLGSVRYNGPVPNNAVPASCNCKYVPPSPGTDESSSLSSSTSEQSSSSATSVSASETSDTSSTQESSLSSEVSSTQEPSSSTPEPSSSSETSSTQESSSTEGPSSSTDSSTEASSSESSTAPSSSAEASSSTESSTEEPSSSTEGPSSSQESSSSEESSTQEPSSSTKESSSTEGPSSTEESSSTEGPSSSTDSSTDITSASSTDEQSSSGTGQSSTEDEPIDSTESDTSSATDSSTATDSSATNTDTNSESTDSSTATDTSSTDSNTASSTETNTDVTDSSTDSNTGATESSTATDTNTDATDSSTVSETGATDSSTATDTNTGATESSTDSNTGATDSSTATDTNTSATNTDTNTGSNTATNTDDNTATDTSSTETNTATNTDGTETNTGTTETNTDTSASNTDDNTGSNTATNTGGTDTNTDTNTGGTDTNTGTNTGGTDTKTGTNTATGTNTGATETNTATNTNGNGTNTNTGATDTATNTATGTNTNTGATDTNTNTNTGATVTNTATNTGDVSATKDIPSPTSTDEGSNNGGGSNNGSGSNNGSGNGSGSGSGSGDGSNNGSGNGSGSGNGSDNGSGSGSGSGNGSDNGSGSGSGSDNGSGSGNGSGSGSDNGSGSGNGSGSGSGSGSGSDNGSGSGSNNGSGNGSGNGAGSGSGNGSGSGSDNGSGNGSGSGSGSGSGSGSGSGSGSGSGNGSGSNNNNGSGSGSGSGNGQDNGIITSSIGQPGSSTSTQGPSSSNSATIPEQANSGNHIKFTLFNGLLIGLVPIVFM

SEQ ID NO: 26678 - protein, 1249 aa, Candida albicans SC5314
MHLFKRIALTLWLIISSTLAVVITEDRVDRGTISVNLGEVTVNSGASWSIINNAVTAFAGKINVQSGGGLYISSTSPLLALQVTLTSLLDSITNDGVISLDSRASLTASNYNLIGLSFTNNGEMYLAASGVLPSTMDLTAASWTNNGLIVAYQNQRSSGVLNLGTPLGAITNNGQICLYNQVYQQQTRIEGSGCITANKNSAIYISNAVLPVATTQNFYLQDSKSSMIVQAVSSTQTFNVYGFGNGNKIGITLPAVGIPPNPAYSYDVDTGILTVRAGLLSQKFNIGLGYYSLFFSVVTDNGAGLPSTILGSISYSGPVPSRNLPASCKIACKPVPTAPGTNPTEYTTTITTTNSAGNPLTETGVVDISTDSNGSWFTTTSIFPTTSQSSSSETVASSSQPDSSSTEPSAFPSSTGDSSAEPSITSDYSSSELSVVPSSASESASESSAEPSSASESASESGSESVASETSASESASEQSSTSESVSSEFASSDSSSEPSSASESSVESSSASEFVVPSSATETSVSESASESSAEPSSASESVASESAVSETSASESAAPSSASETSVSESAASSSASESFASESSVESSAVPSSASEFSTSESVASETPASETPASETPASESASEQSSTSESSAEISSASESSAEPSSAKSAISESASEFSAAPSSASQSSASQSSTNESSSQQSSAESSSTGTSSVSASAATSEYTATWTTTNSDGSVSTESGIISQSGSSFTTITTFVPDATSEYTTTWTTTNSDGSVSTESGIVSQSGSSFTTITTFAPDATSEYTTTWTTTNSDGSVSTESGVVSQSGTSLTTITTFAPDVTSEYTTTWTTTNSDGSVSTESGIVSQSGSSFTTITTFEPPVVCKRDDVNCGSSIGLSTPYYGNSSQPLSSTKMTDTSATQTVDSSLSSITDATTTQSVNSLETPVPTSGSGNGSNNGSDNGSNNGSNNGSNNGSGSGNGSNNGSNNGSGSGNGFNNGSDNGSNNGSGNASNNGSASGSGSDNGSDNGSDNGSDNGSNNGSNTDNGSNSGSDSGNGIDNGSGNGSSDGSDNGTTNGSGSGGESNNGSGNGSDNGSSPDNGSNNGSNNGSNNGSGDGIGTGSNSDTDNGSGNGSNNGSGSVNGSANGSGNGSNNGSNSGSNSDNGSNNSSGNGSSSDLGSVSGTGNGSNEGSSNESGANNGSNNGAGALPAATLSVVPSPSADSGSTSSASAMVIPNTNGSGKLLNGKVLTLSVLSSMVVVFL

SEQ ID NO: 26679 - protein, 1094 aa, Candida albicans SC5314
MAPHALPVSSKTTSEVDVTSSSSFSLIKANPFGLTTDPQEIKNTTYTSATTIINQTIYSIASKIFSYETVGDENLLDSNIQLWLQYQRLNAYGIVPFYNKFQVRSGAANAILGYFTKNGTNGQPVSTLLGSNGLNYMRTALSSATADKLPLALNVSAIDFNQDSLVSNYGEALNAARALSYPVFTPVDSNDALEIQHLAILNHFYSFFSGKPSVYLFDGPEFVKTFKKFENVLSTNDIFQLYQGLLDSAAGEVSIDAAFNALNKVTGKNYSQFEYVGSENPKTVFVVYGTHQSTQLSQIVSKLDVGLVKVRVPVPFNQEKLVQVIPQSTKKLVVLSSNDGLMADVTAGLFLGGRYHSLSLDEFNYPLDFKWTPVTVTKLLNEFVSLDFEKIFPVVKPADEILTANSSPEGSYLFWGKDNGIIVDTVDKLALSLSLDNSKNVAIRNTFDNGNGGGLFQSQIVSTTGPIRAVDAADVVVIEDLSLLQHYDILATAKPDASILYINQKSLTKEELIEKLPIEFKKDLAKNHNKLYAIDFSIIEKLDEANSATKGFSGEFLIQLAFWRSALPELGGFIVNKLLQANGNSFELLGTVLDNFINSVDENEGIKEIPVVPEWVDLKDEVKEAEEKKENEAEEKDKEQAEAETEAEEPKELPFFPIETSFFANPRNPIEAAEEINNTGYKSLAQKITFPEAYNVSKDLRPDLPVKNFVVKVQENKRLTPTEYSRNIFHIEFDTTGTGLTYDIGEALGIHGRNNSEAVEEFLKFYNVDGDSLVEVTNKDDSKIVEIRSARQALSETVDFLGKPPKRFYESLAEFATEEKEKAALTKLASAEGAEELKKRQEVDFDSYFDILQEFKSARPSFEELIKIIAPLKRREYSIASSQRIHPNAVHLLIVVVDWVDPKGRLRYGHCSKYLSDLKIGDELVVSVKPSVMKLPPLSTQPIVMSGLGTGLAPFKAFIEEKIWQKQQGMEIGDIYLYLGSRHKKEEYLYGELWEAYKDAGVLTHIGAAFSRDQPEKIYIQDRIRQTIEELTDAIVTKNGSFYLCGPTWPVPDITACLEDIVRNGAKKNGEEIKDVAKVVEDMKEDGRYILEVY

SEQ ID NO: 26680 - protein, 285 aa, Candida albicans SC5314
MSLISFLFVTTICFSVTQSLGEMATYIPVSGSFVQFITRWVSKSCGAANGWLYGWSWAITFGLELSIVGQVIQFWTDAIPLAAWISIFFVLLTALNLFPVKFYGEIEFWMASIKLTAVIGWIIYAFCMVCGAGKTGPVGFRYWRNGYAWGDGMIVSNNGKYAIAFINGLINAVFTFQGTELVAITAGEASPKALKSAIRKVMFRILVFYVLCMLFIGLLVPYNDPKLTEDGGFTRNSPFLIAMENSGTKVLPHIFNAVIVTTIISAGNSTVYAGSRIFYGLAESG

SEQ ID NO: 26681 - protein, 163 aa, Candida albicans SC5314
MSDFYEFAPNDIKGTPYSFKKLQGKVVLIVNVASKCGFTPQYKGLQDLKQKFADQPVEILGFPCNQFGHQEPGTNEEIEKYCREYFGVTFPVLSKVETNGKNAEPVYKFLKSQKPGLLGLHRIMWNFEKFLIDQDGNVVARFSSFTKPETIGLRIEEMLKHQA

SEQ ID NO: 26682 - protein, 161 aa, Candida albicans SC5314
MSQFYELAPKDAKGEPYPFEQLKGKVVLIVNVASKCGFTPQYKGLEELNKKFADQPVQILGFPCNQFGHQEPGSNEEIGSFCSLNYGVTFPVLDKIEVNGDNTDPVYKYLKSQKSGVLGLTRIKWNFEKFLIDQNGKVIERFSSLTSPESIGTKIEELLKK

SEQ ID NO: 26683 - protein, 229 aa, Candida albicans SC5314
MVKSNVESAWETMEDTFSEIQNKFHQIYKPIDTGKPDEDDETTKKESLDITDDSTLSVSPITQLLYLARSKFYDLTPLDNSKSPFPFKNLRGKVVLIVNVASRCGFSFQYNGLEQLNKRFANDDFVLLGVPCNQFLWQEPGTNDQIVTKCKKKYDVSFQILDKINVNGEQADPVYKFLKAQKEGLWGTNRVKWNFEKFLIDKNGRVVERYSTFTRPVAITPRIEQLLES

SEQ ID NO: 26684 - protein, 407 aa, Candida albicans SC5314
MTIESTNSFVVPSDTELIDVTPLGSTKLFQPIKVGNNVLPQRIAYVPTTRFRASKDHIPSDLQLNYYNARSQYPGTLIITEATFASERGGIDLHVPGIYNDVQAKSWKKINEAIHGNGSFSSVQLWYLGRVANAKDLKDAGLPLIAPSAVYWDENSEKLAKEAGNELRALTEEEIDHIVEVEYPNAAKHALEAGFDYVEIHGAHGYLLDQFLNLASNKRTDKYGCGSIENRARLLLRVVDKLIEVVGANRLALRLSPWASFQGMEIEGEEIHSYILQQLQQRADNGQQLAYISLVEPRVTGIYDVSLKDQQGRSNEFAYKIWKGNFVRAGNYTYDAPEFKTLINDLKNDRTIIGFSRFFTSNPDLVEKLKLGKPLNYYNREEFYKYYNYGYNSYDESEKQVIGKPLA

SEQ ID NO: 26685 - protein, 481 aa, Candida albicans SC5314
MRTKQQQQQQQQSNSSSGVANNQKSYGYTTRIKSNSSVTNGGNVGATLTESRIITNINELLPGLNDISDAFEALPIDLIRYFTLLKEIDAKCINTIPQINHLINQYITNLHQDKNVTTTTTTTTNDDNTIDLNKKLETRRLNLIKNKINEVIPCLEEKMHVTSVASDLLKKHMYRINQDYKLILLNNEIPQSIRIGPLNHPAMINDTHTTSSSSTTSTGNGTGGGGGTNNNHGGNNSVQSQRSESRREALAARKANKEDDRENNTATGGSGRKKKKEQNNNNNSTASGADGNNGSNGKKRNRDDKSNNTGSGNDLKKKKKSNNNDQSDNRRRGEDENGKGDGETSFNSGNAKNDPHGKLKTTTTGNLVGGSSTTTTVSSSSTTSSSATTTTTSSTTTTKNSGSTGASTATATGASGAKGSSSSSSGNNEPTYCYCNQVSFGEMVGCDGDDCKREWFHLPCIGFKNPPKGKWYCDDCLKKLK

SEQ ID NO: 26686 - protein, 477 aa, Candida albicans SC5314
MSTDHHSHPVEGHQFKKIFNRLSGQPESYSRKQNYTFGKTLGAGSFGIVRYARDNSTDEEVAVKIILKKALKGNESMIIDEMQLLEQLNNPHIVGFRDWFESKDKFYLVTQLATGGELFDRIVQKGRFTEHDASLVVLQMLEALEYLHNKDIVHRDIKPENILYLTSKDDSPIVLADFGIAKRLQNPNEKLTSSAGSFGYAAPEVILGTGHGKPCDIWSLGVVTYTLLCGYSPFRSENVQDFINEVKHNNAVIFHADYWKDVSKDARRFIIKALQFNPDNRPTATELLNDPWLVSIAKEYKETDLLPNFKQGFDAKKKFRQAIELVKLNNRIKKLKEWQTDEDDDPTEINLFNEHGSVEQRANPSTNDGLTIPGTTSPRRGESPLNTWKKFNDVINSLDTNRSKASLSSFKSPYDLAHSNRGTDVSNSGATNVGKSDTASSAFVQLVHAATANKEKVANYTEDEEGKEKKQKDGDKN

SEQ ID NO: 26687 - protein, 482 aa, Candida albicans SC5314
MRTKQQQQQQQQSNSSSGVANNQKSYGYTTRTKSNSSVTNGGNVGATLTESRIITNINELLPGLNDISDAFEALPIDLIRYFTLLKEIDAKCINTIPQINHLINQYITNLHQDKNVTTTTTTTTTNDDNTIDLNKKLETRRLNLIKNKINEVIPCLEEKMHVTSVASDLLKKHMYRINQDYKLILLNNEIPQSIRIGPLNHPAMINDTHTTSSSSTTSTGNGTGGGGGTNNNHGGNNSVQSQRSESRREALAARKANKEDDRENNTATGGSGRKKKKEQNNNNNSTASGADGNNGSNGKKRNRDDKSNNTGSGNDLKKKKKSNNNDQLDNRRRGEDENGKGDGETSFNSGNNKNDPHGKLKTTTTGNLVGGSSTTATVSSSSTTSSSATTTTTSSTTTTKNSGSTGASTATATGASGAKGSSSSSSGNNEPTYCYCNQVSFGEMVGCDGDDCKREWFHLPCIGFKNPPKGKWYCDDCLKKLK

SEQ ID NO: 26688 - protein, 470 aa, Candida albicans SC5314
MWKFFITLGVIFSICSAQLLDTVSFDSNWENLHYIRNVDLNKGFVKETDLIEIKNINSKPQDEYYFTINDGFDSVNELSVFSAFLNDNLLEVKVDEIVANKVFKLKLPVPIAPNSNVELKINYVYIDTLVPIPTKISMDAVQQLLFKTNKFPYSPYLTKEYTLSLTGMSKGQEMQLHIDVNATEGTPDLKPRVDNQTLKYGPIAEDIQAFTLSPMGLLYDHNRPVTKAVNLNRSIWLPASDVNKVSIEEYYELTHVGAALDSGFSRIDWMKGRYEGTRNHWALSHLELPLLDRDLDGYYYTDKVGVVSSHKVVKNHLLLSPRYPLFGGWNYNFTFGWSEDLSRFLHKLHDTSDEYIIKFPILNSLRDVTYGDVYLEFYLPENAEFQNVSSPIPFESITIDNELSYLDVSKGHTKVTVHYKNLFDDLHKLDVFVKYKYTKINFVYKIVRISGFVFIGLISYYLLGLLDLSI

SEQ ID NO: 26689 - protein, 495 aa, Candida albicans SC5314
MTTNPALAAAQASHNNIPTKQMNHSTSSSNGNGSNNSSVVGLHYKIGKKIGEGSFGVIFEGTNIINGVPVAIKFEPRKTEAPQLRDEYRTYKHLQGCDGIPNAYYFGQEGLHNILVIDLLGPSLEDLFDWCGRRFSVKTVVQVAIQMLTLVEEVHRHDLIYRDIKPDNFLIGRRGATDENNVHLIDFGMAKQYRDPRTKQHIPYREKKSLSGTARYMSINTHLGREQSRRDDLEALGHVFFYFLRGQLPWQGLKAPTNKQKYEKIGDKKRTTPAVTLCDGLPQQFAEYLDSVRSLPFDAEPPYEEYRMLLLSVLDDLGQACDGDMDWMHLNGGRGWDATINKKPNLHGYGHPNPPNERERRHRDQRRTRQHQQSQQVQQQQLQAQAQAQQLQQLQQAQQAQQQQQSQQHQPLSAAQLHQQKLQHLVNRPLPPIKQESQSAIQSGNGHHELLNNNLGDQHGGKHEGYSSRPDQYQQQQMVAEEEENKGFWSKLCCH

SEQ ID NO: 26690 - protein, 1162 aa, Candida albicans SC5314
MSHIDGDDHMTKDLIDSLESKDNDLSLVTSNTQIPDVEVANLTHDADEINQLFDTATNNVLPESNKKDKPIDTQDLHEDDPKAVPKTTSNGESTSNSNSVSPKLLPNDGKSTPKIQKELRRKSTFVPVTSNSKSLEPSEDDNNNNNNNNNNSRISAYARLDFENFTFFVQTLQVVLGRKSNDETLQQNVDVHLSSKKAISRRHAKIFYNFGTQRFEISILGRNGAFVDNVFVEKGLTIPLTDGNKIQIGDIPFKFVLPSNEPNEENNNQDSSEKQFNPSDAINLRSNLYSKSSSPQSSPKRKSQPSKKVKKEPVSASNTPKDIKPTPPVPTTAISPTTSSSSPTASISTSTNAATAATTTTPATTTAARKNSINRRNSLLKIRRLSNARRKSLAANDEINELLKDLGVTSIDEINEEDSELLDAQIQSLLDEDNENLGGIEDSLMKLAEFNESAIDDDDDEEEGNENSQADLDRLEKTMEHDAIDDEIKAIDSNLTLLDDEISKLTPLINDTNQGLLEEKETKKKQLEEEKRKKQLQQLQHKNSLAKFPRRSAPLMGKPASIQPPASSSIYSRINGLDKIGKTVSPRPPPPKLIAPVLRVTAEPSAIRSRPPLRAITVSDSSYIATFSYPKTIEEPSKYPKPKVKKEHHKKHSKKVYSLDEIPEPYRSKPNISFQIMITNVLKTEAARNGLIINEITEAIKEVYPYYKYCTDGWQFSINHCIKFTKIYKRLQKRGSEWLYAMDELYINERENIRIKQREIAKAKAKAEALRQEEIRQRQRLEAQKSLPHNIVGRNFASPYANTRVPPNQYNQFSQSSSSSSSSATTTTNGQYGSTTMVGGTSPQAGSIRAQLAAVRGNGNTPATTSTTPSLPAMNDPKTKKSLEYLQKELFTLYKARKLTYDTQTATSLITKAVATTIAQVNSIGAKAGAGDNALVFLVERAPEKVSKILDIALTKSIKEYEGIASKSPSQPATPGMRPAQLTTTSQSAATPTTTPQISNLQSLPVKPPISTPLPQVPQQQVSGVNIPGPIATPNIGVTSGVGNLGTTSIGTPTPTQIQSPATSVIPAMQSPQKPVSTPIPTSVPVPLPVPSAPLARPPSFGKPPGAGSSLSRPKAFGKPPGAGSSLSRPPTFLSNKPSYKRELEDDEEEGEQATNKIAKTE

SEQ ID NO: 26691 - protein, 1152 aa, Candida albicans SC5314
MSHIDGDDHMTKDLIDSLESKDNDLSLVTSNTQIPDVEVANLTHDADEINQLFDTATNNVLPESNKKDKPIDTQDLHEDDPKAVPKTTSNGESTSNSNSVSPKLLPNDGKSTPKIQKELRRKSTFVPVTSNSKSLEPSEDDNNNNNNNSRISAYARLDFENFTFFVQTLQVVLGRKSNDETLQQNVDVHLSSKKAISRRHAKIFYNFGTQRFEISILGRNGAFVDNVFVEKGLTIPLTDGNKIQIGDIPFKFVLPSNEPNEENNNQDSSEKQFNPSDAINLRSNLYSKSSSPQSSPKRKPQPSKKVKKEPVSASNTSKDIKPTPPVPTTAISPTASISTSTNAATAATATTPATTTAARKNSINRRNSLLKIRRLSNARRKSLAANDEINELLKDLGVTSIDEINEEDSELLDAQIQSLLDEDNENLGGIEDSLMKLAEFNESAIDDDDDEEEGNENSQADLDRLEKTMEHDAIDDEIKAIDSNLTLLDDEISKLTPLINDTNQGLLEEKETKKKQLEEEKRKKQLQQLQHKNSLAKFPRRSAPLMGKPASIQPPASSSIYSRINGLDKIGKTVSPRPPPPKLIAPVLRVTAEPSAIRSRPPLRAITVSDSSYIATFSYPKTIEEPSKYPKPKVKKEHHKKHSKKVYSLDEIPEPYRSKPNISFQIMITNVLKTEAARNGLIINEITEAIKEVYPYYKYCTDGWQFSINHCIKFTKIYKRLQKRGSEWLYAMDELYINERENIRIKQREIAKAKAKAEALRQEEIRQRQRLEAQKSLPHNIVGRNFASPYANTRVPPNQYNQFSQSSSSSSSSATTTTNGQYGSTTMVGGTSPQAGSIRAQLAAVRGNGNTPATTSTTPSLPAMNDPKTKKSLEYLQKELFTLYKARKLTYDTQTATSLITKAVATTIAQVNSIGAKAGAGDNALVFLVERAPEKVSKILDIALTKSIKEYEGIASKSPSQPATPGMRPAQLTTTSQSAATPTTTPQISNLQSLPVKPPISTPLPQVPQQQVSGVNIPGPIATPNIGVTSGVGNLGTTSIGTPTPTQIQSPATSVIPAMQSPQKPVSTPIPTSVPVPLPVPSAPLARPPSFGKPPGAGSSLSRPKAFGKPPGAGSSLSRPPTFLSNKPSYKRELEDDEEEGEQATNKIAKTE

SEQ ID NO: 26692 - protein, 297 aa, Candida albicans SC5314
MAQELTHPAIKDGWFAEISDTMWPGQAMSLKVEKVLHVEKSKYQDVLVFKSTTYGNVLVLDNCIQVTERDEFSYQEMITHLALNSHPNPKKALVIGGGDGGVLREILKHESIEEAWLCDIDETVIEVSKKYLPNMAKSYDDPRTRVHIGDGFKFLEEYKNQFDVIITDSSDPEGPAESLFQKPYFQLLKDALTEKGVITTQAENMWIHMDIISKLKKDCNEIFPVAEYAYTMIPTYPSGSIGFMVCSKDPNANVSKPIRFDWSDEFVAKNLKYYNKKIHEAAFVLPTWADQVLNKKD

SEQ ID NO: 26693 - protein, 384 aa, Candida albicans SC5314
MQLINQFSKSPPLLQFNSPNFKFIFKYSLLLFFLIIVIFLFLYPPSIYQIMSILPETQKVVLHRENGDYDVIEYSDFPTPKIESSHDIIVKNSYAGVNFIEAYFRKGIYKASLPYVFGREASGEVVAVGDEVSTLKVGDKIAYLSPNTFAQYTKITDDNYKYIKLPDNASDEELKIYGSLFLQGLTALTFVNEAYKVQKDDYILVWAAAGGVGKILVQLISQLGAHVIAVASTPEKLKIAQDLGAEFLINSTSDDIVEKVKEITNGEGVAASFDSVGKDTFEISLNSIKRKGTFVSYGNASGPVTPFPLSILSPKNIKIARPQLYAYIGNADEWDHYSTELLKLFESGKLKFDIFKTYDLKDYVQAAKDLEGRKTTGKLTLKIS

SEQ ID NO: 26694 - protein, 500 aa, Candida albicans SC5314
MKLLAKKTTFLVRFVSTTRPKSKVVTTTDEALKGIGSNITLLSGGFGLSGVPDTIINAMVNHPAIKNVTAVSNNAGLDGRGLSQLLVTGQITKMISSYIGGNRTFEKLYLTGQIDLELTPQGNLAERVRAGAAGIPAFYSSAGVGTWLEEGKLPVRYDSTGEKVLKTSDPREVREFNGRKYLLEPAIQGDVAIIKAFKADTLGNCWFRGAARNFNSVMGRNAKLTVVEAEHIVEPGEIAPEDVHLPAIYVDKIIQSTTPKDIELFTFSDEKSGNESNQKSEVELKRAKIVKRAAQEFKDGSFANLGIGMPTLAPNYLPDNIHVTLQSENGILGLGPYPKKGEEDPDLINAGKETVTLAPGASLFGSEESFGMIRGGKIDLTILGGLQVSSKGDLANWGLPGRVKGMGGAMDLVSNPSATRVVVVMEHVDKKGRPKILEECQFPLTGKRCVSRIITDLAVFDIIDEKLILVEIDPETTVDEVTSKTGAKFEVAKDLKKIEI

SEQ ID NO: 26695 - protein, 364 aa, Candida albicans SC5314
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHQNILTIQDMIFEEPKMSNRTDIITMRGSFYTVTPYMSSDLVGLLENPKIKLELGQIKCIMQQLLKGIQYVHNQKFLHRDIKAANILIGHDGVLKIADFGLARIYHGNVPRLGMGPGGGEKAYTGLVVTRWYRPPEILLGERKYTTAVDLWGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKI

SEQ ID NO: 26696 - protein, 1126 aa, Candida albicans SC5314
MVLNDFDLKTEALNERTTLHTSQNASSKNGSNKESVLAKYEETNQNDEIEGFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRSHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADEKEDTSGNFEFETIGPNKLAVVAESMDESDPFLNIDIENFDTNELEVQSKMEYLVVRLSRKLEQVHLGYEDAVPALVKVTGRMLHLVKKYPVSHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPSIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNELKKNDIVKIYYNLLLDPYWQSNALDSLHCWYKLEPSYIDLNSPMAVDCLVGGFLLPKVSNLESTLEIYFKLLTNNLPLTRDMSNMNVINSILIKLSLHDKKNPVIQLSYLKVLKCLINYLVDSKSSLPFAKPVVNTLQSLKSRQSSLLIEEVTTELLSVLK

SEQ ID NO: 26697 - protein, 219 aa, Candida albicans SC5314
MKPRFLSYTTRLLTKPFKVAIVGTGPGGFYTAHHLLNKSSPDVKLNIDFFEKLPTPYGLSRYGVAPDHPEVKNCEDHMINIMKDFGDSESRHKVRFLGNVEVGKDITLKELEDNYNSIVLAYGCTSADNKLSIPGADLPGVVPARQFVNWYNGHPDYYGENKYIPPPLDKVDTVSIIGNGNVALDVARILLADPREHWAKTDISVDAQQLLEKSTVKHV

SEQ ID NO: 26698 - protein, 329 aa, Candida albicans SC5314
MISSKSRPYSIARVYADVNENKPTEYWDYENHKIQWGLIKNYEIVSKIGRGKYSEVFQGVNVLNDEPCVIKVLKPVKLKKIYREVKILQNLTGGPNIIGLLDVVRDEQSKIPAFIFERVNNVDFRVLYPKFTIKDIQYYFTQLLIALDYSHSMGIIHRDVKPQNIMIDPMNKKLRLIDWGLAEFYHAGMDYNVRVASRYHKGPELLINLQQYDYSLDLWSVGCMLGAIIFKKEPLFRGDSNNDQLVQIAKVLGTENLMKYVNKYGIKLSSEYDDILGNYPRKPWKAFINNDNRHLISDEVLDLIDRLLTYDHQLRPTAKEAMEHPFFKI

SEQ ID NO: 26699 - protein, 1126 aa, Candida albicans SC5314
MVLNDFDLKTEALNERTTLHTSQNASSKNGSNKESVLAKYEETNQNDEIEGFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRSHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADNKEDTSNNFEFETIGPNKLAVVAESMDESDPFLNIDIENFDTNELEVQSKMEYLVVRLSRKLEQVHLGYEDAVPALVKVTGRMLHLVKKYPVSHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPSIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNELKKNDIVKIYYNLLLDPYWQSNALDSLHCWYKLEPSYIDLNSPMAVDCLVGGFLLPKVSNLESTLEIYFKLLTNNLPLTRDMSNMNVINSILIKLSLHDKKNPVIQLSYLKVLKCLINYLVDSKSSLPFAKPVVNTLQSLKSRQSSLLIEEVTTELLSVLK

SEQ ID NO: 26700 - protein, 486 aa, Candida albicans SC5314
MTKKYSSTDLKSSKLLHRDLNSPPIVIDHANGNNLFTQDHHQLFDSVGGAAVISVGHNNKEVIDAITTQLQKVSYLHTGEFTVPIAEELAHELINNLDSSSGYSGGDVDPSKKIAKVYFANSGSEANEAAIKLVMQYFYEQGKHTKTQFISRHQSYHGNCLGGMSLSGHIARRKPYESIIDQSRFHKVDPCYEFRYKQSNDESNESSDQYVKRLLEQLENKILQIGPENVAAFFAETIVGATTGCVPATPGYFKGVREICDKYDILLVLDEIMCGSGRTGTFFAWQQEQEGEEQGGKSIIPDITTCGKAITSGYCPLSCVFFNKKILDVLSNGSSCFNCGHTYQSFPIACAAAHAVQKIIKRDNLLDNVVKMGVILQELLMMKIDPLEIVANIRGRGLFWGIEFCKNKSTLEPFNPSCNVSIKIGEYTKRNGVVVYPGKGTIDGIKGDHILIAPSFTITKEEIEFIVDIVAKSIKEFIANEVDLFK

SEQ ID NO: 26701 - protein, 504 aa, Candida albicans SC5314
MSHSSLSWLSNFNVETVPSKYLRRSSIIGTIGPKTNNVDVLVKLRKAGLNVVRMNFSHGSYEYHQSVIDNARKSEEVYKGRPLAIALDTKGPEIRTGTTIGDKDYPIPPNHEMIFTTDDAYKTKCDDKVMYIDYKNITKVIAPGKIIYVDDGVLSFEVISVDDEQTLKVRSLNAGKISSHKGVNLPGTDVDLPALSEKDIADIKFGVKNKVHMIFASFIRTANDVLEIRKVLGEEGKDIQIISKIENQQGVNNFDEILEVTDGVMVARGDLGIEIPAPQVFVVQKQLIAKCNLAAKPVICATQMLESMTYNPRPTRAEVSDVGNAILDGADCVMLSGETAKGNYPVEAVSMMHNTCLTAEKAIAYPQLFNELRSLAKKPTATTETCAVAAVSAAYEQDAKAIVVLSTSGLSARLVSKYKPDVPILMVTRNERAAKFSHLYRGVYPFIYDKPSIENWQEDVENRLRWAVSEAVELGIISKGDSIVTVQGWTRGSGHSNTVRIVQA

SEQ ID NO: 26702 - protein, 284 aa, Candida albicans SC5314
MCCQIATLLDLDVVYVKPYEGLYCFQELADLDLARVLYSNVQFSEFHIQSFMYQILCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLEVEQILEQEFFKNLRNVHEEPSSKAIFDFSFEEKGKSIPQLKEILETEVRVFKEISKTGIE

SEQ ID NO: 26703 - protein, 221 aa, Candida albicans SC5314
MSNKQSNQRFAQFKLVLLGESAVGKSSIVHRFVKNTFDDMRESTIGAAFLTQTITIPESETTIKFEIWDTAGQERYKSLAPMYYRNANAALCVYDITSRSSFQKAQDWIKELKKQAPEGIVIALVGNKSDLDDEREVESSEVQEYVQEQNSDGCSIITAECSAKSGDGVLDVFNKIGRALPVDEVIDASRSRQGAGAGGRRPGGVDLNRPRGQVNQSNSCC

SEQ ID NO: 26704 - protein, 376 aa, Candida albicans SC5314
MYAGRFILGIGVGIEGGGVGVYISESVPSNKRGSLVSLYQLSIALGEVLGYAIAAIFYEVHGGWRFMVGSSLVFSTIVLIGLFFLPESPRYLVFKGKFGEAFNVFARLRDLGDRHSKIEFVQMVQAAEAERELRLTQNKSKVWFELVTIPRNRRALVYGIVMITLGQLTGINAVMYYLSTLMGRIGFSTKNSVFMSLVGGGSLLIGTIPAILYMDKFGRRVWGYNLVGFFVGLVLVGVGYSIDIETNLAAAEGVYLTGLILYMGFFGSYACLTWVVPAESFSLGTRSQGMTICSALLYLWAFTVTYNFNRMKVAMTYTGLTIGFYGGIAFLGFFYQVLFMPETKGKTLEEIDEIFEKPSRQLIKENLSGLKRFWGR

SEQ ID NO: 26705 - protein, 365 aa, Candida albicans SC5314
MLGRIAKRSISITTNTPLKLPFIPLVSETGFPGAIGNTPLLKLPRISESINRNIYAKAEFMNPGGSIKDRAALYIIKDAEEKGLIKPGGTIVEGTAGNTGIGLAHVCRARGYKCIIYMPNTQSQNKIETLRLLGAEVHPVPAVAFTDPENYNHQAKRHAERLDNAVWTNQFDNVANRQAHIETTGPEIWAQLDGKVDAFTCSTGTGGTFAGTTRYLKDISNGKVKAVLADPPGSVLYSYIKSGGKEMIRGGSSFTEGIGQGRVTDNLQPDLELVDDAVKIPDEDSIAMVYRLLDEEGLYLGGTGALNVAAAVEVAKSLPEGSNVVTVLADSAHKYADRIFSKKWLAEKGLYDAIPPHLQKYAVLD

SEQ ID NO: 26706 - protein, 499 aa, Candida albicans SC5314
MFKKALPLVSKLTTPKGITYNQPLGLFINNEYVHPKQQKTFEVISPSTEEKITDVYEALEEDIDTAVEAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 26707 - protein, 499 aa, Candida albicans SC5314
MFKKALPLVSKLTTPKGITYNQPLGLFINNEYVHPKQQKTFEVISPSTEEKITDVYEALEEDIDTAVAAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 26708 - protein, 453 aa, Candida albicans SC5314
MLRRLFPIRQLYTTTRAMASKSTDPTSLHNPYFYQKPGQKDIWSLINETAAQAQQESGEPIVNLGQGFFSYNPPEFAINAVEEALTKPQFNQYAHARGNPNLLKQVAEHYSRSYGRAVGVDEVQITTGANEGMFAIFFGFLTPGDEVIVFEPFFDQYIPNVEMTGAKIKYVEIKYPKKFDNEVVTGQDWEIDWEGLNNAITDKTKIIVINTPHNPIGKVFTEKELYKIGKLAVEHNLILVSDEVYENLYYTDKFPRPAALPQLPELAERTLTVGSAGKSFAATGWRVGYIQGPANLIKFVTAAHTRICFSTPAPLQQAVSQGFEQAEKSNYFENTRKEYEHKYKIFTKVFDDLGLPYTVAEGGYFVLVNLSKVKIPADYEFPGTISDRGTLDFKLAYWLIKEIGVVGIPPTEFLTESNRKGNGLENCVRFAVCKDDSVLEDAVERLKKLKDYL

SEQ ID NO: 26709 - protein, 392 aa, Candida albicans SC5314
MTISNSNLFKPIKVGNKTIKNRIAHLPTTRNRATDDHVPTDLMKKYYTDRAKSGSLLITEATLISLDQGVYPNVPGMWNKQQKDAWKEITDSVHSIGGTIAIQLWALGRVGNAKLLKDEGLPLTGVSPIYEHEKAEQDAIDAGNPIQELTQDQIKDIVYNQFANAVKLADEAGFDFIELHGANSYLFEQFIHPGTNKRTDKYGGSIENRARFLFEVVDHVSTIVDPAKLAIRLSPLNNFQVPFVNPEGQEDYSYIVEGLQKRADEGKGLAFIDVVEGRFTSDGGTEGCNVDFVGEIWKGPLLKGGNYTYDRKNEWKTIENDANADDRTLVGFGRYFIANPDLPARIQKGNELNDYDRSTFYNTDDYGYNTYPFYGEENKADPNIKVLGVALA

SEQ ID NO: 26710 - protein, 296 aa, Candida albicans SC5314
MLPFAWPYPPEQKDGYWGIPTSTIDWCEENYVISTYIAEALNTTTNSVFIALATFAIYHAFHNKLEPRFIFTAFGFLLVGVGSWLFHMTLRYHFQLLDELPMIYATCIPFWSVFSEFKTPRQSILVAVGIFTAANLLTVIYLYFRNPTIHQAAYGILNGFIILRSIQLNVKYVHDKTARAQLHKTSIFGVGIFLLGYFLWNLDIHFCDFARATRREWGIPYGFVLEGHGWWHIFTGIGVYYSLVYEEYLRCFLTGTEKYFQFTWIWGLPVVYCIDKQGLERYRSVQKLAEEDKKHI

SEQ ID NO: 26711 - protein, 432 aa, Candida albicans SC5314
MTVPYQVKPSDEIKGAPEVSYYTPEQPVPAGTFYPQSSDEVAPKIFQPLKIGKLALPNRIGVSPMCQYSADYNFEATPYHLIHYGSLVNRGPGITIVESTAVSPEGGLSPHDLGIWKDEQAEKLKPIVDYAHSQKQLIAIQLGHGGRKASGQPLFLHLEQVADKSVNGFADKAVAPSALAFRPNGNLPVPNELTKDEIKRVVKDFGAAARRAVEISGFDAVEIHGAHGYLINEFYSPISNKRTDEYGGSFENRTRFLKEVIDSVKSSIPNDVPVFLRISAAENSPDPEAWTIEDSKKLADILVEKGIALVDVSSGGNDYRQPPRSGISKELREPIHVPLSRAIKQHVGDKLLVSCVGGLEKDPELLNKYLEEGTFDLALIGRGFLRNPGLVWEFADKLGVRLHQALQLGWGFWPNKQQIVDLIERTSKLEVN

SEQ ID NO: 26712 - protein, 316 aa, Candida albicans SC5314
MAFGAPRGRGGPARGGRGGFGGGRGGRGGARGGGRGGARGGSRGGARGGARGGARGGARGGRGGARGGARGGAKVVIEPHRHAGVFIARGKEDLLVTRNIAPGESVYGEKRISVEEPAKEEGAAPTKIEYRVWNPFRSKLAAGIMGGIDELGIAPGKKVLYLGAASGTSVSHVADVVGPEGLVYAVEFSHRPGRELIGMAKKRPNVIPIIDDARHPQKYRMLIGMVDCVFADVAQPDQARIIALNSHLFLKDGGLVVISIKANCIDSTVDAETVFAREVQKLREERIKPLEQLTLEPYERDHCIVVGRYMRSGIKK

SEQ ID NO: 26713 - protein, 1060 aa, Candida albicans SC5314
MSEVNIDAGLFYKRLSIFQKQLTANNIPQALIIVGARSDDNTYKKSTVLQNWLLGYEFIHTAIYITDKKCIFITSEGKSKHLKHLTNQKPDLVELWIRTKDVEHNKQLFIKLLETMTKLDSKYGKILKDKYDGKFIDEWNQILNDDNNNNNNNTTNDHALSAVDLAVTVSQALAVKDSEEFNNTKIASNASVVMMDTFVNDMMIIVDDEKKITNSQLTDQIEDKIENNKWYLKTKLGKNLLQSIKDFDPEYLEYCYSPIIQSGGDYDLKPSAVSTDKPLIGEGVILSSIGLRYKSYCSNIARTFLIDPTSEMETNYDFLLQLQKYIVDNLLKDGVPANKVYQDTIDYIKKERPDLVNHFTKNCGWLLGMEFRDSTFILNAKTTDRKLTTGQIISLTIGFNNLSNDKNDKNDKNDNKTNHQKNKQTYALLLTDTIKITDDSSILLTNYSKDRAAISFSFNDDNETQKENNNNNNKRPGLSQTSNTTGLKLESTENTAILKSKLRHENTNADDANSEKLRQEIQIKLHEKRLQEGLARFSKADATDADDFKPIFKKYESYVRESQIPNSVNDLKIHIDYKNQTIILPISGRPVPFHINSYKSGSQNEEGDFTYLRLNFNSPGAGGNVTKKQELPYEDSPDNSFLRSITIRSRDRQRMVDVYKAIQDLKKDSVKREQEKKQMADVITQANLIELKGSRVKKLNNVFIRPTPDTKKIGGVLQIHENGLRYQSQPQSQSNFKNDQRVDVLFSNIKHLFFQPCKDELIVLIHCHLKNPIMIGKRKTFDVQFYREASDMAFDETGGRKRKYRYGDEDELQQEQEERRRKALLDKEFKGFAELIADSSHGMVDLDIPFRELGFQGVPFRSSVLCVPTRDCLVQLIDPPYLVVTLEEIEIAHLERVQFGLKNFDLVFVFKDFNKPVVHINTIPVELLEDVKSWLTDVDIPISEGQMNLNWVQIMKTVLADPYQFFIDGGWAFLTGQGESDEEEESDEESDFRVSDEDPQDEDEESDDYASEEESDDYSGSDDDGSGGGDDDDDDDSESGEDWDALERKAAKADRNSGFD

SEQ ID NO: 26714 - protein, 423 aa, Candida albicans SC5314
MMNIDQHHQLQQQHQQQMLQQQAQAQAQAQAQAQQQQQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 26715 - protein, 259 aa, Candida albicans SC5314
MFNRSIRISRSPLLRSRTILPRTFVTNTHRLSYRLKQRNPSTIFKQSAMTLITISQSLDEAYTKHKVIPEVVDQFDTQGLLSIEYGPTELVTLGNTLSVEGTQEVPKIQLTLNSPTEDGKIESISENDKFILVMTDPDAPSNSDHKWSEYLHWLVTDLKLPHTKNEDGEPEISHFIDVKEGRELVPYMGPGPPPKTGKHRYVFLLYKQDPNAGELTAPKDRPNWGTGVPSSGVKDWIEKNAPNSKLLSVNFFFAQNEDN

SEQ ID NO: 26716 - protein, 198 aa, Candida albicans SC5314
MVNGPAELRRKLVIVGDGACGKTCLLIVFSKGTFPEVYVPTVFENYVADVEVDGRKVELALWDTAGQEDYDRLRPLSYPDSNVILICFSVDSPDSLDNVLEKWISEVLHFCQGVPIILVGCKSDLRDDPHTIEALRQQQQQPVSTSEGQQVAQRIGAADYLECSAKTGRGVREVFEAATRASLRVKEKKEKKKKCVVL

SEQ ID NO: 26717 - protein, 273 aa, Candida albicans SC5314
MVAESSSIDNTPNDVEAQRPVYEPKYDDSVNVSPLKNHMIAFLGEFFGTFIFLWVAFVIAQIANQDPTIPDKGSDPMQLIMISFGFGFGVMMGVFMFFRVSGGNLNPAVTLTLVLAQAVPPIRGLFMMVAQMIAGMAAAGAASAMTPGPIAFTNGLGGGASKARGVFLEAFGTCILCLTVLMMAVEKSRATFMAPFVIGISLFLGHLICVYYTGAGLNPARSFGPCVAARSFPVYHWIYWVGPILGSVIAFAIWKIFKILKYETCNPGQDSDA

SEQ ID NO: 26718 - protein, 301 aa, Candida albicans SC5314
MAAFIAVANVIVVSSYLNESPVWLANQGDTAEAFTILHRLRGGSYSVATDEVNSWKSQGRGTTPESDMLLEEGNGNEHNSGTGSSGAPGGNSNKNLVTVVDYVTLPEYRNSLIASTGILVLQQFDGINSIIFYGVSVLVSIFPNHSIIINCLISLVNVIVTFISATIVDKLGRKPLLLLSVSFLGIATVLMGLGIIWTSSLLSIAGTFTYITFFAIGMGPIPFLLVGEVTQPIAKASAQSWGTSMNWIATFIVGYTFPVLKEWLGGSVYFIFTVMCCVSVWLIKTKVPETKGKHSYQEVWN

SEQ ID NO: 26719 - protein, 1038 aa, Candida albicans SC5314
MNAKLFVAWTVISCLMQLTMGLKVENNQDLEATFTRIKRSLVHQDIFEINPQITERAKPGHGNDGDDDNKECPPCFNCNLPNFECTQFSQCNTFTGMCECQDGFGGNDCSEPLCGSLGDGNSKRPVRKKKQCACKSGWSGINCNLCERDDVCDQFMPEGLKGTCYREGIIVNKFHQMCDVTNPKILSILDGKIPQATFSCNKTSENCNFQFWIDQVESFYCDLNKCKLDYDLNANTTHYNCEEVACKCLPDRMLCGKAGSIDISEFLTETIRGPGDFTCDVATKKCRFSEPSMNDLIQSVFGDPYITLQCKSGECIHKSEIPGYTLPDNPKFTLGNLFVIIGVLLVCILAVVSLLRNISESALFKKNGYEPLDSDPSVMNLNFEPTTLSFEDIKYEVTGGRQILNGVFGFVKPRECLAIMGGSGAGKTTLLDILAGKNKDGKIDGSIYVNGNPIDPKHYKSIIGFVDQEDHLIPTLTVYETVLNSALLRLPRDMSFGQKQARVIEVLNELRILGIKDRVIGSDFKRGISGGEKRRVSIACELVTSPSILFLDEPTSGLDSYNARNVIESLVKLSRDYERTVVFTIHQPRSNIVSLFDKLLLLSEGDLIYSGEMIKCNDFFTKNGYKCPPGYNIADYLIDITVDHNKIVKVSDADSSVAIASSSDLHDANVHAAFLSTRSESQVDTTSEWEHFAVHRDEYNTDIIGHRKSKGGEEETILRLRNKLPTLFIESPSAFEIKQEITNGKENPLPLTQGSQDIKKATIFTQITILASRTFKNLYRNPRLLLAHYVLSLAVGLFCGYLYYDVSNDISGFQNRLGLFFFLLAFFGFSALTGLHSFATERIIFIRERANNYYNPLSYYVSKLFCDIIPLRVLPPIILISIAYPLVGLTMEHNAFLKAILVLVLFNVSVALEMLIVGILVKEPGTSTMVGVLLLLMSLLFAGLFINSEDLNMQIKWLEWISVFHYAYESLSINEVKDLILREKKYGLSIEVPGAVILSTFGFDVGAFWKDISFLGGLSAVFLGLGYIFLFYFTVEKR

SEQ ID NO: 26720 - protein, 372 aa, Candida albicans SC5314
MKKSTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQEYMPSDLHNIIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQEALEHPYLNSYHEQLDEPVTSPIPIEEFDFDIDKKNLDTNDLKKQIFEIVMS

SEQ ID NO: 26721 - protein, 500 aa, Candida albicans SC5314
MPSLSDLDYENPVKIASTQIETVAIIGGGASGAIILDTLLKEPSNIKKIVVFERQKKLGGIWLFNKDIRSTPNDLIKSGSYNLENDPQLPNPFHKQQEKAKKILLPKNTQERFIETPSYYGITTNIIEKMMTYSDVNKWDVEGDAETRKYVEGSIVQDYIEKYFDKNLNDPRTELRLNSTVEDVERITRDDNSNGSDKIPYRFKLTVRNPQDDDHDVWYQEEFDTVVIATGHYHVPFIPHVPGLKTVQEKYPSKIQHAKFYRDSSSYKNKTVVVVGSRASGADLTKFIAREDGTTVYQSVRNFDNTKFVTQKTNVVKKPQIEKFESSKGSIKIVFEDGTLLENPDYVIYCTGYLFSYPYLNRLTNNQITEGITIPNLYQHTFLINEPLITIIGVPIDGISFRVFEYQAVLLARYLTGKISLPPRSKQSEWVNKRYEDKKNTRAYHTIGVLDAFNYSNDLIKLGEVSDKVEVGRKFPILSSDDILLYKEAGEKLKKFWDER

SEQ ID NO: 26722 - protein, 378 aa, Candida albicans SC5314
MNFGTSHSSSSKNSHNNNVVGLHYKIGKKIGEGSFGVIFEGVNILNNAQVAIKFEPRKCEAPQLRDEYRAYKQLQGSKGIPNAYYFGQEGVHNILVIDLLGPSLEDLFDWCGRRFSIKTVIQVAIQMIRLVEQVHQQNLIYRDIKPDNFLIGKPDTPEANQIFFVDFGMAKQYRDPRTKQHIPYREKKALSGTARYMSINTHLGREQSRRDDLESLGHVFMYFLRGALPWQGLKAPTNKQKYEKIGMKKQTTSINELCYGFPIQFAQYLTYVRNLKFDETPDYQYLVGLMEKASISAGIELDGHFDWMDLNGGKGWDAALNKKANLHGYGNPYPHPSQGQRRAAATTAGTISTTTIITKISTIQFTPSTITWEFSFKR

SEQ ID NO: 26723 - protein, 216 aa, Candida albicans SC5314
MSQHPAPATAVKLVLLGEAAVGKSSLVLRFVSNDFQENKEPTIGAAFLTQKCTIGERTIKYEIWDTAGQERFASLAPMYYRNAQAAIVVYDITKPASFIKARHWVKELHEQANRDITIALVGNKLDLVEDDSAEDGETLRKVSVEEGQSLADEEGLLFFETSAKTGNNVNEVFVGIGSKIPSVTVTGGEAQEGSNGRRIDLTANTDNANAPRSTCC

SEQ ID NO: 26724 - protein, 399 aa, Candida albicans SC5314
MTIESSTNYSFGTKAIHAGAPLDPSTGAVIEPISLSTTFAQSEPSKPLGIYEYSRSSNPNRDNFEIAVAALESAKYAIALSSGSATTALVIQSLPINSHIVSSGDVYGGTHRYFTKVANTHGVEAQFVGNLVEDLQGALRENTRLVWLETPSNPTLQVTDIAKVKSILVDHEAKTGNKVLLAVDNTFLSPYLSNPLTHGADVVVHSVTKYINGHSDVVMGVLATNDSQLHERFRFLQNAIGSIPSPFDSWLAHRGLKTLHLRVRQASNSAQRIAEYLSQHSAVLKVNYPGLKSHRNHDVVLRQQRDGLGGGMISFRIAGGAKGAAVFTSSTKLFTLAESLGGIESLIEVPAIMTHGGIPKEEREANGVYDDLVRVSVGIEDTEDLLKDIEQALQKAASV

SEQ ID NO: 26725 - protein, 511 aa, Candida albicans SC5314
MGTAWELTQALKDQIFKYASFNQTPVSLRQMVQFGPVPSPGSIFLASRFIVEELPIRLAKKVKDLENAPLGLNEMPSTIQVKNWYAQSFQELTELHKPKISDELAKLLSKGASKHSLPEDSINEKPHTKQEIHRIPDSLEDNPAINNIFSDDGIVVRHHHHHHSISRARPRLNDNTQTRVESPTYGMSYFNPCPGNIVWPKEVYDYNKLVRETLEIIKKRHDATVATMAQGVQEWKNKNQTVMVNSQIQTFLDRFYMSRIGIRMLIGQHIALNMAQNSPTKQRLSSLINGSQGTTKKPRSNYVGVICTDCNVGEIAEDAIETAKYICEEYYGLFEAPEIQLIAPQQDINFMYVPGHLIHMLFETLKNSLRATIEFHTPKLKQKLIDEDPNLKFDEIDINDLKFPPIKVIISEGTEDIAIKISDEGGGIPRSSLPLIWTYLYTTVNETPKLEPEYDQTSFKAPMAGFGYGLPISRLYAQYFGGDLKLISMEGYGTDVYLHLNRLSSSNEPLP

SEQ ID NO: 26726 - protein, 400 aa, Candida albicans SC5314
MEIESDIPKIPDFQLSEKQFLLQHTDLEEKDRQHIIEEILQAIKKDHLAPYYHYLHTEISDFPYDESLYRELASENEKVIEELKSKIKEAEDEEDTELDVASTTTKLAEYYTKIIDRKNATETFKKVLELTPNTGSKIDHLLTLTRIDFFFNDLPSVQKHLEQIGQLSEKGGDWERRNRFKAYNGIYMLATRNFAEAAKLLIDSLATFTSTELCSYEAIAHCAIVAGVLSLERVDLKNKIIDSPEILSIASTTPNLEPLLNLTNSLYTCEYNCFFQYLLESYEKLLLPNKYLYKHANFFLREMRCKAYNQLLESYKSLSLKSMATNFNISEEFLDQDLCKFIPNKKLNCTIDKVNGIIETNRPDNKNNQYHALIKQGDNLLTKLQKYGAAVKLSGAERVA

SEQ ID NO: 26727 - protein, 383 aa, Candida albicans SC5314
MTRLATDSIHGGDHLKRVIDVINPIHISTTYSYSNNPDELVPGGLTDPNTLVYSRENHPNAAQIEAIIEKITGYPAVIYNSGLGAFNGLITYVNPKTMAFGQIYHGVHGIADIWTRNFGLKQIGIDDNFDGVLQKGDLVHLETPVNPYGTNLDISKYAERAHAQGALLSVDATFAPPPLMNPFDFGADIVMHSATKFFGGHSDLLAGILLVKSQEIKNKLLLDRLVLGTNIGNLESALLMRSLRTFELRIRRQSATAEFIVKYIAENKDKFPDLETIYHGSLQDDEYIKKQMPIGQSPVFSIELVSEDKAKRLPSKLKLFHHATSLGGTESLIEWRAMSDDHISKKLLRVSIGLEDPRDLLADFVHGLGGDDDLVKQIENLEI

SEQ ID NO: 26728 - protein, 461 aa, Candida albicans SC5314
MVKDTTYYDILQVEVTATDVELKKAYRKQAIKLHPDKNANDPKAAEKFQELGEAYGILSNPESRKIYDEFGVEGMKENPTMQQAADIDPAEFFNMIFGGDSFKQWIGELSMLNDMSRMGEIITEDEVELDNVEEESKSGKQHGATDSLNESVQTLTISDNNNNNNTKVSSSNNKPTSNLTSEEIKKLKKQKINEQQREQMLKYQEEAKQAKLKRIDDLTSALLKRIENYQLSKNNKEALDSFTRKLQTEFEDMKIESFGIQLLHLIGKIYIDKANATIHASKTFGVSKIFTSVKSKTETVKNGYSILKTAVDAQLSIEQMVKEQEQFLLAQEEGHQPTQEELVKQAEMERIITGKFLATAWATTKFEVTDILRKVCHNVLRDKTISKKERVARAEALLYIGKEMSKVERSPEEEEEARIFEEMMAEAQAKKSSKKQKSMNNKELEEYMKKMAAENAEAEEN

SEQ ID NO: 26729 - protein, 510 aa, Candida albicans SC5314
MSEPTQDQPQEQQSQEQQQQEQQQQQQQQQQQEHQPEQQQSTESSENESQQAQQPSSQDDEKQVNAASAKEGGREVSNKILYVGNLPKSASEETIQELFSVGGNPVKTIKILNDKNKAGFNYAFIEYDTNEVADMALNTLNGRLVDDVEIKVNWAFQSAAIAGNPNNTEEPLFNIFVGDLSPEVNDEGLRNAFSKFESLKQAHVMWDMQTSRSRGYGFVTFGNQSDAELALQTMNGEWLCGRAIRCNWASHKQQQQQQHYNNQHGGGYSRGYRNNNGGNNNNRQFRQFNNINNGNNNGFSQPLVNNNPQFIGQQPPQPDQHQHQQQQQQQQQQQSVNGANGVPQQMLQGLTNGNLGPGTPINGSNNAAGGFNNNGTAGNVAGAPVAGGPGAIPVMSPQSYDIVLRQTPSWQTTVYLGNIAHFTQQQELIPLLQNFGFIVDFKFHPERGCAFVKYDTHERAALAIIQLAGFNLNGRPLKCGWGKERPPQFQNFPRNGNMHQVPMYGPGGRP

SEQ ID NO: 26730 - protein, 361 aa, Candida albicans SC5314
MKLLALLTLLPLVISTNLEEKWGGLWPFQGIATFAHLEHFQCLIESEKQFDIGIIGVPFDTAVSYRPGARFGPRAIRDASQRQNNLRGFNPKALFDPYQSWARIIDCGDIPVTPMDNSAAYKQMSEAFKDLLNRKSSNNTEIPPRYIALGGDHSVLLPHIRALHKIYGPVNIIHFDAHLDTWKPNKYPTSEKNDINHGSMLWKAYEEGLTTKHNIHVGVRTRLSELDDLQDDDEQNFVRIEADDIWLKGPQWVVDKILATIPKDTATYISVDVDVLDPGFTSGTGTQEPGGFLPRELIYLLRSIDGLTVVGADVVEVSPAYDIAEITATNGAQIAYEVLTSMVKRGNIDKSLVKSVVHVFD

SEQ ID NO: 26731 - protein, 406 aa, Candida albicans SC5314
MTVESTNSFVVPAGTKQIEIAPLGSTKLFQPIKVGKNILPHRVAHAPTTRFRAAKNHTPSDLQLEYYKTHSQYPGTLIITEATFTSEQGGMDLHVPGIYNDAQTKAWKKINDEIHANGSFSSMQLWYLGRVANPKDLKDAGLPLIGPSAVYWDKESEKLAKSIGNELRELTEKEIDHIVEVEYPNAAKRAIEAGFDYIEVHSAPGYFLDQFLNPASNKRTDKYGGSIENRARLLLRIIDKLIGIVGAEKLAVRLAPWSSFLGMEIEGEEIHSYILQQLQQRADNGQQLAYVSLIEPRVIGIFDASLEHQKGRSNEFAYKYWKGNFVRAGNYTYDAPEFKTLLHDLDNDRTIVAFARFFTSNPDLVEKLKLGKPLNHYDREEFYKYYNYGYNSYDESEKQVIGKPLV

SEQ ID NO: 26732 - protein, 249 aa, Candida albicans SC5314
MSIEDLKNTVTKLQERIQELEKKAGIIPDVPKSVRMVLIGPPGSGKGTQAPNLKEKFCACHLATGDMLRAQVAAKTALGVEAKKIMDQGGLVSDEIMVNMIKSELENNQECSKGFILDGFPRTIPQAEKLDSMLESRKTPLEKAVELKIDDELLVARITGRLVHPASGRSYHKLFNPPKKDMTDDVTGEPLVQRSDDNEDALKKRLVTYHKQTEPIVAYYQKTGIWSGVDASQKPTKVWSDILKCLGQN

SEQ ID NO: 26733 - protein, 361 aa, Candida albicans SC5314
MKLLALLTLLPLVISTNLEEKWGGLWPFQGIATFAHLEHFQCLIESEKQFDIGIIGVPFDTAVSYRPGARFGPRAIRDASQRQNNLRGFNPKALFDPYQSWARIIDCGDIPVTPMDNSAAYKQMSEAFKDLLNRKSLNNTEIPPRYIALGGDHSVLLPHIRALHKIYGPVNIIHFDAHLDTWKPNKYPTSEKNDINHGSMLWKAYEEGLTTKHNIHVGVRTRLSGLEDLQDDDEQNFVRIEADDIWLKGPQWVVDKILATIPKDTATYISVDVDVLDPGFTSGTGTQEPGGFLPRELIYLLRSINGLTVVGADVVEVSPAYDIAEITATNGAQIAYEVLTSMVKRGNIDKSLVKSVVHVFD

SEQ ID NO: 26734 - protein, 406 aa, Candida albicans SC5314
MTVESTNSFVVPAGTKQIEIAPLGSTKLFQPIKVGKNILPHRVAHAPTTRFRAAKNHTPSDLQLEYYKTHSQYPGTLIITEATFTSEQGGMDLHVPGIYNDAQTKAWKKINDEIHANGSFSSMQLWYLGRVANPKDLKDAGLPLIGPSAVYWDEESEKLAKSVGNELRELTEKEIDHIVEVEYPNAAKRAIEAGFDYIEVHSAPGYFLDQFLNPASNKRTDKYGGSIENRARLLLRIIDKLIGIVGAEKLAVRLAPWSSFLGMEIEGEEIHSYILQQLQQRADNGQQLAYVSLIEPRVIGIFDASLEDQKGRSNEFAYKYWKGNFVRAGNYTYDAPEFKTLLHDLDNDRTIVGFARFFTSNPDLVEKLKLGKPLNHYDREEFYKYYNYGYNSYDESEKQVIGKPLV

SEQ ID NO: 26735 - protein, 413 aa, Candida albicans SC5314
MSNSNPLKDSLVFQPIKVGDNTLSNRIVYCPTTRFRAAKGNEEPTYRHVPSDLMLKYYSDRAQYPGTLLVTEATLISNRAGGYDGCPKISTQEETKAWKKIVDAVHSKGSFLSCQFWFLGRVGYPSLLKHRKLDYLAPSPIYENEKHQKQAEKAGLPLREVTEQEIHDIIYNDYTIAAKNAIAAGFDFIELHGAHGYFIDQFLHECSNQRTDKYGGSIENRCRFVLELIDHLITIVGAHRLAIRLSPWAEVQGIVEKESPIPTFSYLINELQKRADQGNQLAYLSVVEPRVQGTITADIKTMKGDNEFVAEIWKGVLLRAGNYTYDAPEFKGIVADTSNNRTLVGFSRFFISNPDLVSKLKNNPSSLVKYDRKLFYEQFNWGYNTYGQDQPVDEEKERKKFPKVIGNIDEARL

SEQ ID NO: 26736 - protein, 403 aa, Candida albicans SC5314
MTIDNEGIVIKPLGSTKLFQPIKLGFNTLSQRIAFAPSTRYRATKDNIPTDLQLEYYSQRSEYPGTLIITEATYTSRQGGLVPYVPGIYNDAQTKSWKKINDAIHANGSFSSVQLWYLGRVANPKNLKDAGLPFVGASSVYWNEESEKLAKEAGNELRELTEEEIDHIVEVEYPNAAKRAIEAGFDYIEVHSAHGYLLDQFLNLASNKRTDKYGCGSIENRARLLLRIIDKLIDIVGAERLAIRLSPWATFQNVDVEGEEIHSYIIDQLQERANSGNELAYISLVEPRVQASWDIAKENQVGSNEFILKHWKGKVIRAGTYAHELNKINEDINNDRTLIAFSRFFISNPDLVKKLHDGISLTPYERATFYNHDNFGYNTWIKYGENKVFNEQEERKKLGKPLA

SEQ ID NO: 26737 - protein, 415 aa, Candida albicans SC5314
MVEKRIAIVGGGPSGIITLRSLLDEGFTSVTLFERKNKLGGCWNLTPPEQINFEQLSKKQWDVDPIPETIPTTVPHTTVQRFMDTATYPYLETNVEDIAMEFDKPFPKDTISKHGKDSPFRHFTEINQYLHDLADLKYVTFDTSVELIEKKNEQWRLVLRKFGQTQDYIYEEFFDNVVVASGHFDVPFVPEIPGLQQFSELDDTLVIHSKQFRSRDDFKDKQVVVVGASVSAMDSIRDILPVAKRAITSQKPTTEPHVYFGTEAFDHDGIEKRGQIVKIEDHTIHFHDGTSTFADAIILGTGFLYHYPFLPKFPELKELIFDANDPSLAFVGHNTPGLTFKLFQWQAILVARVFAGKGNVPTTIRNDPTIHPDFNQYYETLREASCGALPKWNPVWEEAFYRGHLRRRQYWLDNP

SEQ ID NO: 26738 - protein, 1320 aa, Candida albicans SC5314
MKSQSTDTLQPRISSDSLVYSSSSSSSNVYSQPKLPFARSYSSIPEQVHDPGSRQSSKNSNTNFSFSEHDDSIQEFLISPIQSDIFPYSKKPVISPVLESPEAGGDSTIVETSSPSPTKSGTVSLNSNAIGSIIGSYDYSKSSLELEKPKPVEEPVFQKDHARDHARQGSDASTISNGSEQVSKDKRFVRYAMNTQSPLVNASNKWQISNVIKWLDKNQFNNSWKETFRRNEISGNRFLELENFDKESMIWKQFSKFLQLDDDLNSVDRFIELLRKESSHELQTRKSLGGGEISPINVKHENRKSTPIYTKHMSTSSVSSSNSSSSISRPLSYVDSKPKEQLSSPSHHSFFRKHSRSTSNESKDAKKRYSSFDDNRVKSVPKNDKKSNGILSTLRKYGGDKIAKNTKQRSSTYFPSLDLPPPLESDPPAYNERKISVDSELSPKSIKSFSDDLSIDPKYLPTQHQELDLRKFHDCEPITILASKDNISFVPIVITELSNAKSHIIKALGLIDIGSITLHLTDFFHKEGEAIPDFLIPKVLKLDGLLKFYVRQELKSPEGTTTTFSTTSSDSKSYIADGNKTYPETPQYLLQAQHDSRVDYWNFKDLTSISEDPSKSLAGAKQNIDSKRNDTKQKPKEFPLKFPFANAPKKGNTVPQLQIDTSGVNNISKPPTSTGSTFQVLRKKGHEIDFDKRRKSPYESKTPKIIANIYSSSVANTKKSPISASTVMALKDDVVVQRPETISRSNSIIAKRTAPPPPGDRRVQIQRQNSILRRKPGLKSTNNVTSGSSEGSKKNISDSTDDNDSEDAFFVKPLKKKENELGNNSDNNSENDEDNDSDDDFFVKPIKKEVADVSAGKVELDDSEEDFFVKPIHKKPSHMNVRPPVEEVYNNLEKYFPYTNLDKPIIDDSPASPSPQRRPTISRTFSSANKSPVAPTSADSKNTNDEQPSLRVRRMKTIRGVANEARRKVLQMKQASPPNTFANITRENSAKLTRSNTKMWGQRVVEVTSQEIEKGFVSKLRNKNGLYQEYAWIKGELIGRGSFGDVYLGLNVTTGEMLAVKQVVCGRNNKEGIEALHKEVETMKDLNHMNIVQYLGYDQQKNIYSLFLEYVAGGSIALCLKSYGKFDETLIRFITKQILLGLEYLHSNNIIHRDLKADNLLLEVDGTCKISDFGISKRSNDIYANNANMSMQGTIFWMAPEVIDSMVEGYSAKIDIWSLGCVVLEMFAGKRPWSNEAAISVIYKTGKEKLAPPIPDDIAHLVSPVAESFINRCFTIDPKDRPTAGELLNDPFVNTLDHDFNFANTKLAEMIRYNSKRLFT

SEQ ID NO: 26739 - protein, 265 aa, Candida albicans SC5314
MGRSMGALSVPPNPKYQEPFSPLIPGVKIAKPNDIESVKQVINKDKTCAVIIEPLQGEGGVNIIDESFLIELRKLCDENNVLLIYDEIQCGLGRTGKLWAHSWLSPEAHPDIVTIAKALGNGFPIGATMITEKVEKSLNVGDHGTTYGGNPLASTVGSYIVDHIGDKEFLQQVENKSQIFLEGLNKIAEENSNLIEKVKGKGLLLGLQFKENVDIGEIVAKCRQHGLLIITAGMNTIRLVPALNIPDQTIKDGLEILTQSIKEVN

SEQ ID NO: 26740 - protein, 498 aa, Candida albicans SC5314
MTTNSIGSELPIAIEMINPPNSTRNDKFDELVLDYFIHEGYEDAAIKYSCRRKANANDIDQEIENRGNNRYDISGNKKDQISPPTSSLFIDNMNRLSNDKEFSDMVISYFNNPSGKHNNNESTDKHNNNNGGSESASFPDITDVGAINNRDKKTESGFATIKQRQEIKKLILNGDISQAIKQISQYYPMILDLNNLLHFKLLRLNLVEMIRNHKFNTKSSNDSMDAGQDEREFLATILNFVRENLINKVFNSFKLLKELEITMSLLCFKFDPTIENLQDQADLPVELKKLFDLSLRYQCYRLVNNAILKLYNNEYTDVSIATTNKDMLRSKSPFSDSYYLTNDETVQELLEDREESNKRKMTRTYHGPKFAEFDLSNYKHKSRQQQQGINYESSDFVTLEEQQRNNEQEELEAVDEEDEDDEEEIGYHINPDVNLYSNGDADKDMKDSSIDNIGTENEDEMNRIINLSLDSRLERVIKLWLLTEQRMKDLNIVVTNRN

SEQ ID NO: 26741 - protein, 455 aa, Candida albicans SC5314
MLRTYSKSLLKTSTTIKKSFSFNTATLSLPTYKKYSTSVPDANDESHTGKFINSISKPYSVTTYARPNLVLTHGKGSYIYDLEDRKYIDFTSGIAVTCLGHSYEPITQLIKDQSEKLIHCSNLYYNLPAGELSNKLIVKTKEFDGMKDASRVFLCNSGTEANEAALKFARKYGKSINPEKYEFITFENSFHGRSMGALSVTPNPKYQEPFSPLIPGVKIAKPNDIESVKQVINKDKTCAVIIEPLQGEGGVNIIDESFLIELRKLCDENNVLLIYDEIQCGLGRTGKLWAHSWLSPEAHPDIVTIAKALGNGFPIGATMITEKVEKSLNVGDHGTTYGGNPLASTVGSYIVDHIGDKEFLQQVENKSQIFLEGLNKIAEENPNLIEKVKGKGLLLGLQFKENVDIGEIVAKCRQHGLLIITAGMNTIRLVPALNIPDQTIKDGLEILTQSIKEVN

SEQ ID NO: 26742 - protein, 1484 aa, Candida albicans SC5314
MSDIPPTNESNSDSTLINQNNNGNNDNKETGKDISSTHTHHRVTFAEQQPISTSSRKSSLLRKHSSNNTSSDSDKRPSIISRNSNPDIHRDSLPPLNRGPSYNGNYTRSHSSRNVNANNTINTGVTSDSNSNNNVDSNAPISSPATPAISSPPANSKYFNLTLPAGKSREKSPGRHSKEGHTRSRSFTKQQHGIGSTSSQSSSQYLAQEKAYLRKMRNQSVDDYYSKGIPGAHEVSKADDNDDEDDDDDEEHSSFDGGDNANLLAAIDDDKYQIDYSMALSLMKNSNVNLRKIANLNTDDTDDPAIIERLEWQSMLTSVLTGDVVRSEKTKIININNPDSTQESYLHATFKENLWFGIRAKIFNRTEDEQRKIVAYRRTLVDQLIDDVMKFEIDYENSTDNPIRDQVKTILDRYDQACSLWKTLEDMYSDKPACRSEEFQNRIDALTAWLTITDAISRETKSLRLWIGNDELDITKSPVEVSSSNAATSTSKIVKKIFDEDNKSLAERLMKEKDVQTIFRKRIFKPIAPWMIKSKDTYIRLGVIFENMKLPDYLHDLLQICIIPVRLIKEIVIVRLGYAMKLQNPTLMMIDQMLDDFKSYITVALEVKSGISEYKEPDEDRKWLISDLFDSELEDFDNVILRCVRYFLVLLNRKLLDSSRSPTTFRTFKEPEELEEAWNFLKPLGHYVDGGSVVVAEEITMLASRLIHRLMAYFNHQIREPTYNGVPQDLIRWYSSTSENFGQLRRKLARFMGEISRDFKNSVVFDIPSQSNCTKTLLEILRSSNHFLVYTGTVETQGTYFFASPELLGNEQEILKILTGSCVGLDPSTDNSHFTDLLHLIRSGSEEHLRYNDDDLDSYDDSNGAYAYVLALCPMKPIVWDGLVVNVDIDSVPITDMKNGELLLVSKLSYYDLHIVRNRFLEVASEVSLGNAGLKQVEYRCSLAKVNQELKKMNRVVFKMCSSVLESVQVIKTRIAELDPVGEYQALINSYFIYARDYGKNSVRTLDPQRKSTIIMKMIQLSIDWVSFICDDCIPTDRKTFRWCVLALEFSMEMIRGINIFLLTEEQFTKLKVKVARCMSLLISHFDIMGARSSEAEKNKLLKWTAQRHNIASSQNDDEYLNKVYHEEVMGQINKIEERRRNLQEEFQSIGRVLDVSDSEYQFLTLLASSFSSVSIRWQKGACIGRGTFGQVFSAVNLDTGGVMAVKEITFHDSQSVKTIVPSIKEEMTVLEMLNHPNVVQYFGVEVHRDKVYIFMEFCEGGSLAGLLTHGRIEDEMVIQVYALQMLEGLAYLHQSGVVHRDIKPENVLLDHNGVIKYVDFGAAKVIASNGRTIGGMTNSSLRKSVKRDGHNNLNSMTGTPMYMSPEAITGTSTDRSGVVDIWSLGCCVLEMATGRRPWANLDNEWAIMYHIAAGHKPQLPSPEQLSEPGRTFLARCLEHDPTKRPSAVELLADPWMVEIRHMAFGNSDVTTTPLSEVAGPVSE

SEQ ID NO: 26743 - protein, 499 aa, Candida albicans SC5314
MTTNSTGSELPIAIEMINPPNSTRNDKFDELVLDYFIHEGYEDAAIKYSCRRKANANDIDQEIENRGNNRYDISGNKKDQISPPTSSLFIDNMNRLSNDKEFSDMVISYFNNPSGKHNNNESTDKHNNNNGGSESASFPDITDVGAINNRDKKTESGFATIKQRQEIKKLILNGDISQAIKQISQYYPMILDLNNLLHFKLLRLNLVEMIRNHKFNTKSSNDSMDAGQDEREFLATILNFVRENLINKVFNSFKLLKELEITMSLLCFKFDPTIENLQDQADLPVELKKLFDLSLRYQCYRLVNNAILKLYNNEYTDVSIATTNKDMPRSKSPFSDSYYLTNDETVQELLEDREESNKRKMTRTYHGPKFAEFDLSNYKHKSRQQQQGINYESSDFVTLEEQQRNNEQEELEAVDEEDEDDEEEEIGYHINPDVNLYSNGDADKDMKDSSIDNIGTENEDEMNRIINSSLDSRLERVIKLWLLTEQRIKDLNIVVTNRN

SEQ ID NO: 26744 - protein, 392 aa, Candida albicans SC5314
MTISNSNLFKPINIGKKTISHRIAHLPTTRNRATKDHVPTDLMQKYYTDRAKTGGLLVTEATLISLNQGIYPNVPGIWNNQQRDAWKKITDSVHSVGGFISVQLWALGRVGNAKLLKNHGLPLTGVSPIYEHEQAEKDAVKAENPIQELTQDEIKDIIYNQFANAAKLADEAGFDFIELHGANGYLFEQFIHPGTNKRTDKYGGSIENRARFLFEVVDHLSTIVDPSKLAIRLSPLNNFQVPGINPTAKEDYSYIIAGLQKRADEGKGFGYINVVEGRFSPDGSTEACDVNFVGDIWKGALLKGGNYTYDKKNSWETIERDANADNRTLVGFGRYFIANPDLPTRIEKDLPLNDYDRSTFYANDDYGYNTYPFYGQEIKADPEHKVFGVALA

SEQ ID NO: 26745 - protein, 167 aa, Candida albicans SC5314
MLIFEDVISGDELLSDAYDVKLVDGAVYEADCAMVTVGNGDIDIGANPSAEDGEEALEDGAETVNNVVYSFRLQPTMFDKKSFTTYIKGYMKRIKAYLAENDPDSVEAFEKGATAYVKKVLGSFKDWEFYTGESMDPDAMVVLLNYREDGTTPYVAIWKHGVKENKI

SEQ ID NO: 26746 - protein, 154 aa, Candida albicans SC5314
MSILDVEFGQDVDVSVYKKTDEDWTPPKRKIGGYHGAGHRLGSPVPGEVLVNNEASSQPDIKTETEISKPKDGGEGDSTVQIRFANGKRTSHKFNSSDSILKVYEFVKNHEYNSEPTRPFTLSHAFPVKPIEESSDITISDAKLKNAVIVQRWK

SEQ ID NO: 26747 - protein, 210 aa, Candida albicans SC5314
MSENTPDSQLIAEFVSITNSSTYLAEQYLSRNSNDLVEAVEDFYANNEPSQKSETKKSSSSNAKGSGVRTFRDLNDEDDDEEDDKTNTNFFTGGEKSGLQVEDPNKDKDNDRSIIDQIFQKAREQMQQPDDRPSASQNDQPSPIKFSGKGFKLGDGNEPSQVVEDPNASAKKFRPSKVTREITFWKQGFTVGDGPLHRYDDPRNAMFCKN

SEQ ID NO: 26748 - protein, 371 aa, Candida albicans SC5314
MSENTPDSQLIAEFVSITNSSTYLAEQYLSRNSNDLVEAVEDFYANNEPSQKSETKKSSSSNAKGSGVKTFRDLNDEDDDEEDDKTNTNFFTGGEKSGLQVEDPNKDKDNDRSIIDQIFQKAREQMQQPDDRPSASQDDQPSPIKFSGKGFKLGDGNEPSQVVEDPNASAKKFRPSKVTREITFWKQGFTVGDGPLHRYDDPRNASVLQELNQGRVPMSILDVEFGQDVDVSVYKKTDEDWTPPKRKIGGYHGAGHRLGSPVPGEVLVNNEASSQPDIKTETEISKPKDEGEGDSTVQIRFANGKRTSHKFNSSDSILKVYEFVKNHEYNSEPTRPFTLSHAFPVKPIEESSDITISDAKLKNAVIVQRWK

SEQ ID NO: 26749 - protein, 267 aa, Candida albicans SC5314
MSTTVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKESGLFVDVRDVAAAHIRAFELNEAQNKRLMLVTEPFSA

SEQ ID NO: 26750 - protein, 359 aa, Candida albicans SC5314
MSLLLKRLSPIKQSYSKVLAIRTMSIPSTQYGFFYNKASGLNLKKDLPVNKPGAGQLLLKVDAVGLCHSDLHVLYEGLDCGDNYVMGHEIAGTVAELGEEVSEFAVGDRVACVGPNGCGLCKHCLTGNDNVCTKSFLDWFGLGYNGGYEQFLLVKRPRNLVKIPDNVTSEEAAAITDAVLTPYHAIKSAGVGPASNILIIGAGGLGGNAIQVAKAFGAKVTVLDKKDKARDQAKAFGADQVYSELPDSVLPGSFSACFDFVSVQATYDLCQKYCEPKGTIVPVGLGATSLNINLADLDLREITVKGSFWGTSMDLREAFELAAQGKVKPNVAHAPLSELPKYMEKLRAGGYEGRVVFNP

SEQ ID NO: 26751 - protein, 463 aa, Candida albicans SC5314
MTKEQIDEPRYKRIAVIGGGPTGLAAVKALSLEPVNFSCIDLFERRDRLGGLWYHHGDKSLVKPEIPSLSPSQEEIVSDNATPADEYFSAIYEYMETNIVHQIMEYSGVAFPANSKKYPTRSQVLEYIDDYIKSIPKDTVNISINSNVVSLEKVNEIWHIEIEDVIKKTRAKLRYDAVIIANGHFSNPYIPDVPGLSSWNKNYPGTITHSKYYESPAKFRDKRVLVVGNSASGVDISIQLSVCAKDVFVSIRDQESPHFEDGFCKHIGLIEEYNYETRSVRTTDREVVSDIDYVIFCTGYLYALPFLKQERNITDGFQVYDLYKQIFNIYDPSLTFLALLRDVIPMPISESQAALIARVYSGRYKLPPTEEMERYYQLELKEKGRGGKFHNYKYPRDVAYCQMLQTLIDEQGLHTPGLVAPIWDESLIKKRSETRAEKNARLKNVVEHVKRLRAEGKDFSLLE

SEQ ID NO: 26752 - protein, 150 aa, Candida albicans SC5314
MSSSYYFSIIGTKDNPLYELEFSSFKSANISTTDNVPGKSQFPQSTKELLPFIANSSLDLIDDQAFTTNVLNLGKIDQFYGLSINAYVLQSQVKFILCYNSKEESTIKQFFQEVNELYTKCLMNPFYNVDDAIVSPDFDLKIKQLARKYL

SEQ ID NO: 26753 - protein, 332 aa, Candida albicans SC5314
MPFVNKSGFFDPSTAPYYDPKETRKVVFITGGNSGIGWYTVLHLYLHGYIVYVAGRTESKVLKAIDDIKAEAENRQAKETTKHPLGELNYIHIDLLDLSTVTKAVDEFAEKEKILDVLINNAGLMGVPYEVTKDDYEIQYQVNFVAHYLLTLKLLPFLQSAVKIGVTPRIINLASIGHNFQFKHFTPEQNKLDKFPNSVFTWVRYGIAKSSQIQFAKELANHYPDILSVSVHPGVILGTELYNHWKNIPIIGIGARGIFALSDKLIGVSNEEGSLATLRAALDPSLTLKENGEYLITGGKIDEPSKIASNTQYSKETWDWNYEQLKKRGYNI

SEQ ID NO: 26754 - protein, 380 aa, Candida albicans SC5314
MITRSRHISKRLYSTNYSAILFNAQENVNQLLESQDRSSYILAQYIPEPVRNTYLAIRAFNLEINKINEGGSNVQSRAARASSQMSNTLGVSTADLKFKFWSDLILRVFTEDSRNETDLGEPIAILLRDGLKHDFNLNISYFQQFLQTRRHFIKNNSSFQTVNDICSYGEGTFSQLNYLTQGLLLSPSISPSVIRLLEYSTELQSQMSDIAAHIGQATAVSSMILGVPFYAQSRNQITLPVDLMTSSGLSQESLLRLFQGHIKDSAEENQIKEALKNVVYETAITANDHMLTAKSKLEMARQEIKKIVQEQPQDQLLNKFSKKWRKGIPDSLYVPTMAGIPTSLFLNKLERCNFDLFHGRLQKEWRLPMKSFYYYHMRLM

SEQ ID NO: 26755 - protein, 432 aa, Candida albicans SC5314
MTVTIPLTETNLFKPISIGDVKLNHRIVHAPTSRKRSTKDNYPTDFMIDYYKSRSQYPGSFIIFESCLVSERSGLVPHKIGLWDEKHCLALKQIVDQVHNNNCVISCQIMANGRTSNAKLMQSKNLPILAPSITYPNEAAEKLATELNFPIKPLTVDEIHNIQDDFVNAAVNSLKIADFDFVELHATSGFLIEQFLSPLSNKRTDEYGGDLVNRCRFLIEIIDKFINHPDIGPKKFGVRISPWYSHNGMVYPEEVNLEDGIPYQFCQYILKQLEVRKSQGNEIAYVSIVEPRVSGNSDVDSFGDKSNDEIIKSWSGKLIRAGGYATNFNVENPTLIKTNKQVTNEGGEIVHYANLINDVNNDDRTLIGFSRPFTSNPDLVYRLENNLKLEYYDRPTFYTQTGEGYLTFKNYDGSAVTKLPEKELMREGISLQ

SEQ ID NO: 26756 - protein, 1212 aa, Candida albicans SC5314
MNNQDPDSQYHNKKVYPPNLPSIPPPPQQPLSGRPATPRMLRSISGTLKSKTELAHSDKGQESNNETKNSNSPHYVPDTHTRQPPPESLKSNIQAPTAVHGNQQKGSLLPPPSIPNPNTMKPAPTPTGVDQPPAKQKPSPAPKQPQPQQQQQQQQQQQFHRKSIGDWNFVKTIGAGSMGKVKLAQHNATHEICAVKIIPRAAKLYQRAHANDPPPQTTQEAAQRHKEFEKEVARDRRTIREGALGRLLYHPFICRLYEMVPMTNHYYMLFEYIEGGQMLDYIVAHGSLKERHARKFARGIASALDYCHRNNVVHRDLKIENIMINEKGDIKIIDFGLSNLYAPKNLLKTYCGSLYFAAPELLSAKPYIGPEVDVWSFGVVLYVLVCGKVPFDDQSVSVLHEKIKKGNVEYPAFLSRECVSLLSRMLVVDPTKRASLYEVCSHPWMNKGYDYKVNNYLPRREPLRLPLDPEIIKTIANFELGTVQGVADELTSILTSVEYQMSCENWYKITETGREYASSQNAQILPDPTGGFHPLVSIYYLVDEMRKRKKAKEEALKAQRRAQVPTIAVPTPKQQQQQQPQPAQPQPQPQPEVSQPLPEPKPVPPEEIINPAVATQAQANMTAPKIVETFSETPQRTLDPSKQSVDEKPSAPGPSIAVPEQAHTTSVPSSFVKTQTSIDEDQLSIPEQQSPRTSTPQTLDPAKVVGGSSGSAISAPNAGSGAGFNSLLRRLSSKKYKGASSPKRSTSPSPNVEGLSPQPTKADPMVRRGVSMKVTAKEKQTNTRPPKSELIKKKPQHGRSSSTSNKMQGFIPVEYLPPLPTIDTNTNTIVSDGAKQQNLTVPSTARHMHPTARAKSVGGGHMRKDSYGRVSHGSQNPLPPLPTSMASQNSQEVVGKDTSEGFFDDVQLDDVGYQEVPQLTESEIIEQYNISKPNSMPSIEHCKTLFLKGFFSVQTTSAKPLPVIRYNIINVLSKLGVKFQEVKGGFVCMHTPSVQPSHSNELDEENKLYGDAFKSKSSDSFEAAEPEGSKTPSRQPSLQLPSHTPTTPSGPKSHKSSNSIGSIGGNVPRRKFSIGNAFNTYRKKNGSQVMMPPNTPATAKVIHGLYDDDDKERNGEDDDDEDDYGYDDSADSLNGYGGGSDMLISSRIEQRAKHQRTVSSSSQKASKSPLKFEIHIVKVPLVGLYGVQFKKILGNTWNYKTLASQILNEMNL

SEQ ID NO: 26757 - protein, 509 aa, Candida albicans SC5314
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDGAMFNNYCNDHQ

SEQ ID NO: 26758 - protein, 1485 aa, Candida albicans SC5314
MNEPPPKRQSVFAKGMKKLQRSKSLLNFAEQAKPPTPENFSSLDPKSNLNSIGLSLVGYGLSSDHLPPPRLDTDSESVSSRTSSPTLHVTTKFNPKQRVESFQTATNFKNQIPPEEIVDQLFEKLLSIRVFPDEAVYSLKKQPVERKWELLLREHETNHHFDLKKLSEQATDKFLTNRDRFQEHEFLIMSRSTTQEPKPKLKPLRIVSGGEDYDDEETPTVTKLVHDDSSTSKLSIESGGSSGAPTETESLLGLVNKKLKIRDGSPDWYVSRIMANKLSLKDCKKLERKLVENNVVKNSGVTWTQGFINAQGETALSVVLTKINKKSIKSNEEFDKEYLIVKCLKHINSEKRDETSSLKEKVYVVKALVFLLVSPRLTTRILVTEVLVMLMLLRDKTLWKSALDGLSSLQDRNGDYVIFQPWLNAFEETIIKYSWSQNKAGELSNLKNYATITLILINSMVDMCSSLKRRISIRRDFGNARILNIFEKLAQIEDTRIDNEIEKYEMYAEEDYNEYVEGKKKRNSKQLPNIPQSKLKLLQVSDFVTTPEANTSLEEDELTPELEDNLSGTESSFDEKSFMTKLKEAEDIESDGAMKSVLQRLMKLKQSERSTEDVHKMLVLVDSMLQHVTNESRVIGTDAHSVLNITIQKLMDRLSTEDMARRAVAESKMLSRQLELVKEEKELLEKELETNKIETIRELKKENYYQAELIATQERQLSKLQQKIEQLQSPNNTALPVVDVGQQGFGNGTVASLKDTSSSSPSKRPPTPPGLYSMQKGSLRGGISAPPMLDFKDARPVSDLQDSRPVSDLQDAPRLVESSAPPLPESKDPVAQPPPPESKDSVAPPPPPVPDFIKSAAPPPPPLPGFMNASAPPPPPVPEFIKSSAPPPPPLPGFITTTPPPPPPLPGFITTTPPPPPMPGMLQPGKVKELGTLFKEKHKQEPQKGITKTKADVVPSIRPKNKLKQMHWDKLENIEKTFWNNLEDSVLSNKLIEQGVLGEVEQVFAAKTATIKKKTAVESQQQPTKKSFLSRDLSQQFGINLHMFANLSEEKLVLKVLRCNSEILENHSVLEFFNNEALVELSDSLFRNLAPYSTDPRTRKKPMKNPEELERADRIFLELCYNLRHYWRSRSRALLFSQTYKKDYIDLMRKLNIVDEANAALKKSESLQNVLGIIRTVGNFMNDDAKQALGFKLDTLQRLKFMKDDQNSMTFLHYIEKIVRHSFPEYGSFVDDLNVLSTLHNISIEQLETDCEEMSRSVKNITDSLERGKLSNKKDLHPEDRILTTISSPMLNAKNKNAMLQSHLKRTAGELNSLMTFFGENPKDATARNTFFYKFVTFITEYKKAHVENIQREEEQRTYEIRKKILEDKIAKKEKLKEESAEPEAVVDTAEESSAVIDSLLEKLKSSTPITTNRAKTKNRRSKALSFYSENPLEIVADTKYESVNNLKRRMTTRKRTTDGETSPKSEQFMSRAQAMLHQLRNKEE

SEQ ID NO: 26759 - protein, 393 aa, Candida albicans SC5314
MPVNFLTSVVFDGPEVIPYWDQIKEYGPTVLPILLTLAGAKYYFHGATNTWERDMHGKVFMITGATSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRDVRVLIATCSSQNLGDVDLNDLLWSDKRYPATQPWKVYGTSKLLLGLFAKEYQRQLMGYERKDKAPCNVRINLINPGIVRTPSTRRFLSLGTVWGLIIYLILFPIWWLFFKSAEQGTQSFYFALFAPIFMKIEGGNVVQECKIMTKVRKEYTDDDLQQKVFHNTEELIKQIETKSAIERKKHENAKKTPEQKARKGKRN

SEQ ID NO: 26760 - protein, 2126 aa, Candida albicans SC5314
MSPSASYLPQEEFSTTNVYDYDEVPENKSWASSLPVAKGLYNPELEKDACGVGFTCHLKGVPSHKIVSDAKSLLCNMTHRGGELNPQDGDGAGLLSSIPHKFLKREFQYYCNVELPAKGQYGVGNVFFKKDDAVFEKSKKTFESIADSLGLKVLGWREVPHDSSILGAAALSREPYILQPAVVYKEIWGQKVSDDEFDSKYRKDFEKRLFILRKQASHTIGLHNWFYICSLSNKTIVYKGQLAPKQVYSYYHDLVNAEYESHFALVHSRFSTNTFPSWDRAQPLRLAAHNGEINTLRGNKNWMRAKEGVMKSKLFGDEMDKLFPIIEEGGSDSAAFDNVLELLVINGVVSLPEAVMMMIPEAWQNDENIDPKKKAFYEWAACLMEPWDGPALFTFADDRYCGANLDRNGLRPCRYYVIDDDRMICASEVGVIEIQPEKVIQKGRLQPGRMLLVDTKEGRIVDDRELKSKVASRYDFKSWVLANMISLQDLNEKLASRKIDINAKPIDVNVNVQSDPRLIAAGYSHEQILFVLAPMAEGNEALGSMGNDNALACISEQPKLLYEYFRQLFAQVTNPPIDPIREKIVMSLECYVGPQGNLLEMKPDQLNRLLLKSPILTSSELLAIKNIQTVYPSWSVANIDITFEKSEGIQGYINTIDRICQAASQAIADDNQIIILSDVATSAERLPISALIAVGAVHHHLVRQKQRSKVALIIETQEAKEVHHACCLVGYGADAINPYLAMETLVRMKHQGLLKNESLTEEKIIQNYKGSIDAGILKVMSKMGISTLASYKGAQIFEALGIDNSVIDRCFAGTASRIKGVTFEYIAQDAFTLHERGYPTRDTIKPIGLPETGEYHWRDGGDAHINDPAAIASLQDAVRNKNERAYEAYAKKENEAVRNCTLRGLLDFEFESSTEVPIDQVEPWTEIVRRFFTGAMSYGSISMESHSTLAVAMNRLGGKSNTGEGGEDAARSQVLENGDTMRSAIKQVASGRFGVTSYYLADADELQIKMAQGAKPGEGGELPGHKVSAEIGKTRHSTPGVGLISPPPHHDIYSIEDLKQLLYDLKCANPRARTSVKLVSEVGVGIVAAGVAKAGSENILVSGGDGGTGAAKLTSIKYAGLPWELGLAESHQTLVLNDLRGRVILQTDGQIRTGRDIAIACLLGAEEWGFATSPLIAMGCIYMRKCHLGTCPVGIATQDPELRKKFEGTPEHVINFFYYLANDLRKFMAKLGFRTINEMVGRTEKLKVRDDLRNTKNANIDLSPILTPAHTIRPGVATHCVRKQDHKLHIRVDNKLIDESELTLAKGLPVTIDCEVVNTDRSLGTTLSYRVSKTFGEQGLPHDTIHVNVTGSAGQSFGAFLASGVTLELEGDANDYIGKGLSGGRIIVYPPRESKFKAEDQIIAGNTAFFGATSGSAFIRGIAAERFAVRNSGAIIVTEGTGDHGCEYMSGGRVVVLGATGRNFASGMCGGIAYVLDMAQDFSEKVNRAQVELSQVTETEEIAFLRNLIEDHRHYTGSEVADNILNDFNRYLPRFVKVLPNDYKKVLEKEKKLAEEAKKKELSSFLKSIKEDPESDVTNGEAYKIKKGHVHHPNKGKNEPKVADVEDTIFNTEFEKKAPVKLDKLRGFMKYKRRNEKYRDAKARTKDWNEMTSRLTKEELKYETARCMDCGVPFCTSDTGCPISNVIPKWNELVFNDRWYDALQRLMMTNNFPEFTGRICPAPCNGACVLGINEDPVNIKSVECAIIDHGFEQGWIKPTPPAHRTGKTVAVIGSGPAGLAAADQLNKAGHLVTVYERSDRPGGLLMYGIPNMKLDKGIVKRRTDLLAAEGIEFICNTTVGEDITVSELKSQFDAVVFAVGSTIPRDLRIPGRELKNINFAMQLLHSNTKALLDDQLEDIRKNLAGKNVVVIGGGDTGNDCLGTSTRHGAKSVTNFELLPNPPNARPKDNPWPQWPRIFRVDYGHTEVATHYGKDPREYSILSKEFVGDEEGNVKGIKTVRVEWKRSDSGAWQMAEVPGSEEFFPAEVVLLSMGFLGPEADNLEVQKTKRGTITTVDPNVYKVDKDDNVFAAGDCRRGQSLVVWGIQEGRQCAREVDEYLMGSTRLPGNGSVEQRNYKLLEELAEKV

SEQ ID NO: 26761 - protein, 258 aa, Candida albicans SC5314
MTKGDSKRVIPLESNPFLFTELAYQLGLSPILQFHDVYSLTDPDLLAMLPTPIYAIILLFPLSPNYEKYRQQQDNNNNNNFNSTNLIKYDNNNDIEWFKQTIGNGCGLYALLHILTNLPQDLIISNSKLSQLRNNLTKVKEFSIDDRAKIIENLENDIKLDENFGEKGDTKAPDINESVDLHFISFIKSTKNGHLYELDGRRTGPIDLGESNNKDNNNNNNNIINDPLLIEKIQFYIDNADEANKNNFAIMAIGPSFN

SEQ ID NO: 26762 - protein, 507 aa, Candida albicans SC5314
MLASKKKRTRRIKRQPICEQIPTSNTAFFFTLDIPIMPVNFLTSVVFDGPEVIPYWDQIKEYGPTVLPILLTLAGAKYYFHGATNTWERDMHGKVFMITGGTSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRNVRVLIATCSSQNLGDVDLNDLLWSNKRYPATQPWKVYGTSKLLLGLFAKEYQRQLMGYERKDKAPCNVRINLINPGIVRTPSTRRFLSLGTVWGLIIYLILFPIWWLFFKSAEQGAQSFYFALFAPIFMKIEGGNVVQECKIMTKVRKEYTDDDLQQKVFHNTEELIKQIETKSAIERKKHENAKKTPEQKAKERQEELNRKRDLHIKPETPEELESKLNSLRNQIGMGTGISSNEMPLFPDDETLKKVISSKKNASSNNSGGSKSNKSQKKSKKV

SEQ ID NO: 26763 - protein, 236 aa, Candida albicans SC5314
MRSIKSVVVGDGGVGKTCLLISYTTNTFPNDYIPTVFDNYSASVMIDGEPIKLGLWDTAGQSEYDRLRPLSYPQTEIFLCCFSVISPDSFQNVKSKWIPEILHHCPKDILILLIGTKVDLRDDLHVLDELTARNLSPVTFDQGNKLAREIGAIKYMECSAATQVGVKEIFDYAIRAVLDPPNANKGEYVTNDSVPGMGVNNSSGSKKHNEKNGSGTATAGTGKKRKIKRAKKCTIL

SEQ ID NO: 26764 - protein, 343 aa, Candida albicans SC5314
MSTAAVATKPSVTSKPATKQVSNYTKEKKVGEGTYAVVYLGKQISTKRQIAIKEIKTGLFKDGLDMSALREVKYLQELKHPNVIELVDVFSATNNLNLVLEFLPCDLEVLIKDKSIVFKSADIKSWLLMTLRGIHHCHRNFILHRDLKPNNLLLAPDGQLKIADFGLARALVNPNEDLSSNVVTRWYRAPELLFGARHYTGAVDIWSIGIIFAELMLRIPYLPGKDDVDQLDVTFRAYGTPTEQIWPNVSSLPMYNALHVYPPPSRQELRNRFSAATEKALDLLISMTQLDPSRRCDSTLALLHDYFTESPRPTDPKKLPKKSSPEKRENEDEQNNGSKRRHV

SEQ ID NO: 26765 - protein, 2110 aa, Candida albicans SC5314
MFTIMTKFQKTNHGLLLCQWLKVYINPELEKDACGVGFTCHLKGVPSHKIVSDAKSLLCNMTHRGGELNPQDGDGAGLLSSIPHKFLKREFQYYCNVELPAKGQYGVGNVFFKKDDAVFEKSKKTFESIADSLGLKVLGWREVPHDSSILGAAALSREPYILQPAVVYKEIWGQEVSDDEFDSKYRKDFEKRLFILRKQASHTIGLHNWFYICSLSNKTIVYKGQLAPKQVYSYYHDLVNAEYESHFALVHSRFSTNTFPSWDRAQPLRLAAHNGEINTLRGNKNWMRAKEGVMKSKLFGDEMDKLFPIIEEGGSDSAAFDNVLELLVINGVVSLPEAVMMMIPEAWQNDENIDPKKKAFYEWAACLMEPWDGPALFTFADDRYCGANLDRNGLRPCRYYVIDDDRMICASEVGVIEIQPEKVIQKGRLQPGRMLLVDTKEGRIVDDRELKSKVASRYDFKSWVLANMISLQDLNEKLASRKIDINAKPIDVNVNVQSDPRLIAAGYSHEQILFVLAPMAEGNEALGSMGNDNALACISEQPKLLYEYFRQLFAQVTNPPIDPIREKIVMSLECYVGPQGNLLEMKPDQLNRLLLKSPILTSSELLAIKNIQTVYPSWSVANIDITFEKSEGIQGYINTIDRICQAASQAIADDNQIIILSDVATSAERLPISALIAVGAVHHHLVRQKQRSKVALIIETQEAKEVHHACCLVGYGADAINPYLAMETLVRMKHQGLLKNESLTEEKIIQNYKGSIDAGILKVMSKMGISTLASYKGAQIFEALGIDNSVIDRCFAGTASRIKGVTFEYIAQDAFTLHERGYPTRDTIKPIGLPETGEYHWRDGGDAHINDPAAIASLQDAVRNKNERAYEAYAKKENEAVRNCTLRGLLDFEFESSTEVPIDQVEPWTEIVRRFFTGAMSYGSISMESHSTLAVAMNRLGGKSNTGEGGEDAARSQVLENGDTMRSAIKQVASGRFGVTSYYLADADELQIKMAQGAKPGEGGELPGHKVSAEIGKTRHSTPGVGLISPPPHHDIYSIEDLKQLLYDLKCANPRARTSVKLVSEVGVGIVAAGVAKAGSENILVSGGDGGTGAAKLTSIKYAGLPWELGLAESHQTLVLNDLRGRVILQTDGQIRTGRDIAIACLLGAEEWGFATSPLIAMGCIYMRKCHLGTCPVGIATQDPELRKKFEGTPEHVINFFYYLANDLRKFMAKLGFRTINEMVGRTEKLKVRDDLRNTKNANIDLSPILTPAHTIRPGVATHCVRKQDHKLHIRVDNKLIDESELTLAKGLPVTIDCEVVNTDRSLGTTLSYRVSKTFGEQGLPHDTIHVNVTGSAGQSFGAFLASGVTLELEGDANDYIGKGLSGGRIIVYPPRESKFKAEDQIIAGNTAFFGATSGSAFIRGIAAERFAVRNSGAIIVTEGTGDHGCEYMSGGRVVVLGATGRNFASGMCGGIAYVLDMAQDFSEKVNRAQVELSQVTETEEIAFLRNLIEDHRHYTGSEVADNILNDFNRYLPRFVKVLPNDYKKVLEKEKKLAEEAKKKELSSFLKSIKEDPESDVTNGEAYKIKKGHVHHPNKGKNEPKVADVEDTIFNTEFEKKAPVKLDKLRGFMKYKRRNEKYRDAKARTKDWNEMTSRLTKEELKYETARCMDCGVPFCTSDTGCPISNVIPKWNELVFNDRWYDALQRLMMTNNFPEFTGRICPAPCNGACVLGINEDPVNIKSVECAIIDHGFEQGWIKPTPPAHRTGKTVAVIGSGPAGLAAADQLNKAGHLVTVYERSDRPGGLLMYGIPNMKLDKGIVKRRTDLLAAEGIEFICNTTVGEDITVSELKSQFDAVVFAVGSTIPRDLRIPGRELKNINFAMQLLHSNTKALLDDQLEDIRKNLAGKNVVVIGGGDTGNDCLGTSTRHGAKSVTNFELLPNPPNARPKDNPWPQWPRIFRVDYGHTEVATHYGKDPREYSILSKEFVGDEEGNVKGIKTVRVEWKRSDSGAWQMAEVPGSEEFFPAEVVLLSMGFLGPEADNLEVQKTKRGTITTVDPNVYKVDKDDNVFAAGDCRRGQSLVVWGIQEGRQCAREVDEYLMGSTRLPGNGSVEQRNYKLLEELAEKV

SEQ ID NO: 26766 - protein, 258 aa, Candida albicans SC5314
MTKGDSKRVIPLESNPFLFTELAYQLGLSPILQFHDVYSLTDPDLLAMLPTPIYAIILLFPLSPNYEKYRQQQDNNNNNNFNSTNLIQYDNNNDIGWFKQTIGNGCGLYALLHILTNLPQDLIISNSKLSQLRNNLTKVKEFSIDDRAKIIENLENDIKLDENFGEKGDTKAPDINESVDLHFISFIKSTKNGHLYELDGRRTGPIDLGESNNKDNNNNNNNIINDPLLIEKIQFYIDNADEANKNNFAIMAIGPSFD

SEQ ID NO: 26767 - protein, 369 aa, Candida albicans SC5314
MTTDSVPAKFQGFASSNKNTWNKPKLVSYDRKQINPHDVVLENEVCGLCYSDIHTLQSNWGEYNRDDLVVGHEIVGKVIAVGDKVTEFKIGQRVGIGAASSACRECNRCKSDNEQYCAKAASTYNAPDVRSNNYVTQGGYSSHSIADEQFVFPIPDDLPSAYAAPLMCAGITVFSPLLRNLGSDAKGKTVGIIGIGGLGHLALQLAKALGAKVVAFSRTSSKKDQALKLGADEFIATNEEKDWSSKYHDTFDFILNCASGVDGLNLQDYLSVLKVDKKFISVGLPPATEQFGVSPFTFLKHGASFGSSLLGSKVEVLEMLKLAAKHNVKPWIEEVPLSEENCSKALNRCHDGDVRYRFVFTEFDKAFAK

SEQ ID NO: 26768 - protein, 343 aa, Candida albicans SC5314
MSTPITVIVSGATGFIAQHVVKQLLAKNYQVIGTVRSTAKGDHLLKLFNNPQNLSYEIVEDVGTKGAFDKVLQKHGEAKVFLHLASPFHFNVTDVEKELLLPAVDGTKNVLQAIYNFGNNIEKVVITSSYAAISTASKEADKNAIITEKDWNEISWQDALLNPVNGYRGSKKFAEKAAWDFIKSNDNVKFSLSTINPSFVFGPQSFGSEIKQSLNTSSEIINSILKLKPNDSIPASKGGWVDVRDVAKAHIIAFENEDAKNQRILLNSGRFTSQSLVDIINDKFPDLKGKIPVDEPGSDKSVIAESLATIDDTKSRELLGFEYYNLEQSVYDTVEQIVNAHKL

SEQ ID NO: 26769 - protein, 1439 aa, Candida albicans SC5314
MNSIDVTKLKKLAKDDLFKRDIFGRTILHICILVNNSDALKSLTKNPDFKTLLKLNDYENGWNCLHYIFFHKRLQCLKVLIDYLQGTIVQGNIFATNSPLLELLKFKDRNGHTPLNLLNNDFKDLLWFPEYITDKNEFHMTYKYERIKSTKDVVQPEYEPDTLPFLKSSEILWTDKRGASEIYVFGCNSNNQLGVGDSTDRATPALLYHDNFKFATDLTGSISERFKRPRYKRITISKNHSVVVTQDGELFSCGVGSRGRLGHGLTDLNNYFKFKRIEFFNDKTIKDVAISSNHSIALTTDNEVYAWGLNSFNQLGVPNMNNKKSTNYLDKFIATPIMVGGELRKMQNIIGIEVSKIHSLAWSKNYLCFWGLNVGQMGISYTNGDIEVKVQERSVRGETQVNPKAIQLRDDIKCVSTSELCTCVVTTLNDVHVYYNYQHFKLPKIPMKGHGDKHFDYFKPRRITEAAVIKKIVTRGPENSMILLKNGSVFSFSVNANDIKNTKYTSIWKAYDHDMVATDIDISTDGSVVLCTRSGTVFIKSTLSSNQRKNSMSGATLPIPLTKNKFKKIENVNNVVRVTCDPKFLSFGFMRDDIDLLPLELPQNDFFTDIETLSPAVEYNFNRKQNKLFDTQDHLYIANFFTASRNNTHEDDADDAEYDKLYSNQDASVINKIEEIYNSKFDPRASKRVKALSTYENIVSEEVYSTIKRCSGYGEDYVDGLKDILSNNENLFDANFEFAFAQDAKFGFHSRVLEFRSSVFQKLLQLNDKNETLIGDNIKIVWIPEQSTLRVLTTISPVAALMFMHSVYSGRKMDNLEQNVFSYSSPELVRLRINQYQSLCSLFGIGCDRLSVTDAFQDLLNSNTGDVVIKASDGDVFAHAFVLKARSAFFETLLSERWDTEEKGNVQYVDFTGLTKFQVTLILRHLYGVSNESLLDCFQYDFGEKDYFINDLLELIEVADELLLFQLKSVLQLAICDMISLDNVLVLLVHGFTLNARQLFLNCCWYIFNNLEVLMFAPGFKEIPNETMQLLEVFIDKLGNVQNGTKNWIDQNPNILLEHIENIEEFNEYFMSDRKGFSSFKPLIDNGYIDAIKTKETVKKRKSRKSSTSAFNKDISDFRQGLRRENNGESFPPTIIDENDGFILVENKTKQRNASSSSPNILNMNGIVEPTNKIGNLSVIGKLTSIHPNPESFVQSSGLPSTSNWATKPQSSSIESNTLLPAAISTTLTTAKSKPTKVKIGPVTKLSQKQRKRLAAAAANDANLEQIDQKTTKESSTIAPWSTCVADTPISNSQNINNLPALGSSKPKKKFISISRPQSTKKSPSLISIPSSTASTPFSMAAAITPDSSFNSVYSTPSLTEVMIHESLKLEQAKLQETERKTLVEIQQEQEFAKWWEEESKRVQEEMQRLEVADTKKKKKKKNTSPKPQKYRKPIKSDS

SEQ ID NO: 26770 - protein, 255 aa, Candida albicans SC5314
MPDGTPRFTCKGKEILHFMGCSTFSQYTVVADISVVAINEKAEFEKACLLGCGITTGYGAATITANVQEGDNVAVFGGGCVGLSVIQGCKERKVNKIILVDINDKKEEWGKQFGATDFVNSTKLPEGTTIVDKLIEMTDGGCDYTFDCTGNVNVMRNALEACHKGWGTSIIIGVAAAGKEISTRPFQLVTGRVWKGAAFGGVKGRSQLPGIVEDYLDGKLKVEEFITHREPLDKINTAFDEMHGGDCIRAVVSLW

SEQ ID NO: 26771 - protein, 476 aa, Candida albicans SC5314
MNTEETLLITPVDNYDAIVNDTKDDDSTPKSELKHLTRSSFPLVVSFVLQYVFSITSVYAAGRLGAKELAACSLAICTFNITGLAVFQGMATSLDTFCSQAYGSGNKKMVGVYFQRATLLMLATMVPLMLVWWYSGSILNQLVPDPELVSMAQLFLRIHAFGVPGLILFESGKRFLQAQHLFQASTYVLVVALPFNLLLNWLLVWNPNTGMGYTGIPLSIGITYWVISLLMFGYVIFIDGIECWGGIDWEKASSNWKPMLSLAVPGVIMVISDFLAFEILTIFASRFGTEALAAQSIVSNVATLCFQVPFAFAVAISTRMGHFIGDGNIASAKILNDLTVIIGGSIGLLSFCLFYFGRHVLGEFFTSDKMVLEISSKLLILAGINQISDSLNVVGTGVLRGQGRQRIGSILNIISYYFLAIPLGYVLAFKFGMEMSGLWIGLTIGVFVLAVTQCTSICLSNWEKILEHSHRIHDSV

SEQ ID NO: 26772 - protein, 416 aa, Candida albicans SC5314
MLFPKKKNKKKAIKTWRHLLLLLTQLPRIIPVNSDYLVSHIKTRISAKLLYPFLIPVSFLTLLISYRYSLPHNKLFNSNSTMSSHRHNTVQSVSRVYADVLSTKPQSYWDYDDLNIKWNPQENYEILRKLGRGKYSEVFLGIDLEKREKVVIKVLKPVKRKKIKREISILKNLVDGPNIIAMLDVVREPQSKTPGLIFEHINNIDFRSLYPTFTDYDIRFYMYELLKALDYSHSMGIMHRDVKPHNVMIDHDKKLLRLIDWGLAEYYHPGTEYNVRVASRYFKGPELLVDYRLYDYSLDMWSFGCMLASMVFMKEPFFHGKSNTDQLVQIVRVLGSKNFKKYLEKYNISLGEEYEDIGYYNKRQWVRFMNENNKDLVSQEFLDLIDRLLRYDHQERLTAKEAMKHAYFDPIRVAVS

SEQ ID NO: 26773 - protein, 399 aa, Candida albicans SC5314
MSSTNSTENHAVEEKYEDPQQQQQQQQQQQQQQQQKDALAKKPMSAYIGISIMCVLIAFGGFVFGFDTGTISGFINMSDFLERFGGTRADGTLYFSNVRTGLLIGLFNVGCAIGALFLSKVGDMYGRRVGIMTAMIIYIVGIIVQIASQHAWYQVMIGRIITGLAVGTLSVLCPLFISEVSPKHLRGTLVCCFQLMITLGIFLGYCTTYGTKTYSDSRQWRIPLGLCFAWALCLLGGMVRMPESPRYLVGNDRIEDAKISLAKTNKVSPEDPALYRELQLIQAGVERERLAGSASWKSLITGKPRILERVFVGAMLQSLQQLTGDNYFFYYSTTIFKSVGLNDSFQTSIIIGVINFASTFVGIYAIEKLGRRHCLLIGFRCDVHLFLNLLIDWYSTSLH

SEQ ID NO: 26774 - protein, 497 aa, Candida albicans SC5314
MSQDNVSSTSTAEAVNNEIKVKDEFPQEEQAHTSLEDKPVSAYIGIIIMCFLIAFGGFVFGFDTGTISGFINMSDFLERFGGTKADGTLYFSNVRTGLMIGLFNAGCAIGALFLSKVGDMYGRRVGIMTAMIVYIVGIIVQIASQHAWYQVMIGRIITGLAVGMLSVLCPLFISEVSPKHLRGTLVCCFQLMITLGIFLGYCTTYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVIVGVMLQALQQLTGDNYFFYYSTTIFKSVGMNDSFETSIIIGVINFASTFVGIYAIERMGRRLCLLTGSVAMSICFLIYSLVGTQHLYIDKPGGASRKPDGDAMIFMTSLYVFFFASTWAGGVYSIISELYPLKVRSKAMGLANASNWTWGFLISFFTSFITDAIHFYYGFVFMGCLVFSNFLCLLYGLRN

SEQ ID NO: 26775 - protein, 404 aa, Candida albicans SC5314
MSPKKSYSLETELVLNKSGDQYNASVPPLYQSATFKQPSLSNMGEYDYTRSGNPTRTHLQNHIAKIMKAEHAFAVSSGMGCLDVITRLLKPGDEVIAGDDLYGGTHRLLTYLSKKGDIVAHHYDTTNTELIKSKINNKTKMIFLESPTNPLIKVVDVKSIADHAHKANRDIVVVFDNTMMSPVLMTPLDLGVDIQYESATKYLNGHHDIMAGVIATRSSSLAEQLYYIINSTGCGLSPFDCWLLSRGLKTLAIRVEKQQQNCIRIAKFLENIGFKVRYPGLKSHPQYELHSSMCSGYGAVLSFETGSVRLSEKIVENTDIFGIAVSFGCVNSLISMPCKMSHASIDAKTREEREFPEDLIRLCIGIENCDDLIDDLTKALLRSGAVKVNDRDELYNAVGIQPKL

SEQ ID NO: 26776 - protein, 293 aa, Candida albicans SC5314
MPSDPEEDYIPWIQQFCELFGHDYFVQVSQDFIEDDFNLTGLSSQVPYYREALYTILDYQVETAEDHNTDNTTTNTSNNNDSRNGTSKRNASELPNKALLAHSAELLYGLIHARYIVSKQGLTAMASKFERNDFGSCPRYFCDGMHLIPVGSTDVPGQETVRLFCPCCNDIYIPSSSRYLNIDGAFFGTTFPGLLVKMFPEIENQCRIRITKFSQNDFGLKLFGFKINELSATGPRMKWLRMHPKTEDEKQEYDSCEYNVPISYLDEDEEMEEDDEEEDEVEEEDDDRTMASE

SEQ ID NO: 26777 - protein, 248 aa, Candida albicans SC5314
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKSIGAEQAEKTRILYGGSVNGKNAKDFKDKANVDGFLVGGASLKPEFVDIIKSRL

SEQ ID NO: 26778 - protein, 424 aa, Candida albicans SC5314
MNWKTPSKKIYDSADLKNFEKSIAFEKLQKTLQQIILSVENHKIPPGILNVDIVTRPGRIGSIPLPSLIEPTTTTTTRENKIGPSNGNVEILIELFQYLNKLIDETPPLKGPTRFGNFACRDWHDKIDIIPILKKFKFPQELSSSNNSSSKSNIDGFLLESSYYLLNSFGSKIRLDYGTGHELSFLAFIGSLIEFKILNHPTTTEEINGKEILIIFANYYDLVRRLILVYNLEPAGSHGVWGLDDHFHLIYILGASQFINDKLAPIVQRSLSSQVINSCKLTNFYINAIAFIFRLKTGPFNEHSPIIFDIHNKVFSWTKVRQGLIKMYMVEVFNKFPVLQHFWCGEVLYPWKDHQGNDLPVNEKEETELDKPPETTLNSTTTTTTTTKVSSSTSKIPFTPAPWANTTTTHAVPRNTRNTRNPRS

SEQ ID NO: 26779 - protein, 335 aa, Candida albicans SC5314
MTIKVAFLGPEGTYTHQVCSHTIPYTDFIFLFLLGYLLTIIFKALIQQFGTENVSIYPQQSIGDCFHILNEKKVDYAVVPFENSTNGQVVFTYDLLRDWYFQTSTPPKFRIIAEQFVSIHHNLLTNASKIEDIKTIYSHPQVWTQVNKFLQSLPQQITKIDVGSTSKAAEIVSQDTITTSGSSSAAISSYMSSELYKLPILKEGIEDNQSNTTRFLILGYDSPISPPPAAASNNDDDNSKRNTTIVSSIMFTLNHDDPGALCDVLVKFKEYGITLTSINSRPANLKPWQYVFFVEMIGDIHQEGLVEKIKESCLELVILGVFQRSWRYNNNSNDQ

SEQ ID NO: 26780 - protein, 405 aa, Candida albicans SC5314
MVSIITFTKNVLVTLAFALLAQGLAIPEDIDKRAEKVVSLDFTVTRKPFNATAHGQHHQSQQQQQQQQQQPAQKRGTVQTSLINEGPSYAATITVGSNKQQQTVIVDTGSSDLWVVDSAAVCQVTYPGQSPTFCKQDGTYKPSSSTTSQNLGKAFSIRYEDGSSSQGTVYKDTVGLGGASITNQQFADVTTTSVDQGILGIGFTGDESSPTYDNVPVTLKKQGIINKNAYSLYLNSASASSGTIIFGGVDNAKYTGSLTALPITSSNELRVQLSTINIAGTTVSASTTPVLDSGTTLTYFSQTIADKLAAAVGAKWNSYYQLYTSSCNLAGNIVFNFAKGVTISVPLSEFVLQDGNSCYFGVSRDSATILGDNFLRRAYAVYDLDGNTISLAQVKYTTSSSISTL

SEQ ID NO: 26781 - protein, 333 aa, Candida albicans SC5314
MSYPTIPWPTFADLKQMLHGFWASKPTYTESQYPDLQDKVVIVTGGNTGLGYETVKSLAGSTKARIYVFSRNKEKTLAAIKQIQLEIAEEYNVSNSDIRFIQVDLSDLTTIKPAVEEFLKQEQRIDIIIHNAGIMGPPVGSKSKQGYELQWGTNVVGPHLLQRLLDPLFIKTSETNPPGFSRIVWVSSTAHLFAPQGGVFWDNVNYENLKLSQTQVRTTLYAQSKAGNLIQARTWSRKHNYPNVISSSLCPGYLYTDLIRNLNSFEQCFVKRLIYPRRYGAYTELYAAFSPDVKDGAHTIGFGVPSHARTDLTSEAVGDKTWAYLDKETDAYL

SEQ ID NO: 26782 - protein, 491 aa, Candida albicans SC5314
MAPKLNNPNLFQNKPFINGQWYDSKSTSTFKVYDPATQELIIELPDQTPEEIDEAIAITHKAFQTYQRTPVYERAKWLRRMYELMIENLQDLATLITWENGKCLADALGEIKYAASYFEWFSEECKRNYGHTIQPSNQNNKVITYKQPVGPVGLLCPFNFPSAMGARKAAPALAAGCTCILKPDGQTPLSSLALAYLAQQAGFPDGCFNVVLTSVTNTPMCGLKFCQSPKLKKISFTGSTNVGKLLMQQSSSTLKKLSMELGGNAPIIVFNDCNLDLAVDQSITSKFRSLGQTCVCANRIYVEKGVYDEFCNKFVEKVNQFKIGNGFEPGVTHGCLINTKAIEKVEDHVQDAVEKGAKLIVEGGRLPQLGENFYSPSVVKDVTQDMKVVKEETFGPLAAIIPFDSKEQVLQWCNDTPYGLASYIFSENLNTVWYMSEFLENGMVSVNTGLFTDAALPFGGVKESGFGREGSLYGMDDYTVIKSITLGNVYN

SEQ ID NO: 26783 - protein, 335 aa, Candida albicans SC5314
MSSIFPKLSFQEWYQVLYGLWPSNPQFTEKDISSNTLKDKVVVITGGNSGIGYETAKVLAGNTEARIYIWARNRQKSIEAIEKIKLEVAEKHSKDVGDRLQFIQIDLSDLNSIEPAVKEFLQREQRLDIIYHNAGVMESPSDQKTKQDYQMELGVNCIGPQLLQTLLDPLFIKTAEKNPPNLSRIVWVSSTAHMLSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKSYVR

SEQ ID NO: 26784 - protein, 347 aa, Candida albicans SC5314
MSKTVILTGASGYIGQHILGELLDQNYKVIAIVRSQKSSDTLSKLFKQTPKLQFEIVEQFDKPHALDKVLEKHKEATIFISTAAVVTFHAEDYERDVLDPAIDLVKNIFSSIKEHAPQITRVILTSSSASVVGLDKAFSYDAEYSDNDWSPFTREMSTSDGTMAYFASKKLAEKEAWKFLKEEKPNFDLVVIMPALILGPVRFSSELKNGKFPSTSGIIGGLLHLKSDDPIQPMAAGAVDVRDVAKVHVDVITSEKASNQRILVESGKVTNDNIIQTIIDNFPSYKDKLPTPNPVPHSKFVKPKDERSRKIIGFSLRSLGDSVVDLVKQIDQENSVIESIKKLDIKK

SEQ ID NO: 26785 - protein, 465 aa, Candida albicans SC5314
MIISYIFVATVIGANQIAVTEVTCLMPITSGYIRHAEHFVDHSLGFAMGICNIYSAVIPTELSAVVLIMTYWTDLSPAVFVTIFGIVIVVINSYNVRWYGEIEFCFGVLKILLVICLIIVGLVIDLGGAPNHDRLGFRYWKDPGLFSERYATGSLGRFLGIWKSVGTAVYTFSGIQSVCLLAGESEYPRRAIYRAAKRVFYRIAILYFTTVLVLSMIVSHTDPAISKPDGTARGSAFVVAIQRSGIKVLPHIVNAVVLTSALSAANLDIIRSSRIIYALASKRQLPKIFLKVNNYGLPYVAVAFCCSFLPLAYMTANATSAAVFSWFQNITSSCTLLNWSIISINHISMSRALRAQGYTRDDLPYKFAGGEFAAYYSLFFAIIFLLTGGFPVFIKGYWQFSTFFSSYFIIPLVLIFYTFGKLFWKTKLKSPHDVPLKPLFFDVQQRPEPPYPKLKGWQKLTWLWA

SEQ ID NO: 26786 - protein, 485 aa, Candida albicans SC5314
MESNNKMEKESSLENSRNSSINEFDDSTLSNKVHTFLGYSGTRLNFIISTFAGVGFFLFGYDQSLIGSLLTLPNFEETFPSISGPDDGVLQGTVVSIYEIGCFAGAIATIYCGNKFGRIKCMLIGCIIIIIGAALQASAFSVGHFIVARIVTGVGTGFMTSTVPVWQSELSRATTRGKLIMLMGSLITAGVATAYWVDFGFYFVSENDPKGISWRLPIILQVIFPMMLLSVIFKVPESPRWLMSKKRVREARIVFSAIYNLPENDSEVTSQLAEIQSALELEEAESAGFNIRELVKQGPTRNFQRLSLACWSQIFQQISGINLITYYAGTIFEKYIHMSPFNARILAACNGTEYFLASLLGIVFIERVGRRKLLFFGAIGQALTMMALTIATWQADKQRAENGGGTGAGIAAAVFLFVFNSVFGVSYLGGTWLLPTEVSSLQLRAATAALSTSCNWLFNFMVVCIKFSFLLVQGLNFSILTFSRL

SEQ ID NO: 26787 - protein, 230 aa, Candida albicans SC5314
MVKPIIAPSILAADFANLGCNCKRVVDTGDVEWLHLDVMDGHFVPNISLGPPIISSLRKQFPREGDKPIVFDCHMMVSEPDEWIEEIAKAGGDSYTFHFEATKDPARVIKKIKEHGLKAAMAIKPKTPVEEVFPYAEDLDMVLVMTVEPGFGGQKFMPDMMPKVETLREKYPNLDVQVDGGLGKDTIQPAADAGANVIVAGTSVFKPEDPKPVVQYLKQTVADAIQARNK

SEQ ID NO: 26788 - protein, 222 aa, Candida albicans SC5314
MNPLRILLLGAPGSGKGTQTSRLLKRFTQLQSLSSGDILRNQIRSGSAIGGEAQTYIKNGSLVPDNIMVGLITAELEKKKWLTQSSSWLLDGFPRTVNQARELDRVIHDRANFNLVVELDVDQKVILQRIEARWIHEASGRVYNLDYNPPKVPFKDDVTGEALTKRQDDTAQVFQKRLDQYNEEIEPLKVFYKQQGLLYTVSGDTSDIIYPKLENLIVDKIM

SEQ ID NO: 26789 - protein, 335 aa, Candida albicans SC5314
MSSIFPKLSFQEWYQVLYGLWPSNPQFTEKDISSNTLKDKVVVITGGNSGIGYETAKVLAGNTEARIYIWARNRQKSIEAIEKIKLEVAEKHSKDVGDRLQFIQIDLSDLNSIEPAVKEFLQREQRLDIIYHNAGVMESPSDQRTKQDYQMELGVNCIGPQLLQTLLDPLFIKTAEKNPPNLSRIVWVSSTAHMFSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKSYVR

SEQ ID NO: 26790 - protein, 267 aa, Candida albicans SC5314
MANEEYVTDSSSDFTEYWIDLFLGIKGNEYFCDIDDEYIRDRFNLTGLNSEVSKLPTLIDIITDVIDIESQPEEHKDSLEHNARILYGLIHARYILTTRGLNKMFEKFRSGDFGYCPRVHCQLNPLLPIGLNDQPRMASVKLYCSKCEDLYNPKSGRHSAIDGAYFGTSFPAMFFQNFPNTVPIHAKETYVPRVFGFKLHEYSKLNRWRELQRLKLENRLKKNGIQIDNVVGGFITNGDEEEKQDNNNNKQLQSVSSQFKSLSPNQK

SEQ ID NO: 26791 - protein, 1462 aa, Candida albicans SC5314
MSTVVNRRSSHQFDSPSNHLDHSSSMNVDKVVQSVTNATKRLSQISTNTNNSNKKRKTQNKIGPWKLGRTLGRGSTGRVRLAKNTTTGQLAAVKIVPKSNFKKLENPKYKRSKEDATRLPYGIEREIIIMKLISHPNIMGLYDVWENKNDLYLILEYIEGGELFDYLIKRGKLQEYEAINYFKQIINGINYLHQFNICHRDLKPENLLLDFNKNIKIADFGMAALEVKEKLLETSCGSPHYASPEIVAGKNYHGAPSDIWSCGIILFALLTGHLPFDDENIRKLLLKVQSGKFNMPPELSFEAKDLITKMLKVNPRERITIDAILTHPLLAKYPEPTVSYSSTTTLDINSINIKQIESVDKIDKEILKNLSVLFHNCDEKTIISRLLSPNRCPEKMFYYLLMKYRNEHLSNSNSFNSSNDVDSARSLPRSTSYVKTTVTDHATGEKHTTVKKIQQSSSIYSNRSLLKKSTSAKGNVLSNITNRPNTPKQFSASSSFNKKKALHSKTQIYASRSRNASSRSLKSNSSTGRNGNNASVTSVNKIPEITGATVLQPIPSMAMNRGDEQQNKTKKNLTGTFGNKSLLNFQLICEEVFENDKENSKPVSKTPVSQLPPPPPPPIETPTSRTNSVKRGKTWSLARRERELAEQVRQRNEARENKLKAEELARKELEQEKKRIAEEKKRLEQQERELDEKQKLQEKQKAALEKLQKHQSAHDFEGLFASNRRSVTDMAPSSGMSSLDPRAHMVSRANTIGSPNLSSSSVNIDENASKVLHKFGIDVAPSPKRFSRASKTSTSKNLSSFLAPTVSRNLSSQLKTSSSKNLAGYLHGTTDTNGSAIAAKKKDDSTNEALTIEEFNAKERTSMSPSISKASVNKRNSNQSSYYRSMFSDNGNDDNVTKVRTGESHLSVQEEEEMDMENAIDEDISLIPNPRFSRFSFGGLLGSNTVANEEGDWTIMNSTLNHSNTVVRGTHNKSSTMLGLGIKMRDTTTIKEDEEFEDEKPFISVPSSEDDEGNTHKNKRGGLRDSGNYDFDEEHSVASTANTEYSDVASQGQQMPGSHTIHQLETELSNFDLLSYRVADIGKVNKHKPSIVDSKETLLKNHSSDEATIEVKEDNNEHDFNDKIKQHYDDNGDSEEDDEDEDEEEEDDDDDDDARSSFEARPHSHNYSLAEITSESPVGGGYESPSIANDFKKSRHSTGIFSTTQFPRSPYVVNNNGDSNKDENSQQQTKHMLNDGHKGLITSPVQDTFGSKKPVESNSLFRRLSLNPNRAAPKAPAPPPPSAPISSAAKANISQPLSSPTKGHNRFSRISIGSKNMLQKEDKSTKSNWFKKFFHSLTTPSAKDQSGNSSSKVASKDIKIIDTSLTAAQLIRVIKYQLELKKIEGSISKVDIDEEFGLISGVIPSKFANGRKLKFKIEVIDLINSSSLHVIKMKGNDKGFQSLVNIVTFIIKKEEQDKISRR

SEQ ID NO: 26792 - protein, 341 aa, Candida albicans SC5314
MSSSTTVFVSGASGFIAQTLVKQLIEKGYKVVGTVRSNEKGDSLKENLKAAKLQSENFTYEIVKDIAVKGAFDDALKKHPEVTVFLHTASPFHFNVTDIEKELLTPAVEGTNNALQAIKTHGPQIKRVVVTSSYAAVGRFADLADPSIPATEESWNPITWEQSLSNPLAGYVGSKKFAEKAAWDFVEKEKPNFTLSVINPVYVFGPQAFEIKNKSQLNTSSEIINGLLNSKPDSKFDNLTGYFIDVRDVAKAHIVAFEKDSIQGQRLILAESPFSTQSILDLIRKDFPQLDSQLPKGDPSQADAWKKAESKIENEKTRELLGFKFIDFKKSIDDSVAQIIG

SEQ ID NO: 26793 - protein, 326 aa, Candida albicans SC5314
MEEYKLQPMAKESNHLLSDIKNFIKIDSNASFIAGGIAGAVSRTVVSPFERAKILLQLQGPGSQQAYQGMFPTILKMYREEGWKGLFRGNLLNCIRIFPYSAVQFATFEKCKDIMLHYNPRDTQQLNGYERLIAGSVGGIVSVAVTYPLDLVRARITVQTASLSKLNKGKMVRAPKVMETLKDVYKNEGGILGLYRGIIPTTLGVAPYVAINFALYEKLREMMDSSPRDFSNPVWKLSAGAVSSFIGGVLIYPLDLLRKRYQVASMAGGELGFQYRSVAHALHSIFTTEGFFGAYKGLTANLYKIVPSMAVSWLCYDTLKDWINRW

SEQ ID NO: 26794 - protein, 362 aa, Candida albicans SC5314
MTLTTPELNFKAYTYKNSSTPVQLTDKSIKLVKDPSNPDSYVAPPGKILLKINYTSLNPVDVKLHHLATSLVSLLVNNNNGFGRDFSGEVLSIGDNVKTNVKVGDLVQGIYHKVYSQGTASQYLLVDPNEVDMIAKPDNISLAEASSWPTVFGTALLMSKDLKYKDSKVLVIGGGTSVGRYLVQLAKQGGAKEVVVTCSPRTEDVIKSLGADTIIDYTKHKNILYPVLESVKSTGKFDYILDSYGGHELFPEINNILTEKIGRYYSIVGDYPGSSFYNLISTVSKVAWRQLLGALGLLSFNYKFIMLDNFKESMQEARDLIGSGNLKIFVDSIYPFNQLDQAIEKLDSGKAAGKVVIEVAKE

SEQ ID NO: 26795 - protein, 322 aa, Candida albicans SC5314
MFGQKKCSNKPQQGTILANSNQVNMDTSTVLEKYTQDLSNLPLEVRHLLEEIKSKDVQVSEARKRYQTRDHQLHKFIRTNGTLTKHPKEDQLYSKIEEDMKLVQKLQKEKILLANTALFLISKHLYHFETDIAKLERDELLPPLEHPIELTEVSKDEYAKSLNGFSDSASATPTPRNGSSATPVAETVKKIQKKKLSVKGASSSSAQSSSASRQVKRLRSEEIEDPLPYEGGSLAFNGNVAMSINSAADANGPNGEDADNNLYCFCQRVSFGEMIGCDNEDCKYEWFHWSCVGITSPPKDDEIWYCPDCASKMEKRKKKRKN

SEQ ID NO: 26796 - protein, 377 aa, Candida albicans SC5314
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVEGLTHPYMEAYHDPTDEPVCESKFDWSFNDADLPVDTWRVMMYSEILDFHQTVGVANETEGSEQPDSQVEQNNLDSANGA

SEQ ID NO: 26797 - protein, 248 aa, Candida albicans SC5314
MPKLVLVRHGQSEWNEKNLFTGWVDVRLSETGQKEAKRAGELLKEAGINVDVLHTSKLSRAIQTANIALDAADQLYVPVKRSWRLNERHYGALQGKDKAQTLEAYGQEKFQIWRRSFDVPPPKIDPKDEYSQVGDRRYADVDPAVVPLTESLALVIDRLLPYWQDEIAGDLLAGKVVLIAAHGNSLRALVKHLDNISDEDIAGLNIPTGIPLVYELDENLKPTKPSYYLDPEAAAAGAAAVAAQGQKK

SEQ ID NO: 26798 - protein, 226 aa, Candida albicans SC5314
MEEDNQQDQNNQYVIYHPFFSEGCHFYFIISCTNSFIRVALKIGLIGDSQIGKTSLMVKYVEGSFDEDYIQTLGVNFMDKKIQIRNTTITFSIWDLGGQKEFINMLPLVSNDAVAILFMFDLTRKSTLNSIKEWYRQVRGFNKTAIPFLVGTKYDQFIDLSFQDQIEITQQAKKFGSAMKAPVIFCSTSHSINVQKIFKIILSKAFDLKLNLDEIVNVGEPILIYK

SEQ ID NO: 26799 - protein, 507 aa, Candida albicans SC5314
MLILLPIAVIAASIYYIAEYWKRESIKRKYDCQPVKQAPLVTWYDIFGIKALVDNSNLTKSGYFYQDIQRKLDNLDTTTMKTTALGKNQIITIEPENFRTMCSSADLNNWTIGTRPIALKPLLGNGIFSSEGESWKHSRIMLRPIFAKEHIKQITAMESYIQSLIKVIKLQQQGEGEFDLQHLFHCFTIDYATDFLFGESCDCLKSILGETSISTMSEEEKSKFAPNFDVMQYHMTKRLVFGYFSFLVNPPEFKNAVKHLHEFVFHFVDRAINFTDEELNDPSKNYVFLYQLAKQTKDRKVILDELLSVLLAGRNTTASLLSFMFFELAQNKPVWNKLKKEITEHFPDVESITFETIHNCEYLRWCIHESLRINPPVPINTRTANRDTVLPKGGGKGNNYPIFVRKGEQVIFPLFSSNRQERFFGPEPEKYIPERWANLPRNGGVAFGPFGTGPRLCLGQQLALVEASYVTIRLLQTFSQLDSNHTECRRSVGATMRLMDGCQVTLK

SEQ ID NO: 26800 - protein, 269 aa, Candida albicans SC5314
MCVSSKDPLLLGAKGTNAGASPFVIAIKNAKIHGLDHLINACILLFVISASNSDMYVCSRSVYSLSVDGYLPKFFSKTNRMGVPYYGVLLSFLFCLLAYMNVSSGSAEVFTYFVNVVSLTGLIAWACILTFHIRFMKALKAQGLDRKKDLVYRSPLQPYGSYISLVICIVIIFIKNFTVFLGDTFDYKNFITGYIVLPVFLIFFFGYKIVYKTKWLKPEEVDLDTFRDVIDAEFEKFEAEEAERKAIREAEGKRFDAQWFYDKFLGWIF

SEQ ID NO: 26801 - protein, 266 aa, Candida albicans SC5314
MVFGYNSDKGLSNEEKRSSTADLESVITQHTNNYDLYIARSNPSAHNAEEGHQLRQELHARHVSLIAIGGALGTGLLIGTGSALKTAGPGAILVAYGAIGFVVYMVMTALGEIASFIPLPGFANYGKRYADEALGFACGIVYLIKYLVLPANQLTAGALTMQYWVSRDRVNPGVWITVFLVVITFINFLGVKVFGEIEFWMSILKVLTCLGLILLLWIIALGGGPTHERLGFRYWKNPGAFIHYSIPPKMWLLVVQKGDSLRLFQF

SEQ ID NO: 26802 - protein, 226 aa, Candida albicans SC5314
MEEDNQQDQNNQYVIYHPFISEECHFYFIISCTNSFIRVALKIGLIGDSQIGKTSLMVKYVEGSFDEDYIQTLGVNFMDKKIQIRNTTITFSIWDLGGQKEFINMLPLVSNDAVAILFMFDLTRKSTLNSIKEWYRQVRGFNKTAIPFLVGTKYDQFIDLSFQDQIEITQQAKKFGSAMKAPVIFCSTSHSINVQKIFKIILSKAFDLKLNLDEIVNVGEPILIYK

SEQ ID NO: 26803 - protein, 207 aa, Candida albicans SC5314
MNNEYDYLFKLLLIGDSGVGKSCLLLRFADDTYTPDYISTIGVDFKIRTIELDGKTIKLQIWDTAGQERFRTITSSYYRGAHGIIIVYDVTDQESFNNVKQWLQEIDRYATGGVMKLLVGNKADLSDKKIVEYTAAKEFADALDIPFLETSALSSTNVEQAFYTMARQIKAQMTNNANAGNAANAKGKSNVNLRGESLTSNQSNSCC

SEQ ID NO: 26804 - protein, 1162 aa, Candida albicans SC5314
MKFGKTYVTHQIPEWSIYYMNYKQLKKIIKSIDSAANTNVDESKYPEVISDTLGSFFYDLDRDIEKVDSFYNTKFKEYNRRLNKIFQVLGYQDGQITHNIESSEELDEIINILIELKSLFRNLKWFAELNHKGFIKILKKLDKKLTSILSQHSGVSVGGVSNHNQEAYMGSRINALPFANGTEASNCLDSIHHILSRIETRNDVVQETIPVENNETSISALIKNDDFEGLKKHITIKSSQKFLISTLNKAALANSTKCIDVIWNQLDMLYDDSDFNGRNFFHQHIISLGKAQFIREEQIVPGEVTNRLIGGDNGPDNSNKNDNPIGLLYILNKLKHKRLILAEDHYHRTPLHYASQYGLVEVTRYLVEFGVKWGLINTSISIDDVSIWGDQEGLTPLHLSIIGKHPKTTETLLGFNKAQTLTCPNLLLLAVRLNSPQILNSLIVEGNIDVNYTDIDHRNETALYIASKLNHPDLVEFLLESNANTEIGENVFGWTPIFIAASEGFMTIVKLLKEYGASYDIVDDSGWLPMEHACLRGHLDVTDLLLPKNEKLLLYDMYHPENNLPRIPSLAASPVLTGSDDGTVSTSSIDKLPEPQKNTVNQFYKQLKNNSSNNVSRSTSPKRNKRYKPVKSFGHRYLNEDESLILLTLGTTDLRDTNVPVELNKVSLAKSFATELDTALSLSITCRHKLTNNPVEPPVVVDLPLEDFHGSATDPISFKLSNDLTVNDVIITFDIIPTYQVNKKVIGRAIALLKDAYTKVGPNLRSLNNSIAIPIIESTNLDILGTIRFEYLQVLPFKHKAMSIARSDTYWKQLVSTRVIGHRGLGKNLSGKKSLQLGENTVESFIAAASLGASYVEFDVQLTKDHVPVVYHDFTVAESGVDIPMHLLTLEQFMGFNTPTEKPTHTVDDEVLTRGKQRAQSSYQLSNNHNDDIEKEFANQRDERMKFTKTWKNQGYKGNLRGSSVASNFVTLRELFRKLPNNVGFNIEVKYPMLDEAQLEDMGEIGVDLNFFVDTILKVIYDENTTGRDIVFSSFHPDICLLLSLKQPTMPVLFLTEAGTAPMYDIRASSLQNAVRFSKKWNLLGIVSNALALIKTPRLAQVVKSMGLVCVTYGTENNEPELAKIQMRAGVDAVIVDSVLAVREGLREHNETMNEFEDSPTE

SEQ ID NO: 26805 - protein, 434 aa, Candida albicans SC5314
MQASLFRIFRGASLTTTTAAASFTATATAGATTAKTLSGSTVLRKSYKRTYSSSVLSSPELFFFHQFNNNKRYCHTTTTTNTKTIMSEQIPKTQKAVVFDTNGGQLVYKDYPVPTPKPNELLIHVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILSRYVLDTS

SEQ ID NO: 26806 - protein, 1162 aa, Candida albicans SC5314
MKFGKTYVTHQIPEWSIYYMNYKQLKKIIKSIDSAANTNVDESKYPEVISDTLGSFFYDLDRDIEKVDSFYNTKFKEYNRRLNKIFQVLGYQDGQITHNIESSEELDEIINILIELKSLFRNLKWFAELNHKGFIKILKKLDKKLTSILSQHSGVSVGDVSNHNQEAYMGSRINALPFANGTEASNCLDSIHHILSRIETRNDVVQETIPVENNETSISALIKNDDFEGLKKHITIKSSQKFLISTLNKAALANSTKCIDVIWNQLDMLYDDSDFNGRNFFHQHIISLGKAQFIREEQIVPGEVTNRLIGGDNGPDNSNKNDNPIGLLYILNKLKHKRLILAEDHYHRTPLHYASQYGLVEVTRYLVEFGVKWGLINTSISIDDVSIWGDQEGLTPLHLSIIGKHPKTTETLLGFNKAQTLTCPNLLLLAVRLNSPQILNSLIVEGNIDVNYTDIDHRNETALYIASKLNHPDLVEFLLESNANTEIGENVFGWTPIFIAASEGFMTIVKLLKEYGASYDIVDDSGWLPMEHACLRGHLDVTDLLLPKNEKLLLYDMYHPENNLPRIPSLAASPVLTGSDDGTVSTSSIDKLPEPQKNTVNQFYKQLKNNSSNNVSRSTSPKRNKRYKPVKSFGHRYLNEDESLILLTLGTTDLRDTNVPVELNKVSLAKSFATELDTALSLSITCRHKLTNNPVEPPVVVDLPLEDFHGSATDPISFKLSNDLTVNDVIITFDIIPTYQVNKKVIGRAIALLKDAYTKVGPNLRSLNNSIAIPIIESTNLDILGTIRFEYLQVLPFKHKAMSIARSDTYWKQLVSTRVIGHRGLGKNLSGKKSLQLGENTVESFIAAASLGASYVEFDVQLTKDHVPVVYHDFTVAESGVDIPMHLLTLEQFMGFNTPTEKPTHTVDDEVLTRGKQRAQSSYQLSNNHNDDIEKEFANQRDERMKFTKTWKNQGYKGNLRGSSVASNFVTLRELFRKLPNNVGFNIEVKYPMLDEAQLEDMGEIGVDLNFFVDTILKVIYDENTTGRDIVFSSFHPDICLLLSLKQPTMPVLFLTEAGTAPMYDIRASSLQNAVRFSKKWNLLGIVSNALALIKTPRLAQVVKSMGLVCVTYGTENNEPELAKIQMRAGVDAVIVDSVLAVREGLREHNETMNEFEDSPTE

SEQ ID NO: 26807 - protein, 251 aa, Candida albicans SC5314
MAYYQQQMGNPQNMQFYQSNYSYQQPTNAQGTSGMMGSMDSNFGSNIDVSGVMGNGELTPGLLAAFGTSGYPGEPPLLEELGINFQHIRSKTLVVLNPLTKDIPSDIMADSDLAGPILFVLLFGTLLLLAGKVQFGYIYGVGLFGIIGLHYLFKFMSNETTIDLIRSASVLGYCLLPLVLISVLGVVTSLDNLVGYILSAIAVMWCTYSASGFFVSVLKLHNVRPLIAYPLCMFYTVFALMAIFVENVEEK

SEQ ID NO: 26808 - protein, 435 aa, Candida albicans SC5314
MEARFFRIFKGGSLTTTTAAASFTATATAGATTAKTLSGSTVLRKSYKRTYSSSVLSSPELFFFHQFNNNKRYCHTTTTTNTKTIMSEQIPKTQKAVVFDTNGGQLVYKDYPVPTPKPNELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 26809 - protein, 1732 aa, Candida albicans SC5314
MRRRHKDKHNTDSVSDMSSNDSASILSSASQNSTHSRRSASLQSLHSQSHQYPQGHNNSSHRQASTYSISSLSPYDKGASLSRKSTNISISRPIKTNDSNVFPIKQSFQLERPNSAFEIERMFRELLEKLNFKSLPPQATREMLNYDIDRKWMMIEQDARAEYDRQQRYARAQNIFSPEEYAKVLMSKQVSTNQLSGLWLALRSEPIDWVRRFVYDCQGDTLLSVYLTKLQQEMVSCNITDIEDDIFDKEVNVLQSLKCLMNQRLGAERIKTDVDVFVNAVSGSLLSPRIITRKLATDTLTFMISYNGNNDNGRYHKVLRALDSINEKSRMEFDSPDNYSPRKLTRKPPQPANFKRFELWLNVVEKTIDARGKFRNSDVGASDELKSAYAGTRGSVITTRNQLENHLVEYCIATMLLINVIVGNGTDYRVRIHLRAQFRAAGLDRIIHKFLELGNEELDNMITRHKIDANNDEEELKYSANFNNEDNEVDFNDPVNLVQSLWQSVKNSDAEGYFLSAIQHLFLNQSEKRGNPEEMNRSLRVLDGLIQNISSVRTVSEDTAINVAINKLISNMSTDDMYRKALEDVKIYRRIAEEATAERDDMSRQLSMGADGYINSLLNDVKERDMVISRFRRINEDMKEELEQMKTKYMQEKQESELEMRELLIMLNNSEIGANAVKKDGGKTTISISTSNEELAARLKKQIHRRRAEYKLDNRQLGTNVEPSSRLRALRDQMGDIENMARELEMTDFETYADPEEEENNNDQSPEKSEIDESRSSQESEAEIQSVEEDEEEEEKEVVIPPLPVPSGPKRAVRNDDLVRLDHLRKKLANLQSESNDIMKYNSSSMFNKQKFLAMERLQELENNFKDFNIDFAVSDPEDKYNFNSNAGSVDDSIKNKTKEVLAEAEQIREELRRQLAAAQKIKSPSPKRNTVLERIENKYVKGQVKIDAPDVVSNSPRTQKRAHRSTTLNAMDPKFLQELSLKVGKAEPIQDANNKNQFGGPLSSSPEDVSQKHKTSGDSSDKDKVLSSPISSNDIKSPETGNSTTSSAAPPPPPPPPPPPPPPLPPILGGNNSSAAPPPPPPPPPPPAFLNGSGSVIPPAPPLPPPSSGRSSRSVPSTVTKSSGSAFDKIPRPKKKLKQLHWEKIDHSQVGNSFWNDPNTHTLVDDLMSKGIFDEIELIFAAKEAKKLATKKKEDLDKVTFLARDISQQFSINLHAFNSFSDEEFVLKVLRCDKDVLTNPAVLDFFGKEDIVEITNTLARNFEPYSTDYKTEEITKPEKDPNELQRPDRIYLELMYNLQHYWKSRTRALNVVVNYDKDYVEYVKKLRLIDEAVDSIKNSKHLKGVFEIILAVGNYMNDSAKQAHGFKLSSLQRLSFMKDEKNSMTFLHYVEKVIRTQYPEFLEFINELSCCNEITKFSIENINNDCKEYARAIKNVQSSIDIGNLSDVSKFHPSDRVLKAVLPALPRAKRKAELLLDQANYTMKEFDDLMKYFGEDPTDQFVKNSFISKFTDFMKDFKRVQAENIKREEELRVYEQRKKLLEKPKSSNNGDSNASDQDGESNEGDGGVMDSLLQRLKAAAPTKGESASARKKALMRKQILESQRKRTTGSVGSPTNVSPTRNNESDSGVDNKDDTHGSSPLDEQFHDSITTQEDRIRDDNRPPEGVADFSNVEDPENPDVGARAKNLLQELRGADESSSKLSDAQRYRQERLKKKSVQIDLDEVAKNNNSE

SEQ ID NO: 26810 - protein, 344 aa, Candida albicans SC5314
MSPSTQQQVHESNQSQSNDSSSIGLRLNDNNIQPIEIELSSFKHDSITFHKQDSSYWFYEKSKQSFPGQSFGLQVEKILYHTKSSFQDILIFKSTNFGNVLVLNGIIQCTEKDEFAYQELITHLPIMSHPSPKKVLVIGGGDCGVIRELIKHVNDQTIQEITMVEIDDMVIKLSTKFLPEMAKYHNHPKVNLIIGDGFEFLKNSSKEKKYDVIITDSSDPDDGPAEEFFQINYFKLLLNALNEKGIVIMQSSENIWLNLPYLKELKSKAATVFSNVKYCQCYMPSYTSGQLGLIIATMDTGKDLVNPLRKFDHDKELKLFKYYNQHIHTNSFVLPTWADDYLNN

SEQ ID NO: 26811 - protein, 507 aa, Candida albicans SC5314
MTSNNDDNVNLEKLNISDEIINDYDNGSQEQLDVLEAYQTDEDKQEQEQKEKEKDVELDNPDLEEEVGITMNDDKGDHKLNNQKIDDEINKGDEKDVKASDDDHDDDDDDDFDDFNETSFQQAPTIGSTNQENGHDDNDDDDDDDDDDDDDEFGDFDDFQVSQPSPTQQQQQKQQSQTQSQSISIDKVNFPTTIFNSPKEFSQRLTTTLDEIFPTSTPILEDNNNKNQITTSIQLLNERSQEIYKQLSTLPYLQPTNWIKSNIRHNLLIKLGIPINLDELNDTNTISANPNNKNIVTSETQNDLKIPGYNFGSGGGGGSGGGFVSVSGRQRKSSISINDINWNELNLISEIPKFESLNIDDNLKNSLINSTLDKLNQFELDNLYHNSTTTTTTTISVTTAAEGDGSSNNNNNNNKSNSSSNDSGSTIGGGHANSQWIDEKLNKLTSNYNELLTLSSIWINQIDQLHEEFEIYENVIQSFIGYNQKLRREEIFENLKKLKKKKGKATK

SEQ ID NO: 26812 - protein, 507 aa, Candida albicans SC5314
MTSNNDDNVNLEKLNISDEIINDYDNGSQEQLDVLEAYQTDEDKQEQEQKEKEKDVELDNPDLEEEVGITMNDDEGDHKLNNQKIDDEINKEDEKDVKASDDDHDDDDDDDFDDFNETSFQQAPTIGSTNQENGHDDNDDDDDDDDDDDDDEFGDFDDFQVSQPSPTQQQQQKQQSQTQSQSISIDKVNFPTTIFNSPKEFSQRLTTTLDEIFPTSTPILEDNNNKNQITTSIQLLNERSQEIYKQLSTLPYLQPTNWIKSNIRHNLLIKLGIPINLDELNDTNTISANPNNKNIVTSETQNDLKIPGYNFGSGGGGGSGGGFVSVSGRQRKSSISINDINWNELNLISEIPKFESLNIDDNLKNSLINSTLDKLNQFELDNLYHNSTTTTTTTISVTTAAEGDGSSNNNNNNNKSNSSSNDSGSTIGGGHANSQWIDEKLNKLTSNYNELLTLSSIWINQIDQLHEEFEIYENVIQSFIGYNQKLRREEIFENLKKLKKKKGKATK

SEQ ID NO: 26813 - protein, 503 aa, Candida albicans SC5314
MPNPTSIHNFLDKRHSITPLLGWSTFIICLSALQFGYHLAELNAPADVLSCNVKKPGPLPSYNNTIWSHFHFNQCINMTEQGVTLITTMFTIGGLLASIILGTTSISTNYGRKHLCVVAALFYVSGSFLMSFSQTNWQINLGRLLNGFGAGSSLIVSPILINELAPLNHRGLLGSLMQSAVSIGIFIAQIVSYLYSNDQQWRLIFLVAGLIGFVQFVGLLTVPESPKWLTMAKNDVERATLILKGLRTDESTVDYEIHHWGNLTTTNLPDDETSSLLSDDSLSSRNPPSIPTKDFIMERKYRKQLIAVVLIMTGQQLVGINAITYYGVKILNELFSGSNTGNLVLMLNCVFSGMNVAASIAVAPLIDRWGRKPLLMTSITMCAICTSILAIGIPNRYDIAVVTACIGFVTGWALGLGPLPFLMISEFTGHDVVATAQSLGTVMNWSSNMFIAILFPFLTNILGIGMVFWVFVINSLVYGFGFYHYVPETKGFTHYRDVWEHFS

SEQ ID NO: 26814 - protein, 321 aa, Candida albicans SC5314
MEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSRASAESKHKKTL

SEQ ID NO: 26815 - protein, 321 aa, Candida albicans SC5314
MEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSQASAESKHKKTL

SEQ ID NO: 26816 - protein, 418 aa, Candida albicans SC5314
MKLYIFVLVACVSSQTIFRSPSLLDQLYGELHGRTNTAPNLQVQAEDPNQMVTQKVLAMRSKLTLPDKDDTSDIAIDQNMFGGILTYAHFNHFNCFISDDFDKHSTTDQQTTKNIDIAIVGAPFDTGTSYRPGARFGPESIRSNSRRLGSAWKSTKKRFNYPVNPYDETTHNYSIIDCGDVAMTPFDNRIALNQLYRGHRSISKHPGNVNQHPKIITLGGDHTITLMAIKNAHEQLRTKIRVFHFDSHIDTWDPKKLGGGITDYMSLNHGTFLHYATELGYIETKGNYHVGIRAPYIDANYDKQHDADCGFHIIQANDIDKIGVQGIIDELAKDPNIPTYISVDIDVLDPAYAPGTGTMEAGGFTTRELLSILDGLKNKVNVIGGDVVEVSPPYDTNSEITSLAATSVVDSLLKLMIV

SEQ ID NO: 26817 - protein, 475 aa, Candida albicans SC5314
MSLEDDEALFEDLYGDDEKQEEKQDTVQKEVESTEKETTVVETASATENASSAEVETTTEGESESVPPPPPPPIPASGDVNAQSNTAQDNATSTAPGSVPAGMPQFPFDPAQFQQYAAANGLQFPGNANQQNFGAAGGVPPPPPPAPTANATSAESAGGPSRKCFIGGLSWDTTEEALVSHFQKYGNIVDYTIMKDSATGRSRGFGFLTFEDAKSVDALLKDRHVLDGKLIDPKRAISKEDQEKVGKIFVGGIDPMVTEEEFDNFFSQFGKIIDCQLMIDKDTGRSRGFGFVTYDSPAAVDKVCVNKYLTLKGKAMEVKRAAPRGQHNQQVMMQQQQQQQQQQAQQQAQQQAMYPYGSYGFQQMNPGAMNPAMSQEYMRYYQWFMYQQAQAAQQQQQSGTSASPEAQPAQPLNPQQQAAEEESEKSDEQARPAIPTGPKRAPPTGPSYRGGGRGGGRGGYRRGRGYHPYSRGGRR

SEQ ID NO: 26818 - protein, 337 aa, Candida albicans SC5314
MTKVFITGASGFIAQHIIKLLLSKGYEVVGTVRSTTKGEQLKSFMPSDAKFTYEIVKELSTPNSFDEALSKHNDIEYLFHTASPLTFDTEDPENVILQPAIKGTENILHAAADLCPNLKRVVLTSSDAAIYSNTDETNPTLSFNEGSWNNTSYQDALKDNITAYYASKAFAEKLAWEFVLMQKPVFGLVVVNPSWVFGPKAYDFDPKRFNSSNEMIDDLLKLNHENNSTFENVSGGYISATDIAKVQVYAIESDDLVNKRLLMTNGYFTCQQILDIINKHFPELNLPKGNPGTEAEEFKKLARVNNDATRKLLPWEFEPLETIVVDTVKQILESKQN

SEQ ID NO: 26819 - protein, 375 aa, Candida albicans SC5314
MASTDTNNSKTVSSSTSSPSTPTKTATTKTTATPPIQSSLEVPSLANNSNGSSSTSTSSTNASSTGANDSNYDPFAGLSFRVGVAENKNTTFRNKMEDVHTYIANFAERVDWGYFAIFDGHAGKDTARWCGNNLHTLLEEEIDRNSDEGSPPPTPITGKDDLREDLYKCFVKADELIEKSGQGKSGCTAAVAVLRWESDNEEPVSHTKSQDGGKFDFKPTKNHKRLLYTSNVGDSRIVLCRAGQAYRLSYDHKATDTHEINRIEDNGGLVLKNRVNGVLAVTRSLGDTYMKSLVIGVPFTTATEITADDEFIIIACDGLWDVVSDKHACKLAAESFKQGYSPSQVAKKLCQFAIELSTTDNVTVMVVQLDNDVFS

SEQ ID NO: 26820 - protein, 3302 aa, Lyngbya majuscula
MAKLNLNQDLGNGNSEVVQLAELGDGIVQITMNDEKNRNSFSKNFIDKLFRCFELVNQNPIYKVVIIAGTSHYFSTGATQEQLQSIFREEIKFTDFYEILTLALDCPLPVIAAMEGHALGGGLNLGLYADFLVLSRESFYANNLMKYGLTPVGSTSLILPKKLGAELGQEMIYTGRQYRGEELAQRGIPFPVLPRKEVLNSARKLAKEIAEKPRLSLLALKENLTAEIRTKLPEVVSKELEMHEKTFQQVKVASQAIHQTTSQPVQLKIASYGLLKNLTWVSLENQVPGVGEVKVQIQAVPVNFRDILNALGMLQEHNQTKLGITSVDHLTFGFEAVGVIVGVGLGVSQWQIGDEVMVIGCHDAFSSFIICSPNNLVAKPANLKLIEAATIPIPFFTAYHGLYNLAKIQSGERVLIHAASGGTGQAAIQLAQFWGAEVFATTSPQKMAVLREQGIKHVMNSRTTEFANEIRELTQGKGVDVIFNSLTHGEYIQKNLDVLALEGRYIEISKRKIWSHSQVAQKRSDIKYFPFDLLEEFNRDNQLYYQIWKKLIQCFENKELHPLVYKTFPNEDIVEAFRYLQRSKHIGRVVVTMPEIYSHKESSSYRLPNQGQMSQQEEVLQQLQSGEVSLEDAEKLLLEVTGEEVQQKILFKQINNGQNQQIKKDKSENILALLSSGEISLENAEKLLLEPESTKETEKETDAITPAQNTDIAIIGISCRYPGAKNYREFWENLQNGVDSVTEPPPGRWEGQNWYHPDPEHPDTSYCKCAGFIDDIDKFDPSFFQISPGEAQFIEPQQRIFLEEAYHAIEDAGYAPDFLKGRQCGVFVGAVKSDYSKLLSDSGLGTHRLALSGNQLSIVPARIAYFLDLRGPVMTVETACSASLVAVHQACESIKRGESELALAGGIHTMLTPDFQILSSQFQMVSPAGRCKTFDAEASGTVWSEGCGVLLLKSYEQAIRDQDHIYGVIKGTGINYDGNTNGISAPSSQSQTRLEETVYQKFGISPETISYVEAHGTATSLGDPIEVEALTETFAQWTNRKQFCAIGSVKTNIGHASTAAGVSGLIKTILCLKHQKLVPSLHFNQPNPHIDFANSPFYVNTEFQDWEAQEGKPRRAAVSSFGFSGTNAHIVIEEALREGNRQQATGNSEDYRKGNRQQATGNSEDYLERPVHLLTLSAKTETSLAELVRAYQNYLKTYPGLGLADICYTANTGRTHFNHRLAVVAADQQELVEKLQQHQQGDEVAGIYSGQQEYNTTTAKIAFLFTGQGSQYVNMGRELYQQAATFREAINQCDDILKTVETFRDKSLREILYPADDSSDSSLLNQTAYTQPVLFAIEYALCQLWKSWGIEPDAVMGHSVGEYVAATVAGVFSLEDGLKLIAARGRLMQQLPAGGEMVSVMANEAKILETLNAMSRSDKVAIAAINGPQSIVISGEGEAVRAIATHLESAGIKTKQLQVSHAFHSALMEPMLAEFEAVANQITYHQPWIPLISNVTGKLVDTGITSAEYWVNHVRQPVRFAQSMTTLDQEGYELFLEIGPKPILLGMGKQCLPEEVGVWLSSLRPGVEEWQQMLSSLGQLYVEGTKVDWLGFEQDYACQKVALPTYPFQRERYWLETNNGLPKKQYLSTSQNIHPLLGQKLNCASEQQIFQSVLGEGSPAYLSQHRVFDQALFPTTAYLEMATAAGNYQLKTSHLVVEDFLIRQGCILPPGELVSAQTILTPADNQGYQFQIFTQQEQKKQEEQKWVLHATGKIRSDQTETTPTPVDLEKYQRECNHSIEISQHYQQCRQIGIDYGSSFQGIQKLWSGSNQALAEIKLPEELLGETIDYQFHPALLDAALQVTFSALPQTDSDKTYLPVGIEQFKVYRSPGLSLWAYASVMTPVEESQESLTTQVTLVSPSGEIIATVKGLQVKLATQQTLLKTEVESITNWLYGVEWRNKGRLGRLLPPDFLLAPVEVSQQLTPSLAELVTQVDNARTAEIGKSIEALSVDYIVQALSSMGWSYQPTESFDLQAAVQRLAIVPSQRRLFQRLLEILAEVGILQSQQQRWQVQQTLEKVNPTQKSQSLLSQYPEEAATLTLLDRCASQLSGVLRGAIDPVQLVFPKGDLTTAAELYKNSTVAKVMNTIVQQTITKAIDKLPPSRGVRLLEIGAGTGGTTNYILPYLNPNQTEYIFTDIGALFTSKAQDKFRDYRFLGYQTLDIEVDPTSQGLESHQYDVIIAANVLHATTSLKQTLSHVRQLLAPGGMLVLYEATTRTRWVDLIFGLLEGWWKFSDYELRPDYPLLSRQQWKKVLSETGFTQVVTLPEVEGMAKALSEQTVIVAQAATTTLEQTKETSKGWLILADTQGIAQHLASQLRSVGDVCTLVFAGESYQQLAPEEFTINPDNLSEFEQLIETLTAKSPSLSGVVQCWTTEAGLGKTINSEELENLSRLGCGTTLSLVKALVKAGLSQSPRLWLVTNGAQPVPSNHPVIPGVAQSSVWGMGKVISLEHPELNCTRIDLDPEETIEGQADALFNEIWSEDSEDQVAWRGDGRYVARLVGSRHRQPVTQQLVPSQPFKLGSSEKGSLDNLILEPVTRRSPGAGEVEIRVKATGLNFLDVVSALGLVPEQVDGMSQKHLVEMDSFGAECAGEVVAVGSEVTGFHIGDTVMAMAHGSFSQYVTVDATYVVIKPENLSFEEAASIPANFLTAYYALHHVAKIQAGDRILIHAGAGGTGMAAVQIAQQAGAEVLATASPPKWEALRNLGVKHIMNSRTLEFADQVMEITQGQGVDVVLNSLTSGEFISKGLSVVSSGGRFVEISKRGVWDSSQVAALRPDVSYFVVDLVKESIEQPGLINSMLQGLKDKLSNGLLQPPPIKVFPIEEVIDAFRYMQQAKHIGKIVVSQTQLADGTTQKPLSFRSGASYLITGGMGGLGLLVANWMVSKGAKHLVLLGRRSPDDATRKKITELEMAGAEVVVEKADVSDLESMTRVLHKIEQSNIPLTGVIHSAGMLSDGVLQNQSWSSFEQVMDPKVQGAWHLHQLTKNKPLDFFVLFSSVASLFGSPGQGNHSAANGFLDGLAHYRRGMGLSGLSIHWGAVAQVGEAAERGADMRASKQGMGVISPTQVLESLELLMSGEDVEVGVVPLEWSAWQERLAQWPFLADWQETIQTTSETSKSEFLLKLEATAPNERRSLLVAHVRRQLALVLGINNPESIALATGFFDLGMDSLSSVELRNKLQNSLDYSLPSSLAFDYPTVEKLVDYLVGKVVAKESYDTLVPKPTENKNDQKQEKLLADTKELSEEQLEELINQELNLIINE

SEQ ID NO: 26821 - protein, 446 aa, Escherichia coli
MSKQQIGVVGMAVMGRNLALNIESRGYTVSIFNRSREKTEEVVAENPGKKLVPHYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGKYLVDVILDEAANKGTGKWTSQSSLDLGEPLSLITESVFARYISSLKDQRVAASKVLTGPQAKLAGDKAEFVEKVRRALYLGKIVSYAQGFSQLRAASDEYNWDLNYGEIAKIFRAGCIIRAQFLQKITDAYAENASIANLLLAPYFKNIADEYQQALRDVVAYAVQNGIPVPTFSAAVAYYDSYRAAVLPANLIQAQRD

SEQ ID NO: 26822 - protein, 480 aa, Aspergillus niger
MPSLGGLLKKRRTKDSQTLSKELEAGSAQTQTSPNAAEDHHNHNHHQHHHHLFHHHHQPQPATNSGSAANTPPQPQDSVPQQSNRSSGAEKSSDGQVASMQSAVTQASPSAHHTSGLPQPNANAASIQNIINPSQQGAMHSASSGHTQSHHAGRSDARTTKGKYSLDDFSLQRTLGTGSFGRVHLVQSKHNHRFYAVKVLKKAQVVKMKQIEHTNDERRMLNRVRHPFLITLWGTWQDSRNLYMVMDFVEGGELFSLLRKSQRFPNPVAKFYAAEVTLALEYLHTQNIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSDDVKNHPWFAEVTWDRLARKDIDAPYVPPIRGGQGDASQYDRYPEETEQYGMAGEDPHGHLFPDF

SEQ ID NO: 26823 - protein, 448 aa, Arabidopsis thaliana
MEQKFKTDSMNEDRISDLPDALLLQILSSLPTENAIATSVLSKRWRSLWTMLPKLKFDSNFNPVFDDDNIDPTMFSENVYKTLSLHKAPVLESLHLSFEGRTDCLHVGIWIATAFARGVRKLVLDSFYQEDQTVTLPSVLFSYNDSLEILKLKCAIDLDFPSRVCLKSLRKLYLDQVHFKDEESVCNLLCGCPSLQDLVVHRYSNADVATFTIASPSLQRLTIEDLRQEGGYGNGSYVINAPGLKYLNINGVIDIESCLIDKALELEEAKISNVSGITNENILESLTSAKRLILHLSPLEVKVPTGKIFDQLGCLELLTHEREWWNLLSIMLDSSPKLQILKLTDVYLHDNKTNPDERKWNPPKCAPECLLFHLETFLWIGYEWQRGDEKEVATYILENARRLKKATFSTKRIGREKLEDFEKRREMLNELAIVLWDSNSCHLVFEST

SEQ ID NO: 26824 - protein, 266 aa, Escherichia coli
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRRAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 26825 - protein, 352 aa, Allium cepa
MPIESVIIAPPAPRVETLSKSNLHSIPLEYIRPEHERACLGDALEQLHNSNSGPQIPIIDLDSRDCIEKVTKAAKEWGVMHIVNHGISSELMEKVRAAGMAFFNLPLEAKEEYANDQSKGKIQGYGSKLANNASGQLEWEDYFFHLIFPDDKVDLSVWPKQPSDYIEIMQEFGSQLRILASKMLSILSLGLQLPTKDRLEQELKGPEDLLLQLKINYYPKCPQPHLALGVEAHTDVSALSFILHNNVPGLQVFYEGEWVTAKLVPDSLIVHVGDSLEILSNGIYKSVLHRGLVNKEKVRISWAVFCEPPKDAVVLKPLDEVVTDDAPARYTPRTFAQHLERKLFKKKGWRFG

SEQ ID NO: 26826 - protein, 192 aa, Xanthomonas oryzae pv. oryzae
LDRQFVEVLIAPDTTPARDYATKKANVRVLKIHGNALNNYDTKRIGSGLLMQSADNRGMSLGELSVVTQRAPSEAELGDLLFAWRVAKYVKSNAIVYAKDSRTIGVGAGQMSRVVSAKIAALKAEEAKLTVAGSVMASDAFFPFRDGIDAAASAGIQAVIQPGGSMRDGEVIAAADEHGIAMVFTGVRHFRH

SEQ ID NO: 26827 - protein, 218 aa, Medicago sativa
MDHDAIIFEEECDYLFKAVLIGDSGVGKSNLLSRFAKDEFRLDSKPTIGVEFAYRNIKVRDKLIKAQIWDTAGQERFRAITSSYYRGALGALLVYDITRRSSYESVGRWLVELREFGGEEMVVILVGNKCDLGESREVEEEEAKGFAEAEGLCFMETSALKNLNVEQVFLQMITTIFDITNQRSLDAKMDETPINLSNGKEIHIADEVTATKQAPCCS

SEQ ID NO: 26828 - protein, 397 aa, Bordetella parapertussis
MSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 26829 - protein, 401 aa, Bifidobacterium longum
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 26830 - protein, 368 aa, Desulfovibrio vulgaris subsp. vulgaris str. Hildenborough
MAEKDNIIELRGVTKNFEDTCALDNIDLEIRNGEFLTLLGPSGCGKTTILRLISGFEKPDAGVITLKGQRMDDAPPEARQVNTVFQNYALFPHMSVRENVGFGLRMQRRPKDEIARRVHDALRMVHLEAHADRRPRQLSGGQQQRVAIARAVVNNPLVLLLDEPFSALDYKLRKQMQLEIKHLQRQLGITFVFVTHDQEEAFAMSDRVVVMNDGKIEQIGSPQEIYEEPANLYVARFVGEINILNAVIAANHGDGLYDAVIEGVTFPIRSQRTFAPGDKVNVLLRPEDLRVYTLTEDRPAGPHLTGRIEESVYKGATVDLIVTLSDGRRLMAAEFFNEDDVDINYNPGETVTVSWVDGWEVVLPDGEA

SEQ ID NO: 26831 - protein, 244 aa, Desulfovibrio vulgaris subsp. vulgaris str. Hildenborough
MTPMIEIRNLHKSYGDHHVLRGIDLTVRTGEVVVVIGPSGSGKSTALRCINRLEEITSGTIIVDGYDLYDPKTDINHVRTEAGMVFQQFNLFPHMSVLENVTIGPVKVRRMARQEAQALGLALLEKVGLADKAHAYPDQLSGGQKQRVAIARSLAMQPKVLLFDEPTSALDPELVGEVLEVMKQLAREGMTMVVVTHEMGFAREVADRVIFIDYGKIQEEGPPNELFADPKNPRLREFLGKVIH

SEQ ID NO: 26832 - protein, 126 aa, Desulfovibrio vulgaris subsp. vulgaris str. Hildenborough
MTAFVPDFGKAGGLVPAIAQDADTGEVLMMAWMNAEAFEMTLKTGEAHYFSRSRGRLWHKGGTSGHTQHIRAVRLDCDSDTILLLVEQRGGAACHEGYRSCFYREMKDGEVSICSPKVFDPKEVYK

SEQ ID NO: 26833 - protein, 164 aa, Desulfovibrio vulgaris subsp. vulgaris str. Hildenborough
MILMETSSGDILVELFADKAPATVENFLAYVDEGFYKNTVFHRVIKDFMIQGGGYTVRMDEKPTRAPVRNEADNGLKNLRGTLAMARTAEPHSAAAQFFINTVDNEDLDHTAPTDEGYGYCVFGQVVEGLEIVDKIQKVKTKPQGIHSDCPVDMVVITGMSRFD

SEQ ID NO: 26834 - protein, 437 aa, Desulfovibrio vulgaris subsp. vulgaris str. Hildenborough
MSTIVSVWAREILDSRGNPTIEVEVSLESGHSGRAAVPSGASTGTREALELRDGDKGRYKGKGVEKAVDNVMGEIAEAVIGLDALRQVQLDNTLLDLDGTDNKERLGANAMLGVSLATARAASSFLGLPLYQYLGGVNAKVLPVPLMNIINGGAHAPNNLDIQEFMIMPIGAATFRDALRMGAETFHTLKALLAADGHVTSVGDEGGFAPNLKSHDEAFKYITRAIEESGYIPGAEIALAIDAAASEFYRDGKYHLAGEGKTFSNSEMTEWLGEFTAKYPLISIEDGLAEGDWEGWGELTYKLGDTVQLVGDDIFVTNPDILAQGIDEGVANSILIKLNQIGTLTETLDTIEMAKQAAYTTVISHRSGETEDHFIADLAVGLNAGQIKTGSLCRSDRLAKYNQLLRIEEDLDDAGIYFGPMIASHFGYEGDEEFEDA

SEQ ID NO: 26835 - protein, 290 aa, Desulfovibrio vulgaris subsp. vulgaris str. Hildenborough
MTDSPHKRFLASELDDIAPEEARFHVIPAPFEASVSYGGGTGAGPDAILDASDQLELWDGLSIPAAQGIHTHPPVDCTGDAEAVLDRISRATRSVLDAGGTPVLLGGEHTVTYGALAALRERFGRFGVVQFDAHADLRDSYEGSRWSHASVMRRAVSDLGLPLVQYGVRALCTEEVAFRREAGVTHWDAAQLARSGVPARPLPDDFPESVYVTFDVDGLDPSIMPATGTPVPGGLGWYDALRLVERSVSGRRVLGFDVVELAPIAGWHAADFAAARLVYDIMGIIQRMAR

SEQ ID NO: 26836 - protein, 391 aa, Desulfovibrio vulgaris subsp. vulgaris str. Hildenborough
MSAPEPVNGTPPDVAQRLQAIRVTIDGLDRDLLALLNRRAALSLEVGRIKATDPGIVFRPFREREVFDNLEAANEGPLPDEHLRAIWREIISSSRSLQRPQRVAYLGPEGTFSYFAGMEFLGRAMDYRPQPGLPDVFRAVHDRQCELGIVPLENSLQGTVGQSLDLFLQHEVFIQAELFCRISHCLLGTAAALADIDTVYSHPQPLAQCGGWLRAHLPNARIIPTESTAAAARRAAGEAGAAAIGHRSLADLLGLNVLERGIEDQPDNWTRFVVIAPAPADQQGREKTSMLFSLPDKAGALAGVLELLAREGINMKKLESRPLRGEKWQYVFFVDVECDLGTERYARLVEELRTLCHTLRILGSYPVGPHFDMAAHEALPGLPDQIGQGGL

SEQ ID NO: 26837 - protein, 257 aa, Desulfovibrio vulgaris subsp. vulgaris str. Hildenborough
MSASRLERRIREAQAAGRPALIPFLTAGFPTKERFWDELEALDAAGADIIEVGVPFSDPVADGPVVAAASQRALESGVTLRWIMDGLAARKGRLRAGLVLMGYLNPFMQYGFERFVSDAADAGVAGCIIPDLPLDEDADLRALLAARDMDLIALVGPNTGEGRMREYAAVASGYVYVVSVMGTTGVRDGLPVEVADTLARARQCFSIPVALGFGISRPAQLEGLSHPPDAVIFGSALLRHLDAGGDAASFMKAWAER

SEQ ID NO: 26838 - protein, 1079 aa, Desulfovibrio vulgaris subsp. vulgaris str. Hildenborough
MTENKTKVKDLAAELGVTTKELGQVLKDMNISAKTSTSVIAQEDLPRIKERVQAQRDGGARKEGNPDVIVRRRHRDGDRASARAEAKAPEQEATAAMPETSAPERAEEADKPAVAKPAKAPETEAHARARKEPQAEPVKARIIRRPDEPAPVAKVVEAAPAETPAPEAPAVKATVTAEAAPAKTVEPESERPQADKPATARVVRPATPDASAVPDGTSSAPTLPVRSAEPSDTVERADADADGDDDDAQQRRRKKKRRQPEAVVPQVRVISRPDPAAVAQQQMQQQAAQQQREAGGYRPGGQRPEGGYRPEGQREGGYRPEGQREGGYRPGGAPRPEGGYRPGGPRPEGGYRPGAPRPEGGYRPAGGPRPEGQREGGYRPGAPRPEGGYRPAGGAPRPEGQREGGYRPAGGPPRPGGAPRPGGFGGAPGGMPVPGADGRGDQSKKKRQKGRRTVDFQADGPRGRSDDDVMRGPRGRGKRGKKDVRPAATQPLKAVKRKIKVDEAIRVADMAHQMGLKANEIIKVLFGLGVMATINQSLDIDTATVVAGEFGYEVEKVGFSEDDYLVPKEEDAPETLVTRPPVVTIMGHVDHGKTSLLDAIRKSNVTAGEAGGITQHIGAYHVTTKKGEIVFLDTPGHEAFTAMRARGAQITDLVVLVVAADDGVMEQTREAVNHSKAAGVPIMVAVNKMDKEGANPDRVIRELSELGLVAEDWGGDTIFAKVSAKTREGLDELLELIAIQAEILELKANPDKAARGHVVEAKLDKGRGPLATVLVQEGTLRQGDAFVCGVFAGRVRAMFDDQGRKVKEAGPSTPVEVQGFDGVVEAGEEFVSVADDKVARRIAESRAVKQRERELAKESKVTLETFLSRRADAAEALTLNLVLKADVQGTLEAISEAVRKLSTEKVKINIIHGGAGAITESDILLASASDAIIIGFNVRPTSKVKDIAEQENVDIRFYDIIYKLVDEIKSAMAGMLAPVQREVYLGQAEVRETFSVPKIGVIAGCHVADGKVTRNAGVRLLRDGVVVYTGKITSLKRFKDDVRDVQKGYECGMGLENFNDIKVGDVIEAFEMVEEAATL

SEQ ID NO: 26839 - protein, 1005 aa, Desulfovibrio vulgaris subsp. vulgaris str. Hildenborough
  misc_feature (192)..(192): Xaa can be any naturally occurring amino acid
MTVTRRHFLKLSAGAAVAGAFTGLGLSLAPTVARAELQKLQWAKQTTSICCYCAVGCGLIVHTAKDGQGRAVNVEGDPDHPINEGSLCPKGASIFQLGENDQRGTQPLYRAPFSDTWKPVTWDFALTEIAKRIKKTRDASFTEKNAAGDLVNRTEAIASFGSAAMDNEECWAYGNILRSLGLVYIEHQARIXHSPTVPALAESFGRGAMTNHWNDLANSDCILIMGSNAAENHPIAFKWVLRAKDKGATLIHVDPRFTRTSARCDVYAPIRSGADIPFLGGLIKYILDNKLYFTDYVREYTNASLIVGEKFSFKDGLFSGYDAANKKYDKSMWAFELDANGVPKRDPALKHPRCVINLLKKHYERYNLDKVAAITGTSKEQLQQVYKAYAATGKPDKAGTIMYAMGWTQHSVGVQNIRAMAMIQLLLGNIGVAGGGVNALRGESNVQGSTDQGLLAHIWPGYNPVPNSKAATLELYNAATPQSKDPMSVNWWQNRPKYVASYLKALYPDEEPAAAYDYLPRIDAGRKLTDYFWLNIFEKMDKGEFKGLFAWGMNPACGGANANKNRKAMGKLEWLVNVNLFENETSSFWKGPGMNPAEIGTEVFFLPCCVSIEKEGSVANSGRWMQWRYRGPKPYAETKPDGDIMLDMFKKVRELYAKEGGAYPAPIAKLNIADWEEHNEFSPTKVAKLMNGYFLKDTEVGGKQFKKGQQVPSFAFLTADGSTCSGNWLHAGSFTDAGNLMARRDKTQTPEQARIGLFPNWSFCWPVNRRILYNRASVDKTGKPWNPAKAVIEWKDGKWVGDVVDGGGDPGTKHPFIMQTHGFGALYGPGREEGPFPEHYEPLECPVSKNPFSKQLHNPVAFQIEGEKKAVCDPRYPFIGTTYRVTEHWQTGLMTRRCAWLVEAEPQIFCEISKELAKLRGIGNGDTVKVSSLRGALEAVAIVTERIRPFKIEGVDVHMVGLPWHYGWMVPKNGGDTANLLTPSAGDPNTGIPETKAFMVDVRKV

SEQ ID NO: 26840 - protein, 275 aa, Desulfovibrio vulgaris subsp. vulgaris str. Hildenborough
MRTLNSTSPAVIRLRGIVNRFGAQTVHDGLDLDVERGKVLALIGGSGTGKSVLLRTIIGLRRPQGGSIEVLGTDVLHGTSAALRDLRRRWGVLFQDGALFSSLTVLENIQVPLREFLSLPGDLMDEIAFMKLRMAGLPPGAAHKYPSELSGGMRKRAGLARALVMDPELLFLDEPTAGLDPIGAAAFDDLLAELREALGLTVVLVTHDLDSLYAVCDKVAVLADRRILKVGTIDELISLDHPWVRDYFTGPRGRAAQHAPQGIPCPTSQPSTRQR

SEQ ID NO: 26841 - protein, 308 aa, Desulfovibrio vulgaris subsp. vulgaris str. Hildenborough
MDIASSMTDLVGKTPMVRLNKVTLGCVAEVVAKLENFNPCSSVKDRIALNMVEAAIARGEIAPGAVLVEPTSGNTGVGLAFVCAVRGLKLVLTMPESMSAERRALLKAFGTTLVLTPAAKGMRGAVEEAERIVADTPGAVMLQQFANPDNPAAHEATTGPEIWADTDGMIDCFVAGVGTGGTITGTGRYLKGRNPDIRVIAVEPAESAVLSGGAPGPHAIQGIGAGFVPPVLDTSVYDEVMPVPGADALTMARRLLQEEGILCGISSGANVHAAIAYARRPENAGKRVVCIICDTGERYLSTPLFAPE

SEQ ID NO: 26842 - protein, 472 aa, Desulfovibrio vulgaris subsp. vulgaris str. Hildenborough
MNAQSPACHAIILAGGSGTRLWPISRSLFPKQLIALNGDLTLLQETLKRALTHFRPDHIHVVTNEEHVFEVRAQARTLDPRLEAGVIAEPRGRNTLPAILLGLDAAWRATGGETPPTIAVFPSDHMLGDIPRWQAALDEATRLADDGWFVTFGVPPTHPETGYGYIRRGDSIADRSFEVEGFVEKPDHATATAYLKDGRYFWNSGMFVFNGQSLIEAVHAHQSDLGHWWESRGDRPLIEGYTSIPSISVDYGIMEHASRIAVVEADFGWDDLGSWEALYRLGKKDESGCVRRGDTMALDCENSMLFSRGGKLVGIGLKDIVAVQTRDATLVCALDKTQRVKDVVELLKAESSSLAEVHLTVHRPWGSYTVLEEGKLFKIKRITVLPGARLSLQMHHHRSEHWVVVSGAALVQVGETETLLTENQWAVIPRGAMHRLSNPGKIPLELIEVQSGPYLEEDDIVRFEDVYGRKPK

SEQ ID NO: 26843 - protein, 397 aa, Desulfovibrio vulgaris subsp. vulgaris str. Hildenborough
MSQSQFPRMHRLPPYVFAVVNELKMQLRRQGVDIVDLGMGNPDMPTPQHIVDKMVEASMKGNNHRYSVSRGIPNLRKAICDWYTRRFGVYLDPDTEAVVTMGAKEGLSHLSLAMLSPGDVVFAPDPTYPIHTYAPVIAGADVRRIPIGRGRDFFEDLLVATRQTWPQPKLLFLSYPHNPTTELATPEFFQKVVDFAKEHKIYVIHDFAYADLAFDGHMPPSFMQADGAKDVGVEFFSMSKSYSMAGWRVGFCVGNREMVNTLTRIKSYLDYGIFQPIQIAATVALNGPQECMTEIVDTYRKRRDVLIEGLNRSGWEVPAPKGTMFVWAQIPEPFRAMGSVEFSKLLLREAHVAVSPGLGFGAHGDDHVRFALIENEQRTKQALRGIRHLLSGKPCGE

SEQ ID NO: 26844 - protein, 246 aa, Desulfovibrio vulgaris subsp. vulgaris str. Hildenborough
MTIISARNVNKYFYVPEELHALRDVSLDVAPGEVVVIIGPSGSGKSTFLRCLNRLEYADSGEILIEGRDILDPKCEINEVRAEVGMVFQSFNLFPHLSVLENVALAQMTVRKRSRAESEKKGMELLTKVGIADKHAVYPDQLSGGQQQRVAIARSLAMDPKIMLFDEPTSALDPEMVGEVLDVMRNLAREGMTMVVVTHEMGFAREVADRVVFMDHGAILEIATPKDLFTTGATHDRTKLFLSQIL

SEQ ID NO: 26845 - protein, 480 aa, Desulfovibrio vulgaris subsp. vulgaris str. Hildenborough
MDYDADLLVIGGGAAGLTVAAGAARLGARVVLADRGPTLGGDCLHHGCVPSKTLIASARARRTMRDAPRFGLPEVALPPVDFKAVAAHIAGVQSVIQKHDSVERFSGLGVEVRFGDAVFVDEHTVAVEGRRISARRIVVATGSSPQIPAFPGLADTPYLTNRDIFTLETLPASLIVLGGGPIAVEMAQAFARLGSRVVLVQRGGHILSREDADMAAVVHEALEQDGVRIMTGATVEVARRQDAGVVVTVRVGDEHVDVHGERLLVALGRTPNVEGLHLGNAGVVFSERGVPVDARMRTSQSHILAAGDVTGAWQFTHAAGYEGSVVVANAVLRLPRKAKYDRMPWCTFTDPELASVGLNEREAHRQGIGVDVHTESFSSNDRALAEGTACGLLKLVLARGTQRVLGVQIAGPHAGELINGWCMALGGGVRLTTLAGGVMPYPTLGEISRRVAGNIVSEALFSDKVRNVLCTLFRYRGKGC

SEQ ID NO: 26846 - protein, 485 aa, Desulfovibrio vulgaris subsp. vulgaris str. Hildenborough
MSKIVCKALTFDDVLLQPGYSEVTPDQVDVATWLTPSIRLNIPLLSAAMDTVTESGMAISMARNGGIGVIHKNVPIHRQRLEVEKVKKSESGMIIDPVTIAPGLTVRQALEVMAEYRVSGLPVVENDKLVGILTNRDVRFVKDLETTCVSEVMTSKNLVTVPVGTTLEEAKHHLHQHRIEKLLVVDGNNRLQGLITMKDIDKVVKYPNACKDENGRLRVGAAIGIGRDCEERASELIAAGVDVLVLDSAHGHSRNVLRAIEMVKTSFPQCQLIAGNVATYEGAKAILKAGADAVKVGIGPGSICTTRIVAGVGVPQVTAIMEAVKAANEMDRCLIADGGIKFSGDVVKALCVGAHTVMIGSLFAGTDESPGETILYQGRTYKIYRGMGSIDAMKDGSSDRYFQEKSKKLVPEGIVGRVPVKGPVADSLYQLIGGLRAGMGYVGAANMEELREKSRFVEISAAGLRESHVHDVIITKEAPNYRVEN

SEQ ID NO: 26847 - protein, 469 aa, Desulfovibrio vulgaris subsp. vulgaris str. Hildenborough
MSSKFPSSFAEVRARWREPGGYREVLHIGLPLVAGMASTTVMQFTDRLFLSHYSVESIAAALPAGLASLLLLLTCMGVTGYASVFIAQYIGAGQPHRVGGVLWQSLIASLVFGGLLAMTSLLAEPIFSLAGHAPELQRLEETYFIILQLGSVLSLVGNSLGTFFSGRGRTRPVMLANIAAAVVNVPLDYVLINGVWFFPEMGIAGAAVATVMGWGVTAVLLAIAVFNRDHETRFGVRSQWRFDAVMMRRLMRYGLPSGVNFFMELFAVTWFVFVVGTLGEVALAATNIAFSINSVAFLPTVGLNIAVGTMVGQAMGRGDPDGAARATGSTLHVAMAWMTALALVFVLLPGPLVDLFRPDNLTPAAYADIRETTARLLAYVAFYCLFDSLTIIFCGALKGAGDTAFVMWNMTVGCIFVLIIPAYALRALGWWSLDSLWLVFSVYVSVLAVASYVRFRLGRWRKLRLVHPA

SEQ ID NO: 26848 - protein, 247 aa, Desulfovibrio vulgaris subsp. vulgaris str. Hildenborough
MTAANEPIISIRNVWKFFGELTALHDVSLDVQAGEKVVIIGPSGSGKSTLLRSINRLENVDKGSIIVDGKDIRAEDSDINVIRQDLGMVFQSFNLFPHKTVLQNLTMAPMRLRKVPRDEAESRALDLLKKVGISDKANVYPAMLSGGQQQRVAIARALAMNPKIMLFDEPTSALDPEMIGEVLDVMVTLAKEGMTMVCVTHEMGFAREVADRIIFMDHGQILEQGTPQHFFEAPEHPRLQKFLQQIL

SEQ ID NO: 26849 - protein, 274 aa, Desulfovibrio vulgaris subsp. vulgaris str. Hildenborough
MSDTTTAWDIRLEGLRLGYGEKVVLEDVTATLPAGRISMILGGSGCGKSTLLRHILGLQRPLSGRVLLGGNDLFALSGIEFRRTRRRMGVLFQDGALLGALTLGDNVALPLKEHTRLPATTIREVVLHTLGLVGLSDFADYYPSQLSGGMRKRAGLARAIVMHPPILLCDEPTSGLDPINAAQMDRLLLDMKAHFPEMTTVVVSHDLQSLRMIADHALVLHDGKAVFSGSYHDLQATRDPYLRDFLDRTPAADNAMRPALSPEVRAALDAWLAR

SEQ ID NO: 26850 - protein, 456 aa, Desulfovibrio vulgaris subsp. vulgaris str. Hildenborough
MTYDVVILGAGPGGSRAALEAAAAGLRVAIVDKGSFGGTCLNWGCIPTKLLLGGTAAHPLLEVQKKLKTAQGTIDFDLTALQARKTRFINGTRQALEKQLRQAGIEVITGTARLAGPGHVEVVDGEGTRELAARNVIVATGSVPASFPGLAPDGEAVLDSTALLDVTEVPDSLIIVGGGAIGLEMGDFFSRLGTAITIVEGLDRLAPTEDPEIGQTLGKLLKREGWAIHTGRRVASLSTVEGKAQLRFEDGTELVADKALMAVGRRPATAGLGLETAGATLLGAGWVETNDHLLAAPGLYAIGDVNGRTLLAHAADHQARFVISHIASGSASSASGYPAPVMPSCIYGHTEVMRAGATVAELVASGHDVHVSTSQLIANPIAQAYGTTGGFIRVLWVEGQVRGISAVGHGVSHLVTLATVIVSQRWRWEDVHGIIFAHPTLDEALEAALLAPSQKV

SEQ ID NO: 26851 - protein, 176 aa, Desulfovibrio vulgaris subsp. vulgaris str. Hildenborough
MIIKDLKVVYSEEQIAARVRELAQEINRLYKGEPLVVVCVLKGAFMFFTDLVRHLDMHPELDFVRLASYGDATHRGSTISFLKDVEVKLEGKHVLIVEDIVDTGHTMDFLFRQLAARGAKSMRLAVLVDKTERREVPVRADFVGFALPRGFIVGYGLDYAQKYRELGAIYEAIVDA

SEQ ID NO: 26852 - protein, 456 aa, Desulfovibrio vulgaris subsp. vulgaris str. Hildenborough
MAKVRETYVCSACGANTPQWRGQCPTCKAWNTLDAVTVARETRSGVRRQGAPDSVRPRPLRDVSDEGGSPFGTGLEALDRVLGSGLVPGAAILFGGEPGIGKSTLLLQVAGAVAASGRDVLYLSGEESLTQLKGRAERLGVLHERLLAVATSRVEDVFSVLESGTPPALLVLDSVQTLTSDLAEGLPGNVSQVRAVATEVVDRCKRAGTAVLLVGHVTKDGNLAGPRLLEHMVDTVVSLEGDRRQMFRLLRVLKNRFGPNQELLVFQMAQRGLEVVEDPSTFFLGARDPALSGTAVVMAVDGQRPFAVEVQALVTRSYLAIPRRTGLGFDVNRLHLLLAVLEKRLRLNFGQVDIYAKIGGGMRLQDPGMDLALVAAVLSSFYDVALPERAVLWGEVDLNGQVRPVAAHDIRLGQAARLGYGPVLHPGEGRGAVPTVVELQARLFGKSGAPRHNPSE

SEQ ID NO: 26853 - protein, 343 aa, Desulfovibrio vulgaris subsp. vulgaris str. Hildenborough
MRAEPLPPNGRKVAIIGAGPSGLAATGYLACMGYQVEVYDKLPGAGGLMVFGIPGHRIPADRIQRGVHILERQYGTIFHTRTKICCSAPLHEEEGDHFSCDIRGLGELVEGYDAVMICTGSWKSRKLGIPGEALPGVYSGLEFLFPIRAVRYATTNVSLPDVAGRIVAVVGAGHSAVDVVHSAHALGAEKVYMVYRRTRREAPCGSFEIDRIEEAGGTWLERCTPTGIVGDGKVEGLELRDSETGETSVLPVDVVVTAIGEIPTPPFQKELGLENVRKGEVRWLHMTSIENVFVAGDVLTGPSKIGKAVYSGLRAARSLANWLDLRAQHRESEYNYDADVIHR

SEQ ID NO: 26854 - protein, 511 aa, Desulfovibrio vulgaris subsp. vulgaris str. Hildenborough
MSLKPTLLLILDGWGKAPAGPGNAVTLAGMPHLSSLLRQAGCTELACSGRAVGLPEGFMGNSEVGHMNIGAGRVVYQDMTRIDIAVERGELASNPALTGLFEAVRATGGRVHLMGLLSDGGVHSHIAHVEALALAARDAGVEVVVHAFLDGRDTAPTSGVGYVKRLASFLESNRAGRIGSLVGRYYAMDRDKRWDRNLLAWAMLTRGEGAPADDPVGAVEAAYAAGETDEFVKPRVVVEGGSPIGTIRDGDGVFFFNFRADRARQLSHMFVDGTFEHGDRGHVPSLAGFATMTSYDPALGLPVAFDKQPLDGTLGEVVANQGLRQLRIAETEKYAHVTYFLNCGREEPFPGEERRLLPSPRDVATYDLKPEMSAEAVTDTLLEEWAGGGYTLAVCNVANLDMVGHTGVIPAAVRACETVDACVRRIADAVLASGGRLVITADHGNAEELLDESGNPQTAHSMNRVPFTVVEQGRVHTFREGGVLGDIAPTILGLWGVPASAGMTGTSLITE

SEQ ID NO: 26855 - protein, 388 aa, Desulfovibrio vulgaris subsp. vulgaris str. Hildenborough
MAAFKLADRLATLPPYLFAGIDKVKAEVAARGVDIISLGIGDPDMATPGFIIEAMKEAIARPANHQYPSYVGMLAFRQEVANWYDRRFGVSLDPATEVIGLIGSKEGIAHFPFAFINPGDLVLVCTPNYPVYHIATGFAGGEVQFVPLLEENDFLPDLDAIPEDTWKRAKMIFVNYPNNPTAATAPLGFYEKLVDICRRFDVIIAHDTAYTEIYYDEDNRPPSILSVPGAKDVAIEFHSLSKTYNMTGWRVGMAVGNPTLVAGLGKIKENMDSGIFQAVQEASIVALRDGDDFCRELRGIYRQRRDTVINALHKAGIQCRVPQATFYVWARVPQGHTSADFVTRVLQETGVVVTPGNGFGTPGEGFFRISLTVDNARLEEAVSRIAKL

SEQ ID NO: 26856 - protein, 251 aa, Desulfovibrio vulgaris subsp. vulgaris str. Hildenborough
MKKLIAANWKMYKTIDEARATGRELVSAVAGSLPADREVLVCPPFTALHALHDTFKDVEGFAIGGQDVYPATEGAYTGEIAPGMLLDAGCGWVLTGHSERRHILGEDDETVARKTAFSLKAGLRVVLCIGEKLDEREAGRLEDVLAHQLQVGLADVDATYVPQSLVVAYEPVWAIGTGKVAGPAEVVEAHALVRSLLEARYGRDGAAIRILYGGSVKPDNAAELLSLDNVDGLLVGGASLQAVSFSRIILA

SEQ ID NO: 26857 - protein, 1191 aa, Desulfovibrio vulgaris subsp. vulgaris str. Hildenborough
MGKTQAEKPAAKGRPAEADIAELTKKLILNGADIVRIGEDAELLVGGKNYNTALISQVEGIRTPQFRAISSVAFHRLLDETKVNASLIRAIVDKEFNRIDWNDTEINRDPEFLQKFVRNLAKDIHAEVQANPGTLIKLRTFVNNVVEGFATSPEGIDQLRKRSVLVQAGILSVDLPKEVEDEVKRAYRDICKEAGADDVPVAVRSSAAGEDSRKKAFAGLQDTYLNMVGEARVARAYHWDCASAYNLRSMTYRREAILDALARAEATGDESIAIKAKQEWAIENTSLSVCMMRMINPVISGTAFSADTATGCRGTSRRDLVSIDASYGLGEAVVGGMVTPDKFYVFQRDDGAEVVVRQMGCKDKKIVYDEKGGTKKVPVPDLEAYRWSLSLAQAEQVARGVRNISVAYGSMIMDTEFCIDSGERLWFVQARPETRWNEEFETHPHTIFMRRLEVDPKAAAGAEIIVEGNGASRGAGQGRVKYLRSALELNKINKGDILAAERTDPDMVPGMRVASAILADVGGDTSHAAITSRELGIPAIIGIQRLEILRALDGQDVTVDGTRGRVYRGMLPLREVGGEMDLSKLPATKTKVGLILADVGQAMFLSRLREVEDFEVGLLRAEFMLGNIGVHPRALEAYDNGELEHVVHAKLKELDVNLSKLLREQLSAGLIGIDMKLREYVGHVTGLAAEIEELASRDNLRGTEEVLAVHRRMRELDHKLDEHVELATRRMDILKTSVDLADHVRVIMGYDDELALLAGTDPDILKRRAEIEANVRAHVERAEQIPAVQEALAKIASLRHEVGLRSGLQTAMDDVRAVPEKIRLLIRSRGFRTGKEHYVQTLAQGLALFAMAFYGKDIVYRTTDFKSNEYRNLLGGNLFEQHEDNPMLGYRGVSRNIHDWEVEAFKLARGVYGGVNLQIMLPFVRTLEEARSMKRYLEQVHRLKSGVDGLKVILMSEIPANAVLAKQFIEEFDGFSIGSNDMTQMVLATDRDNASLGHIYDEEDPAVVWAILVTIFTGQKYGRKVGFCGQGVSNSVILRGLVAIAGIVSASVVPDTYYQTKLDMAEVESHNIPTEKLGAWLREQHFGKLRQLLDTKGYGHILKKHTQAEDLSDWYEGELRRLHEQLRESMDTPKEKFYRQELAQFRAAFHKPVIYATWDWNRTVEDAMRQAGFASFAEQAEALAAQRAKKF

SEQ ID NO: 26858 - protein, 316 aa, Desulfovibrio vulgaris subsp. vulgaris str. Hildenborough
MGVEFKDYYKLLGVSRTASRDEIAKAYKKLARKYHPDLNPGDKKAEESFKEINEAYEVLKDDEKRKLYDQLGPNWQHGQNFQGAPDFENVRFDFGGGQGFGGAGFSDFFETLFGGAGAGRRGGGGFGPDPFGGFSGRQRKGRDVEAEIALTLEEVHGGGRRAITLQGQTGPRTLEVNIPAGVRDGARIRLAGQGDPGMGGAPAGDLYLKVRLAQHPLFAVEESNLVYDLPLAPWEATLGTTVRVPTLDGEVDIAVPPGTGSGRKLRLKGRGLGPVGKRGDQFVRIVVRVPDTLTPRERELWETLARESSFRAREGR

SEQ ID NO: 26859 - protein, 223 aa, Desulfovibrio vulgaris subsp. vulgaris str. Hildenborough
MNILIFGPNGSGKGTQGALVKKKYDLAHIESGAIFREHIGGGTELGKQAKAFIERGDLVPDDITIPMVLETLKSKGANGWLLDGFPRNMVQAQKLWDALQAEGMKLDYVIEILLPREVAKNRIMGRRLCKNDNNHPNNIFIDAIKPNGDVCRVCGGELSARSDDQDEGAIGKRHDIYYNTVDGTLAAAYFYKDLAAKGMTKYIELDGEGAIDAIKDKLLAQLS

SEQ ID NO: 26860 - protein, 443 aa, Desulfovibrio vulgaris subsp. vulgaris str. Hildenborough
MMAGAAGVLERLFRIREKGSTVRTEILGGITTFVAVSYIIFVNPSILADAGIPKEAAIASTIWAATATTLLMGLWANFPVAVAPGMGLNAFFAYYVCGVLGLPWQVALGAVFISGVIFLLLTVTRVRQIIIDAVPMNLKCSIVVGIGLFIAFIGLKSAGIVVSNPATFVTTGNLAKAEPLLACTGLILTAVLMARNVRGAILIGILVTTGLGMAVGAVPMPTGMDSVMSFNLPSLTPTLMQLDIMGAIKYGLFSILFTFTIVDLFDNMGTLIGLSRKAGLMDDKGHIPNLDKALVTDSVGTVLSSFLGTSTVTSYVESAAGIAEGARTGLAAVVTAILFMFALVFAPLVGLVPAFATAPALVIVGALMMMEVRHVDFTDFTEAFPAFMTIVMMPLTFSIASGFGFGFISYAFVKTCSGRAREVSPVMWLIAIAFIFNFALRSH

SEQ ID NO: 26861 - protein, 439 aa, Desulfovibrio vulgaris subsp. vulgaris str. Hildenborough
MLEAKNRLGVIFFPAFDWAISPTHPEREERLLYTQDQLREEGLFDIAGITEHKPDVATREDVERVHFCLPDVSSVCTKSHLVSAGGAIKAARLVMEKRADKAFALIRPPGHHAMRVVHGNRGFCNINIEAVMLEHIREQYGRLRVAIVDTDCHHGDGTQDIYWHDRDTLFISLHQDGRTLYPGTGFPQELGGPNAMGRTINIPLPPGTSDRGFLHVIEHVVRPILDDFKPDLIINSAGQDNHFSDPITNMNFTARGYAMLNRMLDPDIAVLEGGYAIQGALPYVNLGICLAMAGLDFDDVREPGLDLAAIEQPRNVTDYIERLCDELPRLYFEPPARPKQGDVVGDTFVRTRDVYYDTDGISESQVETVTLCEHCSGAMKVETWSTVNPLSVGIHIPQDACDACHAAGLRMEDEAKTRGNYRYIQCIDRRGKRYTQHGF

SEQ ID NO: 26862 - protein, 242 aa, Desulfovibrio vulgaris subsp. vulgaris str. Hildenborough
MAMIEFHDVHKWYGEFHVLRGITQKVEKGEVLVICGPSGSGKSSFIRCLNRLEPIQKGQILLEGKSIHDKDVDVNDLRTEVGIVFQQFNLYPHLSVLKNVTLAPIKVRKMPRAKAEAVAMELLERVGIHDQAGKYPVELSGGQQQRVAIARALAMQPKVMLFDEPTSALDPEMINEVLNCMKDLAREGMTMLCVTHEMGFAREVADRVIFMDGGNVVEEAPPDIFFSNPQHERTKAFLREIL

SEQ ID NO: 26863 - protein, 399 aa, Desulfovibrio vulgaris subsp. vulgaris str. Hildenborough
MTTSFEALKNREESLLCRTYGRYPISVQRAEGSRMWDHEGREYIDLLSGIAVTSLGHCHPELAEVMARQARKLVHVSNLFYQEEQLDLAEKLLSTLHCTKAFFCNSGAEANEAAIKLARRYMQRVRGVDAHEVVTLTGAFHGRTLATVAATGQERFQDGFAPMPAGFRQAEWGDIDALRAAITPATAGVLVEMVQGEGGVRPMTQDYARAVADLCREKGVLLMVDEIQTGLCRTGRFWAHQHYGVEPDIVTSAKALANGLPMGAMMTTDEVAQGFVAGSHATTFGAGALVSSVAAATLDIMKRDRLDERATAVGGRAMERFRAIGAKLPGTIEEVRGYGLMIGIVLTFSGKEVWKELVARGFVCNNTQEKVLRLVPALTIDEADLTAFADTLEDILARR

SEQ ID NO: 26864 - protein, 476 aa, Desulfovibrio vulgaris subsp. vulgaris str. Hildenborough
MNSDKKGRSLQPRVPMPCQPAHERVGNFHEVALGYSREDAMREASRCLQCKKPKCVKGCPVEVQIPQFIAALAKGDVESAYRTLRETNSLPAVCGRVCPQENQCEGACILGAKGQPVAIGRLERYAADTYMALDACDQLTGRPECPLIDPDLKVACIGSGPASLTVAGYLSSRGFKVTVYEALHELGGVLVYGIPEFRLPKSDIVEKEIAALRQQEVEFVTNWVGGRTFSIDDLFAEGYKAVFIGVGAGLPRFLDIPGENLVGVFSANEYLTRVNLGRAYGFPDYDTPVYRGREVTVFGGGNVAMDAARTALRLGAESVRIVYRRTRDEMPARLEELEHAEEEGVRLELLAAPLGFKGDADGRLTAVTLQRMELGEPDASGRRSPRPVEGAVYDLPTDLAVIAVGTRPNPILLEATPGLTLDRRGYIAVDEATGMTSIPGVYAGGDIVTGAATVILAMGAGRRAAKDIEARLRPAT

SEQ ID NO: 26865 - protein, 1003 aa, Desulfovibrio vulgaris subsp. vulgaris str. Hildenborough
  misc_feature (191)..(191): Xaa can be any naturally occurring amino acid
MRMPRRTFIKLASASAGALAFAGLGQSLAPTVARAAELKIAKAKVTPSVCCFCAVGCGLLVYTDTQTGRSINIEGDPDHPTNEGTLCPKGASIWQTTERSKRVTKVLYRAPGAAAWEEKSWDWALPRIARKIKETRDATFELTNDKGQTVNRTRGIASVGSAAVDNEEGWLMQAMMRALGLVYIESHARIXHSSTVGALAESYGRGAMTNHWIDLKNSDVILIMGSNAAENHPISFKWVTRAQERGATLIHVDPRFTRTSAKADIHAHIRSGTDIAFFGGLIRYIMENDLFFRQYVVDYTNASYIVGADYGFADGLFTGFDAEKGTYNTKKWAFAADENGMTLKDPTLNDPRCVFQLMKAHYARYDRKTVSDVTGISEEQLATLWSTFASTGKPDRAGTILYAMGQCQHTVGVQNIRALSMIQLLLGNIGIAGGGVNALRGESNVQGTTDISLLCDNLSGYLPTPKASWATFDDYVKGTTPVDKDPKSANWWSNRGKYLASYMKSVYPTASHQDGYLWHPKVDDGKITDYSWLQIFERMSKGGFKGAFVWGQNPCAGGANAGKNRKAMETLDWMVVVNLFENESSLFWKGPGVDPAKVKTEVFFLPACMSVEKGGSIANSGRWLQWREPGPKPMGDSRSDGDIVLDLYDEIRKLYREEKGAFPEPVLALDTDYRTDGKYDHHKVAKTLNGKFLTDVTIGDKTYKAGQQVPGFAMLQADGSTTSGCWIFTGCYTDAGNMMARRDRTQTPEQAAIGLFPNWSYAWPANRRILYNRAAVDMTGKPFDPKRAVIAWNGEKWVGDVPDGGWKPGEKLPFIMIREGRGQLFGPGRVDGPFPEHYEPFESPLESHPFSKQRVNPTALAFSHEPKAVRDKRYPFICTTYRVTEQWQSGTMTRNTGWLKEMQPEGFCEISRELAKELGIANGDAVVLESLRGKVQVVAIVTPRLKPFKVMGEVMHEVGIPWQFGWGQHVGKGDSANLLSPSVGDPNTGIPETKVFMVNLRKA

SEQ ID NO: 26866 - protein, 469 aa, Desulfovibrio vulgaris subsp. vulgaris str. Hildenborough
MRTKIIATIGPASRSHEVLSRLVNAGVGIFRLNFSHGDASMFVELIGLLRELERESGRPLTILQDLSGPKIRIGEIAKGALSVSKGDRLLLGPAPAPADNRPFIPFDHPAVLAEFEIGDRVVLSDGGLQFRVVDKGPNGTFELEANNNGMITSRKGLALPGKSVKLAALTAKDRKDLADGLALGVDAVALSYVQTPDDIRDAKEIIRAAGRNIPVIAKLERQNAVDRLDEILAETDIVMVARGDLGVECPLPELPAMQKRIIRACNRAAKPVIVATQMLLSMVNSPSPTRAETTDVANAVLDGADCVMLSEETAMGSFPVETVNFMKEIAMKAEELHFELQRLREPDVGRGSADFLAYSACLLAEKANADAIVSHSLSGSSARLISSRRPQQPVYAITPDPAAQRWLNFSWGVFPEGGDEGISGHLERAEAFIERCPDIPDGADVVITAGQPKPGDTPRGTNLVKIYRK

SEQ ID NO: 26867 - protein, 393 aa, Desulfovibrio vulgaris subsp. vulgaris str. Hildenborough
MAVIKMTDLDLKGKRVLLREDLNVPLKEGRITSDKRIRAALPSIRMAMEAGARVLIVSHLGRPVEGEFDEAFSLAPVAAHLSRELGRDVRLVKDYIDGVDVAEGDCVLCENVRFLKGEKKNTEELGRRLAALCDIFVMDAFGAAHRAQASTHAVARFAPVACAGPLLAAELDALERALDAPKHPLVGIIGGSKVSTKLTLLDNLSHRVDRLIVGGGIANNFIKAAGYEVGKSLYEPELVEEAARLMAAARAAGGEIPVPLDVVVGPELADGAPATVRKVSEVGPDEMILDIGPATATRYREILLAAGTIVWNGPVGAFEWEQFGAGTRALCEAVADSPAFSIAGGGDTVAAVEKYGVASRVGYISTGGGAFLEFLEGKELPAVAILQERAAQS

SEQ ID NO: 26868 - protein, 222 aa, Desulfovibrio vulgaris subsp. vulgaris str. Hildenborough
MILSPSLLSSDFGRLTEELAALEAAGVKWVHWDVMDGRFVPNITYGQPVISHLRKKSGLFFDVHLMVHEPERYLADFAKAGADMLVVHAEATNHLQRTLAEIRRLGCKAGVALNPHTPLSVLDYVLEDVDMVLIMSVNPGFGGQKFLPATYRKIRDLRAMLDARGLSAHIQVDGGVDPSNTAALVESGADVLVSGSAFFGFPPYDQRLRAFEDAAAAARPAN

SEQ ID NO: 26869 - protein, 141 aa, Desulfovibrio vulgaris subsp. vulgaris str. Hildenborough
MAIQNGATVRVHYTGTLDDGTEFDSSRDREPLEFTLGEGMLIPGFEKAVLGLSKTGDAVKVVIPAEDAYGERLEELVISVPRDQVPPHIEPEVGLMLQLMTDGGEMEVAVTEVTDEAVTLDANHPLAGETLTFDIELVEVL

SEQ ID NO: 26870 - protein, 332 aa, Desulfovibrio vulgaris subsp. vulgaris str. Hildenborough
MNLAVFPRRGYVKDPTPIESCPAFSKALGGKVNIFIKRDDLLPGCAGGNKTRKLDFCMADALAKGADTIITCGAVQSNHCRLTLSWAVKEGLDCHLVLEERVKGSYKPEASGNNFLFKLMGVKSITVVPGGSNMMGEMEALAARLKEAGRTPYIIPGGASNPIGATGYVSCAQETLQQLFDMGLKVDHMVVPSGSAGTHAGIVVGMVGNNANIPVSGINVSRTKADQEALVRKLARETAQRVGMSGEFPDEAVTCFDGYVGPGYSLPTESMVEAVRLLAQTEGILLDPVYSGKAMAGLVDLVRSGYFAEGSNVLFLHTGGSPALYAYLDTFK

SEQ ID NO: 26871 - protein, 325 aa, Desulfovibrio vulgaris subsp. vulgaris str. Hildenborough
MSKAIVLHAHGGVDNLHWEERDPGRPGAGEALIRHEAVGVNFIDIYHRTGLYPLPALPAVLGMEGAGIVLAVGEGVTEVQPGQRVAYAGRPIGAYAEERCIPARRLVPLPDAIPTRMAAAMMLRGMTARYLLHGCYPVRQGTTLLVHAAAGGVGSMLVPWACHLGATVIGTAGSPEKREKALAAGCHHVIDYRTGGVAARIRELTDGRGVDVVYDSVGQATFMDSLDCLRPMGTMVSFGQSSGAVPPFDPGVLAARGSLFLTRPSLMHYTERREDLLAHAADLFDVVARGVVSVHIDQSWPLAQVAEAHTALESRRTTGTMVLDV

SEQ ID NO: 26872 - protein, 1012 aa, Desulfovibrio vulgaris subsp. vulgaris str. Hildenborough
  misc_feature (189)..(189): Xaa can be any naturally occurring amino acid
MKTTRRSFLKLVGVSVVGLSLGQLGFDLEDAQAYAVKLKIEGAKEVGTVCPFCSVCCQVIAYVRNGKLVSTEGDPDFPVNEGALCAKGAALFSMYTNPHRLTKPLYRAPHSDKWVEKDWDWTLNQIARRVKDARDKDMILKNDKGQTVNRLESIFMMGTSHASNEECAVIHQAMRGLGVVHMDHQARVXHSPTVAALAESFGRGAMTNHWIDIKNTDAVLIIGSNAAEHHPVAFKWIMRARDNGAVLMHVDPKFSRTSARCDFHVPLRSGTDIAFLGGMVNHIIAKDLYFKDYVANYTNAAFVVGKDYAFEDGIFSGYDPKTRTYDRSKWEFEKGPDGGPVMDPTLKNERCVFNLMKKHYERYTLKNVSDVTGVSEENLLRVYDAFCATGRPDKAGTILYALGWTQHTVGVQNIRTSTLIQLLLGNIGVAGGGINALRGEPNVQGSTDHALLYHILPGYNAMPVAQWQTLADYNKANTPVTTLKNSANWWSNRPKYVASLLKGWFGDAATPENDFCYEYLPKLEKGEDYSYMYVMDRMYHGKLKGGFIFGVNPMNSFPNTNKMRAALDKLDWLVCSELHNSETTDNWKRPGVDPKACKTEVFLLPSAHRVEKAGTISNSGRWLQWFDKAVEPGQARNFADIFVPLVNKIRALYKAEGGTLPDPVLKLHWTDKFDPEEWTRRINGFFWADTKVGDKEYKRGQLVPAFGQLKDDGSTSSLNWLYTGSYTEEDGNKSKRRDARQTPMQANIGLFPNWSWCWPVNRRILYNRASVDVNGKPWNPKKAVIEWDGAKWVGDVPDGPWPPMADKEKGKLPFIMNKDGFAQFYGTGRMDGPFPEHYEPAETPLDSHPFSKQLSSPVYKFHTSDMDQIAKAADPKYPIVLTTYSLTEHWCGGGETRNVPNLLETEPQLYIEMSPELAEEKGIKNGDGVIVESIRGRAEAIAMVTVRIRPFTVMGKTVHLVGMPFAYGWTTPKCGDSTNRLTVGAYDPNTTIPESKACLVNVRKADKLTEIA

SEQ ID NO: 26873 - protein, 250 aa, Desulfovibrio vulgaris subsp. vulgaris str. Hildenborough
MARLILLRHGQSAWNLENRFTGWTDVDLSPAGEAEALAAARLIRDEGLDFSVCHTSMLTRAIRTLHLVQQELDRLWTPVRKHWRLNERHYGALQGLDKRETAARHGEDQVFVWRRSYDVPPPVIAPDDPKHPVHDPRYADVPPDVLPCGESLEATVARVLPYWYDAIAPDLMAGRDVLVAAHGNSLRALVMHLDGLDREDVSRLDIPTGLPRLYELDAALRPVSYRYLGDPAEAEERARAVAAQGRLEKN

SEQ ID NO: 26874 - protein, 423 aa, Desulfovibrio vulgaris subsp. vulgaris str. Hildenborough
MSQRSSELFERAQQLIPGGVNSPVRACLGVDSEPLFIARAAGSRLHTVDGETFIDFVESWGPMLLGHTHPEVTAAVHAAVDRGTSYGAPCEDEVVLAAKVVDALPGVDMVRMVNSGTEATMSALRLARGYTGRTKLVKFVGCYHGHADPFLASAGSGVATLSIPGTPGVPESTVRDTLLAPYNDLAAVKDLFALHGKDIAAIIVEAVAGNMGLVPPKAGFLEGLRELCDQHGALLIFDEVITGFRVSFGGAQQRFGITPDLTTLGKIIGGGLPVGAYGGKREIMQRIAPCGEVYQAGTLSGNPLAMAAGIATLDVLSRSDYAGLEARVAAFVKELEAILKGKGVPVRINTLASMFTVFFTNDPVTDFASAKTADGALYTSFYKQMRAQGIYLAPSPFEAAMVSFAHTDDDLAAMLDAARKVTF

SEQ ID NO: 26875 - protein, 510 aa, Desulfovibrio vulgaris subsp. vulgaris str. Hildenborough
MRGAGPGGARLRQSARAFKWKLPVVGHCATLSAFRERGARPCRGVVRSSFRRGVMPGLARTWARHGGIPRSASSSQPKSIPEPTMSSLKDMYRTLQQDDFPERMTISFGDRTLVYRKRTWVIDGEAKGLRYGENPDQPAALYELAEGGLELGGVTFRGPGQGLVSALTEEHMVQAGKHPGKTNLTDVDNGINMLQYLTARPAAIILKHNNPSGAAWSDAGIADALSKAFWSDRIAAFGGAVVLNRPLDKAAAELIAANYFEVVAAPDFEEGALDIIKARKNLRILRIPGLARLEEVLADAPFLDVKSLTDGGIVVQHSFRNRIRTVGDFLPATATSKEGVTVTARAPSKQEAEDLLFAWAVESGVTSNSVIFVKDGATVSIGTGEQDRVGCVELAIHKAYTKYADVLAFREQGCSLYELKQKAVADATAAAALADIDERTRAAKGGLIGTSLVSDGFFPFRDGVDCAVAQGVAAIAQPGGSMRDHEVIMALNEATPQVAMVFTGQRSFKH

SEQ ID NO: 26876 - protein, 447 aa, Desulfovibrio vulgaris subsp. vulgaris str. Hildenborough
MPAMHRLDWTNAWTGRLEGQQEAPFALRHADIAHRFATELSAGRLPFVDMPYAEDLIASLEALTPRLRRFRHMVLLGIGGSALGARALQKAFHPSQDRPGHTGPCLWIADNIDADTLEAWFATLPARETIVVAVSKSGGTIETVAQYLLAREWLRGHLGESWRENMLLVTDVAHGFMRQEADTHGLVSLPVPDHLGGRYSVLSAVGLVPAAFLGMDWRALLDGALSVGRPLRDGGLPADHPAWRLALWNRSLMAHGYTQIIFFAYIPLWATFGPWFAQLWAESLGKEGKGSMPLPATGVTDQHSLQQMFLDGPRDKGCLFLTCPTLPAGRAFPLQLPDQWAFLKGAHFGDLLHAEALGTRMALASCDVPTVALEMADTGPEAAGRMMALLELATLFTGWLLDINPLDQPAVELGKRLANAKLGAPGYEAEGSALAGFLAREGERQEF

SEQ ID NO: 26877 - protein, 200 aa, Desulfovibrio vulgaris subsp. vulgaris str. Hildenborough
MDLLPIRRALLSATDKGGLVEFAGFLAENGVELVSTGGTYKTLEAAGLTVTPVSRVTGFPEILGGRVKTLHPHIHGGILADKDDPAHMDTLKELGIVPFDLICVNLYDFASAVAKGLDLRGAVEEIDIGGPCMLRASAKNFHSVLVLPSPTHYARAMEEMRANAMGVTLDFRREMAALTFDATSKYDRMISDYLSGTAKA

SEQ ID NO: 26878 - protein, 376 aa, Desulfovibrio vulgaris subsp. vulgaris str. Hildenborough
MSQRDYYEVLGVARDASEDDIKRAYRKLALQYHPDRNPDDPEAEQKFKEAAEAYDVLRDGEKRARYDRFGHAGVGNGGGFGQGFSSNEDIFAHFSDIFGDLFGFAGAAGGRSRGPRPQAGSDLRYNLTISFRQAAKGDEVTLRLPKSVPCDECGGSGAAPGTRPETCRHCGGAGQIRQSQGFFQIAMPCPVCRGEGTVITSPCPKCKGSGQTQQVKELSVRIPAGVDTGNRLRLRGEGEPGIHGGPAGDLYVVISVEDDKTFRRQGQDLVVTREISFVQASLGDRIDVPTLDDDITLDIPAGTQSGEVFRLVDKGLPYLGHGHTGDLLVEIRVVTPTRLTKKQEELLREFALLDEEKPLEKVKKMARKIGKAMGMD

SEQ ID NO: 26879 - protein, 1006 aa, Desulfovibrio vulgaris subsp. vulgaris str. Hildenborough
MDQQHLDGKVVERGKEFFRSISGEAPSIFNKGWWTGKVMDWAMQNEDFKVQLFRFVDVLPYLNTSESLLRHIREYFATEDADIPPVLKWGAGKAGIGGALTAKLMGMTIRSNIEGMARQFIIGDNSKEAVKGLAKLRKDGFTFTVDLLGEATVSEEESEAYAQGYHEVVDAIAREQEKWKALPGNGPVEGFDWGATPKVNVSIKPSALYSQAKPVDVEGSVRGILSRLVPIYRKVVAMGGFLCIDMEQLKYKEMTLELFKRLRSDPEFRHYPHLSIVLQAYLRDTEKDLDDLLHWARSEKLPIGIRLVKGAYWDYETVIAKQNGWEIPVWTDKPESDIAYEKLAHRILENSDIVYFACASHNVRTIAAVMETALALNVPEHRYEFQVLYGMAEPVRKGLKNVAGRVRLYCPYGELIPGMAYLVRRLLENTANESFLRQSFAEGAALERLLENPQKTLHRLLAARPEPRAVEPGPGGLPPFTNDAMIDFTVPDNRKAFVEALADVRSRFGQTVPLYIGGRDVTTADLIPTTNPAKPAEVVASICQAGRPEIDDAIAAAKKAALTWRDTSPADRAAYLRRAADICRKRIWELSAWQVVEVGKQWDQAYHDVTEGIDFLEYYAREMLRLGAPRRMGRAPGEHNHLFYQPKGIAAVIAPWNFPFAIAIGMASAAIVTGNPVIFKPSSISSRIGYNLAEVFREAGLPEGVFNYCPGRSSIMGDYLVEHPDISLICFTGSMEVGLRIQEKAAKVQPGQRQCKRVIAEMGGKNATIIDDDADLDEAVLQVLYSAFGFQGQKCSACSRVIVLDAIYDRFIERLVKAASSIHIGPSEDPSNYMGPVADATLQKNVSDYIRIAEEEGRVLLKRTDLPAEGCYVPLTIVGDIRPEHRIAQEEIFGPVLAVMRAATFDEALSIANGTRFALTGAVFSRSPEHLDKARREFRVGNLYLNKGSTGALVERQPFGGFAMSGVGSKTGGPDYLLQFMDPRVVTENTMRRGFTPIDEDDDWIV

SEQ ID NO: 26880 - protein, 447 aa, Desulfovibrio vulgaris subsp. vulgaris str. Hildenborough
MDIPVFNCKNGDDVIRAVKEYNVSFVQFWFVDILGNLKSFQVTPSELEAAFEEGMGFDGSSILGFTRIEESDMVAFPDATTFQICSWRPLERPVARMFCDIRTPDGTPYEGDPRYILRKLIDKAAQKGYTFYVGPELEFFFFSSPQCPTPIDAGGYFDAPPLDLGNDVRRDIIFALQRMGIPVEYSHHEVAPSQHEIDLRYNEAMKMADVVMTYKVVVKEMARKHGIYATFMPKPIFGENGSGMHVHQSLFRNGKNAFFDPNDQHNLSHECRSYIAGLLKHAREFCCVTNQWINSYKRLVPGYEAPVYIAWAQRNRSALIRVPMYKPGKEAATRIELRSPDPACNPYLAFAVMLGAGLEGIENNYELPKAVEANIFHMGEEDLGKHGIGSLPGSLYEAAMELRNSNLMKEILGEHTHANIVGNKLIEWDDYRTHISEFELKRYLPIL

SEQ ID NO: 26881 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 26882 - protein, 436 aa, Mycobacterium leprae
MSGATSGLTPEQIGAIDAAHLWHPYSTIGAATGVIPPVVAVAAHGAWLTLIRDGKPIEALDAMSSWWTAIHGHGHSVLDAALTTQLGAMNHVMFGGLTHEPAARLAQLLVDITPAGLETVFFSDSGSVSVQVAVKMALQYWRSRGQPAKRRLMTWRGGYHGDTLTPMSICDPDGGMHSLWTDILARQVFAPQVPRDYDPAYSKAFETQLAQHTPELAAVVVEPVVQGAGGMRFHDPRYLCDVRDICRRHDVLLIFDEIATGFGRTGELFAADHCGVSPDIMCVGKALTGGYLSLAATLCTTDIAHAISVGAAGALMHGPTFMANPLACAVSVASVEVLLGQDWRSRVAEISAGLTAGLEAAQGLPGVIDVRVCGAIGVIECDRSVDLAVATPAALDRRVWLRPFRNLVYAMPPYICPPAEIAQITSAMVEVAGLVG

SEQ ID NO: 26883 - protein, 392 aa, Mycobacterium leprae
MCGRRLGRQRRRVPVGGDFPAPRGAAADAVLLNPDRVHRKALVAFRKAGGRIVENVSAATDLVIDGVVGISGSGPLRPAAAAVFATVSASGVPVVAVDLPSGIDVVTGVINGPAVHAALTVTFGGLKPVHALADCGDVTLVDIGLDLPDSDILGLQAADVAAYWPVPGVHDDKYTQGVTGVLAGSSTYPGAAVLCTGAAVAATSGMVRYAGSAYTQVLAHWPEVIASATPTAAGRVQSWVVGPGLGIDATATAALWFALETDLPVLVDADGLTMLAAHPDLVINRNAPTVLTPHASEFARLAGTPPGDDRVGACRKLADSFGATVLLKGNVTVIADPGGPVYLNPAGQSWAATAGSGDVLSGMIGALLAAGLPAPRPRRGIRARACASAVGC

SEQ ID NO: 26884 - protein, 510 aa, Ricinus communis
  misc_feature (117)..(117): Xaa can be any naturally occurring amino acid
  misc_feature (122)..(122): Xaa can be any naturally occurring amino acid
MAAGLAITSEGGQYNGRMTSFVALSCMMAAMGGVIFGYDIGVSGGVTSMDPFLKKFFPDVYRKMKEDTEISNYCKFDSQLLTSFTSSLYVAGLVASFFASSVTRAFGRKPSILLGGXVFLAXAALGGAAVNVYMLIFGRVLLGVGVGFANQAVPLYLSEMAPPRYRGAINNGFQFSVGIGALSANLINYGTEKIEGGWGWRISLAMAAVPAAILTFGALFLPETPNSLIQRSNDHERAKLMLQRVRGTTDVQAELDDLIKASIISRTIQHPFKNIMRRKYRPQLVMAVAIPFFQQVTGINVIAFYAPILFRTIGLEESASLLSSIVTGLVGSASTFISMLIVDKLGRRALFIFGGVQMFVAQIMVGSIMAAELGDHGGIGKGYAYIVLILICIYVAGFGWSWGPLGWLVPSEIFPLEIRSAGQSIVVAVSFLFTFVVAQTFLSMLCHFKSGIFFFFGGWVVVMTAFVHFLLPETKKVPIEKMDIVWRDHWFWKKIIGEEAAEENNKMEAA

SEQ ID NO: 26885 - protein, 173 aa, Saccharomyces cerevisiae
MSEQLRQTFANAKKENRNALVTFMTAGYPTVKDTVPILKGFQDGGVDIIELGMPFSDPIADGPTIQLSNTVALQNGVTLPQTLEMVSQARNEGVTVPIILMGYYNPILNYGEERFIQDAAKAGANGFIIVDLPPEEALKVRNYINDNGLSLIPLVAPSTTDERLELLSHIADS

SEQ ID NO: 26886 - protein, 495 aa, Alternaria alternata
MTSVKLSTPQTGEFEQPTGLFINNEFVKAVDGKTFDVINPSTEEVICSVQEATEKDVDIAVAAARKAFNGPWAKETPENRGKLLNKLADLFEKNADLIAAVEALDNGKAFSMAKNVDVPAAAGCLRYYGGWADKIEGKVVDTAPDSFNYIRKSLLVFAVRSSMELPILMWSWKIGPAIATGNTVVLKTAEQTPLSAYIACKLIQEAGFPPGVINVITGFGKIAGAAMSAHMDIDKIAFTGSTVVGRQIMKSAAGSNLKKVTLELGGKSPNIVFADADLDEAIHWVNFGIYFNHGQACCAGSRIYVQEEIYDKFIQRFKERAAQNAVGDPFAATLQGPQVSQLQFDRIMGYIEEGKKSGATIETGGNRKGDKGYFIEPTIFSNVTEDMKIQQEEIFGPVCTISKFKTKADVIKIGNNTTYGLSAAVHTSNLTTAIEVANALRAGTVWVNSYNTLHWQLPFGGYKESGIGRELGEAALDNYIQTKTVSIRLGDVLFG

SEQ ID NO: 26887 - protein, 496 aa, Davidiella tassiana
MTSVQLETPHSGKYEQPTGLFINNEFVKGQEGKTFDVINPSDESVITQVHEATEKDVDIAVAAARQAFEGSWRLETPENRGKLLNNLANLFEKNTDLLAAVESLDNGKATSMARVTSACASGCLRYYGGWADKITGKVIDTTPDTFNYVKKEPIGVCRSDHSLELPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGSRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 26888 - protein, 440 aa, Davidiella tassiana
MPISKIHSRYVYDSRGNPTVEVDIVTETGLHRAIVPSVASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYNELAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 26889 - protein, 369 aa, Arabidopsis thaliana
MAHISDIKLIRTDTTLDLSQKAEKGMIWTMGGASYLYYNAYDHGSLTCRCGTLLIASSGGKYNPIRTFSSHQILEATNNFDWSYAIGVDRFVWYKGTIENRAVLIKYYKGEPFNFDPDNFYRDIAVSSMMSSHKNVLKLLGCCLEFPRPVLVCEYPEKGALAYIGGAGEVIKPLAWSVRLKIAKEIADAVTYLHTEFPRTIIHRDLKLTNIFLDENWTAKLSSFSLSIPIPEGELGVEDIVCGTQGFGEPHYMVTGFVTENVDIYSFGFIMLSLLTGKHGFYQEPANGDSYNMILLPDYVEKCLGRGPLAKLIDPSMLNSTDDDIPDHSKLQMEAFVNLALRCVGFRSGETKLHMIDVAKELKRIQKQT

SEQ ID NO: 26890 - protein, 372 aa, Arabidopsis thaliana
MDKIIISNLSEFDHSVVDYHKSSLLLCKSQSFELSPIEMSKNNKKKRRWDLKNGGILLEELIASFDGKTNPIRCFSSDQILKATDNFSESRIISSWGYFIWYKGVIEERQVSIKKWSSQNLSSFTEAYRDISVSSQMSGHKNALKLIGCCLEFDLPALVCEYTEHGPLNRDGGLSSGVVLPWKVRLKIAKEIASSVTYLHTAFPETIVHRNINPTNIFIDENWTAKLSDFWFCVAIPEGELYVEDDVKGVIGFVDPDYYWTMKVTEKVDIYSFGVVMLVLLSGRAAVFNGPDEAPMSLNDHVSEVMEKGEFDEIVDKEIWNDLGGDDDLVLRRSQVKAFLRLALRCVRYKKEDPVSGMLEVAKELKLIEKLS

SEQ ID NO: 26891 - protein, 357 aa, Arabidopsis thaliana
MSCWRKKSKKKNSEANQRQRWFQENGKVLLEDLIELCNGKSNPIKTFSAEEILQATDNFSESNLVIRFNFMYRGILQNRPVLIKRATWNYYKSDTLEKICRDIAVSSMVSGHKNFLKLLGCCLEFEHPVLVCEYAERIPFNTPNPEMLLPWRMRIKIAKEIAIAVSYLHTALSRTMIHTDIQPFNIFVDSNGTAKLSDFCLCIAIPEGETFVKVHADRVEGTLDYLEYNYAATGLITEYTDVFSFGVLLQNFFTRTYGVVDCCCSEDESLFEEFEDKQNVMNLRISDRISKFVEEGRIFDMLDPKMLESMGDDETEEHKIRRMKAVLMLSLRCTGHRGDVPKMMEVAKELKRIERWT

SEQ ID NO: 26892 - protein, 352 aa, Arabidopsis thaliana
MVKKLKQNLRTGSWKKKEKSMKKERWFLENGSIFLKELIVDCNGKSIPIRSFTSSQIRKATKNFDLSCFVAEEGFYIWYKGVIEDRSYMIKRFSEYKVTDYRVSEVYKDIVLSARMSNHNNFLKLLGCCLEFPFPVLVFEFAEHGVLNYRGGITVNGEESLLPLSLRLKIGKEIANALAYLHMAFPKIIIYRDVKPLHVFLDNNWTAKLSDLSFSISLEEGKSQIEAEDVLGTYGYLDPLYFATRIVTEYTDVYSFGVFLMVVITGISVYFTGSDGYPVGILGYMKGLAENGKLNEIVYPMIMKEMTSAQRLQVEACVLLALRCCEERVEDRPKMIQVAKELKRIEHHVLRS

SEQ ID NO: 26893 - protein, 356 aa, Arabidopsis thaliana
MVKKLKQSLRSGSLEKRKEKEKDIQEEKWFLDNGSIFLKELIADCNGKSIPIRNFSSDQILKATSNFGSSCFVTAEGFYVWYKGIIEDRSYMIKRFSEYKVTQYRVAEVYNEIVLSARMSNHNNFLKLIGFCLEFSLPVLVFEYAEHGVLNHRGGVIVNGEEVILPLSLRLKIGKEIANAVTYLHMAFPKILIHRHIKPRNVFLDENWTPKLSDFSISINLPEGKSRIEVECVQGTIGYLDPVYYTTKMVTEYTDVYSFGVFLMVILTGKPALASTSSDGDYKHIASYVKGFHENGQLDGVIDPKVMEDITSAQKVHVEACVVLALRCCELRDENRPKMIQIAKELKQIETLFRRS

SEQ ID NO: 26894 - protein, 340 aa, Arabidopsis thaliana
MLRLFRKKKKQKKEEEINLQKNGSLLLEELIATSGGIYNPIRTFSSDQILQATNHFDWNYVISEDRFVWYKGMIENRPVLIKKFQDCSVFDADNFYRDIAVSSLMSSHKNVLKLLGCCLEFPRPVLVCEYPEHGALNCIRCGKEGVRSFPWNVRLRIAKEIADAVAYLHTEFPRTIIHRDLKLANIFLDENWSAKLSSFSLSIVLPEGETGVNDMVCRTSSYIEPDYFNTGLVTENVDIYSLGIIMLIILTGKSEYNSEVAVYLPVLPVYVGKFLERGLLTELIDPSILDSTSDDIPKHSRLQMEAFIELAFRCVRFRPGENVPRMIDVAKELKKIEKHI

SEQ ID NO: 26895 - protein, 490 aa, Arabidopsis thaliana
MESMTMIILQSLIIFITILFFKKQKRGKKSNTPRSPPRLPLIGNLHQLGHHPHRSLCSLSHRYGPLMLLHLGRVPVLVVSSADVARDILKTHDRVFASRPRSKLFEKLFYDGRDVAFAPYGEYWRQIKSVCVLRLLSNKMVTSFRNVRQEEISLMMEKIQKSSSLQVNVSELLGSLTNDVISRIALGRKYSGETDSKELMKRLMMLMGEFSVGTYVPWLGWIDWISGLDGQLNKTGNDLDEFLEKVVQDHVDGDGQRTDFVDVLLRIQREKSIGFEIDRLCIKAIVLDVLVAGTDSSYALMDWAMTELLRHPECLRTLQEEVRTICKGNLSVSEEDIQNMSYLKAVIKETTRLHPPLPLLAPHESIQDVILGDYHIPAGTQVMINAWAIGREAATWGPDAEKFRPERHLDSSVDFRGHNFELVPFGAGRRICPAISFAVVLIEVALANFVHRYDWKLPEDSKENQTNVAESTGMVIHRLFPLYAIASSTT

SEQ ID NO: 26896 - protein, 483 aa, Arabidopsis thaliana
MILFLCLIILFIITILFFKKHKTVNKIINFPSPPRLPLIGNLHQLSQHPHRSLCYLSHRYGPLMLLHFGSVPVIVASTAEAARDVLKTHDRVFASRPRSKIFEKLLYKSRNMASAPYGEYWRQMKSVSVLHLLSNKMVRSFQDVRQEEITLMMETIRKSSSKPVNLSKILSSLTNDVICRVALGRKYGVGTDFKELIDRLMRQLGTFTIGSYVPWLAWTDWVSGLEARLEKTANDFDKLLERIVQDHEDGDGDKTDFVDVLLAAQRDKSFGFDIDRLSIKAIVLDAFVGGTDTSSTLVEWEMTELLRHPTCLKKLQEEVRTICKGKSSVSEDDIQGMEYLKAVVKEALRLHPPVPLMVPHQSTQDVRLRDNHIPAGTQVIVNLWAVGREAATWGPDANEFRPERHLESPSDFRGQDFELIPFGAGRRMCPGISFAVVLNEVVLANLVHGFDWQSIDDETDVAESIGSVIRRMHPLYVIPSSTT

SEQ ID NO: 26897 - protein, 512 aa, Arabidopsis thaliana
MMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILVKGRYENKFKFTDELVYNHSSCFGFQDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 26898 - protein, 490 aa, Arabidopsis thaliana
MMMMIILLWSIIFMTILFLKKQLSGKKGKTPPSPPGLPLIGNLHQLGRHTHRSLCDLSRRYGPLMLLHLGRVPVLIVSSADMAQEILKTHDQAFANRPRSKLSQKLLYNNRDVASAPYGEYWRQMKSVCVIHLLSNKMVRSFRDVREEEITLMMAKIRKSSSLPFNVSKVLECLTNDVICRVALGRKYGGETDFKKLTDRLSELLGTFSIGSFVPWLAWVDWIRGWDAQLDKMGKDLDDFFEKVVQDHEDGDRRDGTDLIDALLRVKREKSPGFEIERVSIKAITLDVFVGGSDTSFTLLEWAMTELLRHPKSLNRLQEEVRTICKGKSRVSEDDIQGMKYLKAVIKEALRLHPPFPMMAPHESTEDVKLRDYHIPAGTQVMMNAWAIGREVATWGPDAEEFKPERHLDTSVDFRGQNFELLPFGAGRRICPAVSFAVVLNEVVLANLVHGFDWKLPEESKEDKTDVAESSGFSVHREFPLYAVASPYLT

SEQ ID NO: 26899 - protein, 489 aa, Arabidopsis thaliana
MMIMFFLLCSIIFVVTIIIFRKQKRGKKRNTLPSPPGLPLIGNLHQLGRHPHRSLCSLSHRYGPLMLLHFGRVPVLVVSSAELARDVLKTHDRVFASRPRSKIFEKLLYDKHDVASAPYGEYWRQMKSVCVLHLFSNKMVRSFREVREEEISLMMEKIRKSISLPVNLSKILVSLTNDVICKVALGRKYGGETDFKELMERLNKLLGTFSVGSYVPWLAWIDWIRGLDCQLEKTANDVDKFFERVVQDHVDGNRDMTDFVDVLLAIQRDKTVGFEINRVSIKAIVMNVFVGGTDTSSTLMEWAMTELLRHPKCLKRLQEEVRTICKDKSSVSEEEIQNMSYLKAVIKEALRLHPPLPLMVPHESTQDVRLGDHHIPAGTQVLINAWAIGREAATWGPDVEEFRPERHLDSSVDYRGQAFELIPFGSGRRICPAISFAVVLNEVVLANLVHRFDWRLSVESTEDQTEVAESTGIAIHRMFPLYAIASNTT

SEQ ID NO: 26900 - protein, 332 aa, Phaseolus coccineus
MVVLSQPALNQFFLLKPFKSTPLFTGIPVVDLTHPDAKNLIVNACRDFGFFKLVNHGVPLELMANLENEALRFFKKSQSEKDRAGPPDPFGYGSKRIGPNGDVGWVEYLLLNTNPDVISPKSLCIFRENPHHFRAVVENYITAVKNMCYAVLELMAEGLGIRQRNTLSRLLKDEKSDSCFRLNHYPPCPEVQALNRNLVGFGEHTDPQIISVLRSNSTSGLQICLTDGTWVSVPPDQTSFFINVGDALQVMTNGRFKSVKHRVLADTTKSRLSMIYFGGPALSENIAPLPSVMLKGEECLYKEFTWCEYKKAAYTSRLADNRLAPFQKSAAD

SEQ ID NO: 26901 - protein, 435 aa, Arabidopsis thaliana
MGRTETGDESSARKMRRKVPTSIESLDADILCIIFSFLDLFDLVHCTVVCNSWNAVIKRLKLLQASCRKMHHLGSDSPSSSTSLDRPAEIDVEDFAMKHHKMALLRGRIEIERWEAHSHRVSQCRMKKGLLLTGVGDKVMRLWSLKSYKCMEEYSLPDASSLIDFDFDESKKLEVVSLAWEYFDSVVVVVVEIVGLVGTRISIWRRNGQRSIFPSRAGTFPKGLCMRYIDPEAVVGCEDGTARVFDMYSKTCSQIISGSSLGRVTVSDPLMDQPVATLKSTITAGGIQTICFNQGTNLAFIGTTGGYVSCWDLRKMDRLWEKRVSPNVVYSIQQLRNDTSVMVAGGIDGVLRMIDQKSGRVLSRVIMDDKFSTTSTRNNQVVIEKRRGKRVSQDMEIDKIERKVRPQISCIAMGMKKMVTAHNGKCISVWKFNLS

SEQ ID NO: 26902 - protein, 474 aa, Triticum aestivum
MDVASLLLPFVLALVAIPILLALHDWPRLPPGPCPWPVVGNLRQIKPVRCRCFQEWAERYGPIFSVWFGSSLTVVVSTPELAKEVLKDHDQQLANRTRNRSTQRFSRNGQDLVWADYGPHYIKVRKLCNLELFTQKRLEALRPIREDEVTAMVSSVHRAATGPGNEGKPLVVRSHLAMVSFNNITRLVFGKRFMNANGDINEEGQEFKSIVNNGIKIGASLSIAEYVWYLRWLFPLNEELYKTHNERRDQLTKKIIEEHAKALKESGSKHHFVDALLTLREQYDLSDDTVFGLLWDIITTGMDTTVISVEWAMAELVRYPRVQKKLQEELDSVIGRDRIMSETDFQNLPYLLAVVKESLRLHPATPLMLPHKASASVKVGGYNIPKGADVTVNVWAIARNPDVWSNPLEYRPERFLEESIDIKGGDFRVLPFGAAGGCALARSWESTLWPPCSGTFCTISSGLCQKVPCRRMLT

SEQ ID NO: 26903 - protein, 474 aa, Triticum aestivum
MDVASLLLPFVLALVAIPILLALHDWPRLPPGPCPWPVVGNLRQIKPVRCRCFQEWAERYGPIFSVWFGSSLTVVVSTPELAKEVLKDHDQQLANRTRNRSTQRFSRNGQDLVWADYGPHYIKVRKLCNLELFTQKRLEALRPIREDEVTAMVSSVHRAATGPGNEGKPLVVRSHLAMVSFNNITRLVFGKRFMNANGDINEEGQEFKSIVNNGIKIGASLSIAEYVWYLRWLFPLNEELYKTHNERRDQLTKKIIEEHAKALKESGSKHHFVDALLTLREQYDLSDDTVFGLLWDIITTGMDTTVISVEWAMAELVRYPRVQKKLQEELDSVIGRDRIMSETDFQNLPYLLAVVKESLRLHPATPLMLPHKASASVKVGGYNIPKGADVTVNVWAIARNPDVWSNPLEYRPERFLEESIDIKGGDFRVLPFGAAGGCVLARSWESTLWPPCSGTFCTISSGLCQKVPCRRMLT

SEQ ID NO: 26904 - protein, 474 aa, Triticum aestivum
MDVASLLLPFVLALVAIPILLALHDWPRLPPGPCPWPVVGNLRQIKPVRCRCFQEWAERYGPIFSVWFGSSLTVVVSTPELAKEVLKDHDQQLANRTRNRSTQRFSRNGQDLVWADYGPHYIKVRKLCNLELFTQKRLEALRPIREDEVTAMVSSVHRAATGPGNEGKPLVVRSHLAMVSFNNITRLVFGRRFMNANGDINEEGQEFKSIVNNGIKIGASLSIAEYVWYLRWLFPLNEELYKTHNERRDQLTKKIIEEHAKALKESGSKHHFVDALLTLREQYDLSDDTVFGLLWDIITTGMDTTVISVEWAMAELVRYPRVQKKLQEELDSVIGRDRIMSETDFQNLPYLLAVVKESLRLHPATPLMLPHKASASVKVGGYNIPKGADVTVNVWAIARNPDVWSNPLEYRPERFLEESIDIKGGDFRVLPFGAAGGCVLARSWESTLWPPCSGTFCTISSGLCQKVPCRRMLT

SEQ ID NO: 26905 - protein, 391 aa, Oryza sativa (indica cultivar-group)
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPTPFNPGMSATDLLAYERTLALSKMAANPALMSQHAALKQAAAMGMGAGASQAIYDGGYQSANAVFY

SEQ ID NO: 26906 - protein, 1212 aa, Daucus carota
MHTQRRMDSMSLLFLLILLFCNFSESRKLSGQVKDQGNEVEGLANFKKFSVDAGPNGFLKTWDSSSSSSPCSWKGIGCSLEGAVTVLNLTGAGLVGHLQLSELMDNLPSLSQLYLSGNSFYGNLSSTASSCSFEVLDLSANNFSEPLDAQSLLLTCDHLMIFNLSRNLISAGSLKFGPSLLQPDLSRNRISDLGLLTDSLSNCQNLNLLNFSDNKLTGKLTSFLSSCKNLSTVDLSYNFFSQIHPNFVANSPASLKFLDLSHNNFTGNLVNLELGTCHNLTVLNLSHNSLSGTEFPASLANCQFLETLDMGHNDFHLKIPGDLLGNLKKLRHLSLAQNSFFGEIPPELGNACRTLEVLDLSGNQLIEQFPTEFSLCTSLVTLNVSKNQLSGDFLTSVLSPLPSLKYLYLSFNNITGSVPPSLTNATQLQVLDLSSNAFTGTIPTGFCSTSSSFSLEKLLLANNYLKGRIPSELGNCKNLKTIDLSFNSLIGPVPSEIWTLPYIADIVMWGNGLTGEIPEGICIDGGNLQTLILNNNFISGSIPQSFVKCTNLIWVSLSSNQLRGTIPAGIGNLLNLAILQLGNNSLTGEIPPGLGKCKSLIWLDLNSNALTGSIPPELSSQSGLVSPGPVSGKQFAFVRNEGGTACRGAGGLLEYEGIRAERLEKFPMVLACPSTRIYSGRTVYTFASNGSIIYFDLSYNALSGTIPESFGSLNSVQVMNLGHNNLTGSIPSSFGGLKYIGVLDLSYNNLQGAIPGSLGGLSFLSDLDVSNNNLSGSVPSGGQLTTFPSSRYENNAGLCGVPLPPCGSENGRHPLRSNSQGKKTSVTTGVMIGIGVSLFSIFILLCALYRIRKYQQKEELRDKYIGSLPTSGSSSWKLSSVPEPLSINVATFEKPLQKLTFAHLLEATNGFSANSLIGSGGFGDVYKAQLGDGRVVAIKKLIHVTGQGDREFMAEMETIGKIKHRNLVPLLGYCKIGEERLLVYEYMKWGSLESFIHDRPKVGGGLRIDWPARKKIAIGSARGLAFLHHSRIPHIIHRDMKSSNVLLDENFEARVSDFGMARLVNAFDTHLSVSTLAGTPGYVPPEYYQSFRCTAKGDVYSYGVVLLELLSGKRPIDPAQFGDDNNLVGWAKQLHKEKRDLEILDSELLLHQSSEAELYHYLQIAFECLDEKAYRRPTMIQVMAMFKELQMDSETDILDGLSVKNSVIDESL

SEQ ID NO: 26907 - protein, 511 aa, Fragaria grandiflora
MEFQAMTFAIPFALAAVSWLFLYYIRVSYFTNNNKSAYAKLPPVPVVPGLPVIGNLLQLKEKKPYKTFTSWAEEYGPIYSIRTGACTMVVLNSSQVAKWAMVTTYSSISNRKLSSALKILSADQCMVALSDYNDFHKMIKRYIRANLLGSRAQKRLRTNRDTLRANVLSQSKSHVKNSPLEAVNFTRVFESELFGLAVKQVYGNDIEDPIYVGGTWCYTFKKLDFSGLVVRDILDGGNRWLIDWRDFFPYLRCILNKTLETKIQRLHSRRKPVMTALINEQKKRIASGEEINCYMDFLLSEGRTLTMDQITMLVWETVIETSDTIMVTTEWAMYEIAKNPKQQDRLYQEIQKVCGSEMVSEEHLSQLPYLTAVFHETLRKHSPAALVPLRYAHEDTQLGGYYIPAGTEIAINIYGCNMNKHQWESPDEWKPERFLDPKYDPMDLYKTMAFGAGKRVCVGSLQGMLIACPTIGRLVQEFEWKLRAGEEENVDTVGLTTHKRDPMHAILKPRS

SEQ ID NO: 26908 - protein, 303 aa, Cattleya intermedia
MAVLREACENWGFFELLNHGISTELMNRVETVNKENYRRFREQRFKEFAAKTLDSGEKVDGDNLDWESTFFLRHLPTSNISQIPDLDEDCRSTMKEFARELEKLAERLLDLLCEDLGLEKGYLKRVFCGGSDGLPTFGTKVSNYPPCPKPELIKGLRAHTDAGGIILLFQDDKVSGLQLLKDGQWIDVPPLRYSIVVNIGDQLEVITNGKYKSVMHRVVAQTEGNRMSIASFYNPGSDAVISPAPALVEKEAEEEKKETTYPKFVFQDYMNLYIRKKFEAKEPRFEAMKTMETVSGSQLIPTA

SEQ ID NO: 26909 - protein, 278 aa, Laelia anceps
MNRVETVNKENYRRFREQRFKEFAAKTLESGEKVDADNLDWESTFFLRHLPTSNISQIPDLDDDCRSTMKEFAGELEKLAERLLDLLCEDLGIEKGYLKRVFCGGSDGLPTFGTKVSNYPPCPKPELIKGLRAHTDAGGIILLFQDDKVSGLQLLKDGQWIDVPPLRYSIVVNIGDQLEVITNGKYKSVMHRVVAQTEGNRMSIASFYNPGSDAVISPAPALVEKEAEEEKKETTYPKFVFQDYMNLYIRKKFEAKEPRFEAMKTMETVSGSQLIPTA

SEQ ID NO: 26910 - protein, 331 aa, Chlamydomonas reinhardtii
MEWTTIESDPGVFTELIENIGVKGVQVEELWSLDQLRELSPVFGLVFLFKWKKEPVRPATTTDAGQVFFAKQVISNACATQAILNILLNVKAPGLDLGTELANFREFVSDFDPTMKGLAISNSDLIRTAHNSFARPEPLVPDNDKDDEKSGDAYHFISYVPVGGKLFELDGLQEGPIELCDCTDDDWLDKVGPHITARMERYAASEIRFNLMALVGNRADIYSSRLAAATAQRDQLAAAAAAADGMSDEDLAHAQAKLLEAETEVANLQEALAAEQAKHRTWHEENVRRKHNYVPFLFQLLKLMAARGQMGPLLERARRPAAAGGGNGTKQ

SEQ ID NO: 26911 - protein, 357 aa, Populus tomentosa
MGSLETERKIVGWAATDSTGHLAPYTYSLRDTGPEDVFIKVISCGICHTDIHQIKNDLGMSHYPMVPGHEVVGEVVEVGSDVTRFKVGDVVGVGVIVGSCKNCHPCKSELEQYCNKKIWSYNDVYTDGKPTQGGFAESMVVDQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINTPLQFGTPMVMLGRKSITGSFIGSMKETEEMLEFCKEKGLASMIEVIKMDYINTAFERLEKNDVRYRFVVDVAGSKLIP

SEQ ID NO: 26912 - protein, 385 aa, Populus tomentosa
MAIDCIKTMPSITTPQHHPKDQDQCKDDGKSFVFDAQILRHQTNIPQQFVWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYTAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNGQTPRKSLAFFLCPKNDKMVTPPHELVDTCNPRIYPDFTWPMLLEFTQKHYRADMKTLEVFTNWLHQRSFT

SEQ ID NO: 26913 - protein, 369 aa, Glycine max
MAAKKACETFSKSLIEEVNRWGCLKQTGVSLRYMMEFGSKPTNKNLLISAQFLHKELAIRIARRAVELENLPYGLSQKPAVLKVRDWYVDSFRDVRAFPDIKNVNDEREFTEMIKAIKVRHNNVVPTMAMGVQQLKKGMDPKIVYEDLVEIHQFLDRFYMSRIGIRMLIGQHVELHNPNPPPHVVGYIHTKMSPVEVARNASEDARSICCREYGSAPDVHIYGDPNFTFPYVPAHLHLMVFELVKNSLRAVQERFMNSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 26914 - protein, 369 aa, Glycine max
MAAKKACETFSKSLIEEVHRWGCLKQTGVSLRYMMEFGSKPTDKNLLISAQFLHKELAIRIARRAIELENLPYGLSQKPAVLKVRDWYVDSFRDLRAFPNIKNVNDEQDFTEMIKAIKVRHNNVVPTMALGVQQLKKRMDPKIVYEDLVEIHQFLDRFYMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 26915 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTMVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 26916 - protein, 501 aa, Catharanthus roseus
MALASIEKVATGLICFILLIFSLKRIGHPRDWALVGILSVWFPSLGHIYEKLAKSLAKNDKTFVLKGSFLSKQDVIFTCDPANMHHVMSTNFSNYPKGPENRNVFDVYGEMLFTADHEKWKSHRKVTNAYFHDQRFNGFSQKVNKEVIEKELFPFLDHAAEEALVFDLQDVFQRLMLDSSSILTTGQNHRSLRVGLPYDETLEAINIANYQIFVRHILPAKIWKFQKWLGIMGEKKIKKAWRILDDISVEYMNRRKKEISSTISSQEDMDVVKFSEEDHVVLKSVDASDNLLRDTVKGILLAGTDTTATVLSWFFWLILKNPRVEQKIREEIELYLKQKNGEHGLYTNPEELNELMYLHAAIYETMRLYPAAPFTSRKSIQADVFPTGHQVNPNTTIVMAYYAVGRMKSIWGEDCLEFKPERWLSDKGKLIPVQTNKFLAFGTGPRICPGKELGLNRVKAVAAAIIPKYSFKIMRNKPVMPAACATLYLKDGLIVRVNKII

SEQ ID NO: 26917 - protein, 181 aa, Vigna radiata
MASSMISSPAVTTVNRAGAAGMVAPFTGLKSLGGFPTRKTNNDITSVANNGGRVQCMQVWPTIGKKKFETLSYLPDLTEEQLGKEVDYLLRSGWIPCLEFELSHKDAFPHRENNRSPGYYDGRYWTMWKLPMYGCTDSSQVLKELREARTLYPDGFVRIVGFDSVRQVQCISFIAYKPPGY

SEQ ID NO: 26918 - protein, 454 aa, Arabidopsis thaliana
MNEDRISDLPDALLLQILSSLPTENAIATSVLSKRWRSLWTMLPKLKFDSNFNPVFDDDNIDPTMFSENVYKTLSLHKAPVLESLHLSFEGRTDCLHVGIWIATAFARGVRKLVLDSFYQEDQTVTLPSVLFSYNDSLEILKLKCAIDLDFPSRVCLKSLRKLYLDQVHFKDEESVCNLLCGCPSLQDLVVHRYSNADVATFTIASPSLQRLTIEDLRQEGGYGNGSYVINAPGLKYLNINGVIDIESCLIDKALELEEAKISNVSGITNENILESLTSAKRLILHLSPLEVKVPTGKIFDQLGCLELLTHEREWWNLLSIMLDSSPKLQILKLTDVSNFTSCLFPQLHFQVYLHDNKTNPDERKWNPPKCAPECLLFHLETFLWIGYEWQRGDEKEVATYILENARRLKKATFSTKRIGREKLEDFEKRREMLNELAIVLWDSNSCHLVFEST

SEQ ID NO: 26919 - protein, 477 aa, Listeria monocytogenes str. 4b F2365
MTESKFPKDFLWGGAVAANQCEGAYLEDGKGLSLVDILPTVEDGRWEALFNPAKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVAEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 26920 - protein, 327 aa, Listeria monocytogenes str. 4b F2365
MKKRQLGNTGLVTSELGFGCMGLNYHRGPAKDRKEMIEVVRTAMDAGITMFDTAEVYGPYTNEELVGEALVGKRNHVQIATKGGFKINGLNNEVDSRPESIKAAVEGSLKRLKTDYIDLYYIHRIDPSIPIEEVAGTIQNLKQEGKILHWGLSEASAKTIRRAHKVEPLAAVENEYSIWWREAEKEIFPVLEELGIGLVAYSPLGRGYLTGKLDINASFNENDNRGGLPRFQKEAMEANQVLLDFMKEIADEQNVTTAQLAIAWILDQKPWIVPIPGTTKQSRIKENIASTDIRFDDGARQKIADALSQIEIVGDRYSAAENKRIGK

SEQ ID NO: 26921 - protein, 335 aa, Listeria monocytogenes str. 4b F2365
MDPFLLKDLKQHLGGTNDAIKEAPQEIQMPDFSNLEIATAAALQMRATMGSPNIDLSNGVTTEYRVVEGDYGDIPVRIYRHEEATKPVPAFIFYHGGGFVGGTPAVVENFCKGIAEKLPAVVINVDYHLAPEFPAPAAPKDCYRALEWVVEQSDELGIDASKIGVSGDSAGGTLAAAVSYMDYEAETNYVGFQALLYPALTLVDEDNDKYQWDISKFGASEETLPLVAPGIIGMNSSGELLRTAYVRDENPASPIYSPLSAVDKSIYPPTLIASAEFDALRAFADIFAKELRASGVQTKVIVYQGMCHAFIDKYGIFPQAEDVADEIVQMMKEIF

SEQ ID NO: 26922 - protein, 502 aa, Listeria monocytogenes str. 4b F2365
MAFYFEEPSRTFSEFLLVPGYSSAECVPTNVSLKTPIVKFKKGEESAITMNIPLVSAIMQAVSDDNMGIALATEGGVSFIFGSQSIESEAAMVSRVKNHKAGFVISDSNISPDKTLQDILNLKEKTGHSTVAVTEDGTAHGKLLGIVTSRDYRVTRMSPDEKVADFMTPFEKLVTANKSTTLKEANNIIWDNKLNALPLVDDNEHLVHMVFRKDYDSNKENKLELLDSSKRYVVGAGINTRDYEERVPALVEAGADILCIDSSEGYSEWQKRTLDYVRGKYGDTVKVGAGNVVDRDGFRYLAEAGADFVKVGVGGGSICITREQKGIGRGQATALIDVAKARDEYFEETGVYIPICSDGGIVYDYHMTLALAMGADFIMLGRYFSRFDESPTNKVNLNGTYMKEYWGEGANRARNWQRYDLGGDKKLSFEEGVDSYVPYAGSLKDNVAISLSKVRSTMCNCGALNIPELQQKAKITLVSSTSIVEGGAHDVVVKDASNNLIK

SEQ ID NO: 26923 - protein, 308 aa, Listeria monocytogenes str. 4b F2365
MTIANSITDLIGKTPIVKLNRLPEAGSADVYVKLEFQNPGGSVKDRIANAMIESAEKSGALKPGDTIIEPTSGNTGIGLAMVAAAKGYQAIFVMPETMSLERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATVKAALDLAKELGAGKKVLAIVASNGERYLSTPLYNFED

SEQ ID NO: 26924 - protein, 457 aa, Listeria monocytogenes str. 4b F2365
MAKAKRTTKFVCQACGYESAKWMGKCPNCNEWNQMVEALEPSKKSRSAFNHTGEPSKATPITQIASETEKRVETNMPELNRVLGGGVVPGSMVLVGGDPGIGKSTLLLQVSAQLTLTNKKVLYISGEESIKQTKLRAERLQVSGDNLYVYAETNLEAVQETIDFVKPDFVVIDSIQTVYHPDVTSAAGSVSQVRECTATLMRIAKMQNIAIFIVGHVTKEGAIAGPRLLEHMVDTVLYFEGERHHAYRILRAVKNRFGSTNEMGIFEMRDVGLVEVANPSEVFLEERLEGASGSTVVASMEGTRPVLVEIQALVSPTMFGNAKRMATGIDYNKVSLIMAVLEKRVGLMLQNQDAYLKAAGGVKLDEPAVDLAVAVSVASSYRDKPTRSTDCFIGELGLTGEIRRVARIEQRVQEAAKLGFKRIFIPKNNEGNWKIPKDVQVVGVETIGEALKKALPD

SEQ ID NO: 26925 - protein, 486 aa, Listeria monocytogenes str. 4b F2365
MTEVKKQFPKGFLWGGATAANQVEGAYDVDGKGLSTADMVKFIPKEERTQDHALDVSKAEIEAIIAGKVEGRFPKRDGVDFYHHYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSFMNRFFQENDIHIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLIGYTSWGPIDLVSASTSEMSKRYGFIYVDQDDWGKGTLERSRKDSFFWYKKVIETNGEDLV

SEQ ID NO: 26926 - protein, 478 aa, Listeria monocytogenes str. 4b F2365
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLSSAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 26927 - protein, 338 aa, Listeria monocytogenes str. 4b F2365
MIELHQVSKSFNVNGKTVEAVKNVSITVEKGEIFGVVGYSGAGKSTLVRCINLLERPDAGQVVIDGKNLSTLSSKELRVARRKIGMIFQGYNLLKTATVYDNIAKPLKLEGVPKDEIETRVNKYLSIVGLEDKRNNYPSQLSGGQKQRVAIARALAHEPEILLSDEATSALDPETTEAILQLLLKINAELGITIFLITHELDVIQRICDRVAVMENGHLVEQGTVLDIFTKAKHATTKRFVGSEASFDIPQDLLEKYVATGKLVSLHFIGDEADEPALALVSRKFDVLPSILAGGIDHLKNGTLGKLLVHLKGDEVEYSKAISYLKESGVVVEEVELL

SEQ ID NO: 26928 - protein, 393 aa, Listeria monocytogenes str. 4b F2365
MKISKRLQNLPDQFFSSLVEKVGKKVAEGHDVINLGQGNPDQPTPKHIVEAMKTASEKPLNHKYSLFRGKHELKQAAADFYAREYNVTIDPNTEVAILFGTKTGLVELPMCLMDPGDTMLLPDPGYPDYLSGVVLGEVQFEKMPLIAANNFLPDFTKIPEDIAEKAELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQTCVGELTARYESRRDAFISACKKIGWEAVAPAGSFFAWMPVPENFTSSEFADYLLEEVSVAVADGSGFGEFGEGYVRVGLLMDEERLEEAVTRVSKLHLFDKVTQQ

SEQ ID NO: 26929 - protein, 463 aa, Listeria monocytogenes str. 4b F2365
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTHKTMIAAYNVMYASALGVKAFKEGGYPGQIGIVHSYTPVNGVDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIKSQGKLIKRREF

SEQ ID NO: 26930 - protein, 471 aa, Listeria monocytogenes str. 4b F2365
MHTNTGFPANFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEKDENGNYTVNDDYRINYLSAHLSQVKEAIKDGVDLMGYTSWGCIDLVSASTAEMKKRYGFIYVDRNNDGTGTLNRYKKKSFGWYKNVIATNGEDL

SEQ ID NO: 26931 - protein, 254 aa, Listeria monocytogenes str. 4b F2365
MRKPLVGINMKNYINTRAQTSEWLEATIPLLKNFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVRANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 26932 - protein, 480 aa, Listeria monocytogenes str. 4b F2365
MKELLTFPKNFWWGSAWSAEQAEGRGDTGKAKTVWEHWFETEPNRFYEGVGSEITTDHFNRYKEDVQWMKKTGQNSFRISISWARMFPNDGVGEVNPKAIAFYRDLLTEMNENGIKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYDTSKLVGTKREETTNG

SEQ ID NO: 26933 - protein, 488 aa, Listeria monocytogenes str. 4b F2365
MADVRKLKNYINGEWVESRADKYEDVINPATGEVLCQVPISTRAELDQAAVIAEQAFEKWSQVAVPRRARVLFSFQQLLIQHKEKLARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLAALRTAAQNVKIGNGLDDGVFLGPVIREENQKRTIAYIEKGLEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 26934 - protein, 325 aa, Listeria monocytogenes str. 4b F2365
MNLNKHSERKFDLITVGRACIDLNAVEYNRPMEETMTFSKYVGGSPANIAIGTAKLGLKVGFIGKISADQHGRFIEKYMRDLSINTDGMVKDTEGRKVGLAFTEIKSPDECSILMYRENVADLYLTPEEISEDYIKEARVLLISGTALAQSPSREAVLKAVSLARKNDVAVAFELDYRPYTWTNTEETAVYYSLVAEQADVIIGTRDEFDMMENQVGGKNEATKAHLFQHQAEIVVIKHGVEGSFAYTKAGETFQAKAYKTKVLKTFGAGDSYASAFLYGLFSGESIETALKYGSAAASIVVSKHSSSDAMPTADEIKALIAQAE

SEQ ID NO: 26935 - protein, 222 aa, Listeria monocytogenes str. 4b F2365
MKMIAASIMCADSLHLADELRALEQANVKMLHCDVMDGVFVENAAMGAYVLQDIKNNTDMLLDIHLATVNPDRFVDLYAAIKPAYMSFHVEASPDVDATIKHIRALGIKPSIAISPDTEIEQIYPFLDKVDMVLMMTVNPGFAGQKFQHHVLEKIKKLQRELESHTNKPLIEVDGNIFEETVRLLEPIGADVYVVGTAALFNDKAGSYTEKLAPLREIIQER

SEQ ID NO: 26936 - protein, 216 aa, Listeria monocytogenes str. 4b F2365
MAKIVPSVFGADIGRINEQLEVLEKNGIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNAELAKECTLAGADLIVVGSYLFEGDIEANLEKLSKGVLTE

SEQ ID NO: 26937 - protein, 105 aa, Listeria monocytogenes str. 4b F2365
MTSVDFSKGLVPTIILDDQNGDVLMLAYMNEESYQKTLETGYTWFFSRSRNELWNKGATSGHTQKVKQIWTDCDNDTLLIRVTQIGPACHTGKKSCFFNLIKEDF

SEQ ID NO: 26938 - protein, 464 aa, Listeria monocytogenes str. 4b F2365
MTYKFPENFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNNFKRTIKASGHWYKELSENNGFED

SEQ ID NO: 26939 - protein, 305 aa, Listeria monocytogenes str. 4b F2365
MKRITIGNSALTASEISLGCMRMADLSKEDANKVINTALENGIDFFDHADIYGGGKSEEVFADAIDMNATIREKMILQSKCGIRQGFFDFSKEHIIASVEGSLKRLKTDYLDTLLLHRPDTLFEPEEVAAAFTELEKSGKVRHFGVSNQNPGQIELLKKYVDQELIANQLQFSIMHTGMIDTGFNVNMTIDPSLDRDGGILEYSRLNNMTIQAWSPFQYGFFEGVFLDNDKFPELNKVIDKIAADKGVTNSAIAVAWIQRHPASFQTVVGTMNPGRIADIAKASDVTLSREEWYEIYRAAGNQLP

SEQ ID NO: 26940 - protein, 463 aa, Listeria monocytogenes str. 4b F2365
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPFYPVLPIVSFLLCAFLISRLSVHTWILCGIWFVIGLIVYFAYGRKHSELLKK

SEQ ID NO: 26941 - protein, 458 aa, Listeria monocytogenes str. 4b F2365
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 26942 - protein, 486 aa, Listeria monocytogenes str. 4b F2365
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 26943 - protein, 364 aa, Listeria monocytogenes str. 4b F2365
MTETIIRFENVTKQFDNDPPVLDNVSFEIEKGKFYTLLGPSGCGKTTILRLIAGFLEASEGQIYLGDKVINQIPANKRPVNTVFQDYALFPHLNVYENVAFGLRIKKLKKDAIDEKVKEALRFVNLKGYEKREISEMSGGQRQRVAIARAIVNEPEVILLDEPLSALDLKLRTEMQYELRDLQKRLGITFIFVTHDQEEALAMSDEIFVLNKGEIQQSGTPIDIYDEPINKFVADFIGESNIVNGKMIQDFEVEFVERRFECVDQGFRPNEVVEVVIRPEDLEITSAEKGQLQVTVDWMLFRGVHYEVGCIDTDGNEWLVHTTRKVRVGDKIGLAFEPEAIHVMRLGETEEEFDKRLDSYDEVQ

SEQ ID NO: 26944 - protein, 461 aa, Listeria monocytogenes str. 4b F2365
MSLFSLKRKNYFVPLEIQRQQWFKHFIVAFMSVFICYLTVYLLRNNFKAAQTLLIEQNHFSTTELGMIGLAFSVMYGIGKTILGYAVDGRNAKKIMSFLLGISAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGIQIFGYTLHGWGATFTIMFTALIIAGLMMIPVALKQEKIIRQAKVLHL

SEQ ID NO: 26945 - protein, 510 aa, Listeria monocytogenes str. 4b F2365
MEFWRRSVFYEIYMKSFQDSNGDGLGDFKGLTSRLDYLVDLGIDGIWLTPFYPSPQVDNGYDVSDYCDINPDYGDMTDFRVFMKAADARGIKVIIDLVLNHSSTEHAWFKESRSSKTNPKRDYYIWREKPNNWESFFGGSAWEMDELTGEYYYHSFAKEQADLNWANEAVRAEMEQVLAFWLNEGVAGFRLDVINNLTLVLEFTDNPVTSGEMEHVYDRNQSGLEQALEDIASFCRKERDVFLVGEISSDQLAEIARYSSKKMLDVTFNFNFGSVDQLDAKSVFTTLNEMETALNEGQWPTLFFGSHDMSRFRSRLASGGLVKTQLLAFLMLTAKGVPFIYYGEEVGMPDLTFSSVKEMRDIQGTAAYYQALQTGTDEKQALEIAIEKTRDKARGPMIFPDGKPFTLGEPWIKMATLPEKEARTMWRFYQGLLAFRKENDFKEMEYTFLKLDGEVLSYQRGEFIFLLHFGEEEVTYPLQGNYQLVFGEAVMVGNGIRMGAHTGIALRVEE

SEQ ID NO: 26946 - protein, 449 aa, Listeria monocytogenes str. 4b F2365
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMMLHKHAVPQKVEKNPDGSLTLSLEDGRTETVDTLIWAIGRKPVIQGLQIEKAGVKLLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 26947 - protein, 488 aa, Listeria monocytogenes str. 4b F2365
MSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 26948 - protein, 483 aa, Listeria monocytogenes str. 4b F2365
MFENYQFPKDFLWGGAIAANQAEGAFKVDGKGISLADLHKYHKGKTNDEISEEQHKGVSLADIKASMEDKVNYYPKRHGIDFYHTYPEDLALLAEMGFKTFRTSLDWTRIFPTGEETEPNEAGLKYYDQLIDKIIELGMEPIITILHYETPVEIVLNNGGWHNRKVIDLFEKYGKTVLDRYNKKVKYWIVINQINLIQFEPFNSTAIPYDAVDDYLSATYQAVHNQFVASAKIYEYGKALNPDLMIGTMLADCTAYPFSCDPDDIVLAMKRNRMEYFFADVQFQGEYPQYALNYFDENNIHIEITEDDKAVLQKNTMDYLALSYYYSQMVDSKKNDLDPASITPNPHLKANPWGWAVDPKGLYNALSQYWDRYHKPIIIAENGFGMYDKLENGEIHDDYRIDYLSAHLKEMKRAMYDGVEIIAYCAWGPIDIVSCSSAQMEKRYGFIYVDLDNEGNGTGKRIKKDSFSWYKKVIESNGEDLEA

SEQ ID NO: 26949 - protein, 159 aa, Listeria monocytogenes str. 4b F2365
MNVHDFSEKAMNGKEIALSDYKGKVLLIVNTASKCGLTPQLEGLEAMYKKLGGANFEILGFPCNQFLRQDPGSDEEILEFCQMNYGVTFQMFSKIKVKGKDASPLYKYLTEQTGGKKVEWNFAKFLIDENGEVVERFPSKMKPADFEDKVEALVAKVNN

SEQ ID NO: 26950 - protein, 286 aa, Listeria monocytogenes str. 4b F2365
MEKIGFVGTGVMGSSMAGHLLEAGYEVLVYTRTKTKAEDLLEKGALWIKTPGELANKVDILISMVGYPKDVEELYLGENGFLENLAVGTVAIDMTTSSPALAKKMAEFGREKGIGVLDAPVSGGDIGAKNGTLAIMVGGSEDVFLKVKPIFDILGSSVILQGDAGAGQHTKMVNQIAIASNMIGVTEAIIYAEAAGLNPSSVLDSISGGAAGSWSLANLIPRVLKDDFSPGFFIKHFIKDMGIAISEAKQMGLELPGLTLAEKMYQTLAEQGLSEEGTQALIKYYR

SEQ ID NO: 26951 - protein, 467 aa, Listeria monocytogenes str. 4b F2365
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVPNIFAIGDIVPGVPLAHKASYEAKIAAEAIAGEKAENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 26952 - protein, 496 aa, Listeria monocytogenes str. 4b F2365
MTNLFQDDSLTLHTDLYQLNMMKAYFDDGLHERRSVFEVFFRDMPFDSGFVVFAGLERIIHYMQNLRFTETDISYLHDELGFDGPFLEYLRNFKFKGNILAAKEGEFVFKTEPILQVEASLAEAQLIETALLNIVNFQTLIATKAARIRSVIDDETFAEFGTRRAQEMDAAIWGTRAAYIGGCDSTSNVRAGKIFGIPVSGTMAHAMVQAYRDELEAFRSYAKTHFDSIFLVDTYDTLKSGVPNAIKVAKEMGDKINFIGIRLDSGDMAFLSKKARQMLDEAGFTEAKIFASSDLDEHTILSLKAQKAKIDSWGVGTKLITAYDQPALGAVYKMAAIADENDILQDSIKLSSNTEKVSTPGKKKVYRIITNEDGLKAEGDYIALADESLENVDKLTMFHPVHTYIMKTVENFTARELLVPIFQNGELVYDMPSLDEIKAYKEENLALLWDEYKRTVRPEQYPVDLSVKCWKNKMRNIEKVRKSVQLHSPVELDMPF

SEQ ID NO: 26953 - protein, 475 aa, Listeria monocytogenes str. 4b F2365
MATEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTVSVEFEDGSENEMLIPKNLIIATGSKPRTLNGLSIDEENVLSSDGALNLETLPKSIIIVGGGVIGMEWASMMHDFGVEVTVLEYADRILPTEDKEVAKELARLYKKKKLIMHTSAEVQAASYKKTDTGVEIKAIIKGEEQTFAADKILVSVGRSANTENIGLQNTDIATENGFIQVNDFYQTKESHIYAIGDCIPTIQLAHVAMEEGTIAANHIAGKVAEKLDYDLVPRCIYTSTEIASVGITEEQAKERGYEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 26954 - protein, 446 aa, Listeria monocytogenes str. 4b F2365
MAKFTYDVVIIGSGASGTTVAFEAQAAGLKVAIVEERSWGGTCVLRGCDPKKVLVGAREARNLSTRLRGKGIKQAATISWTDLMAFKETFVENVPESRLENFQEAGIETFFGAASIQDSHSLQVGDDLIQANKIVIATGATPSTLKVEGQEYIQTSDDFLSLEKLPDSVVFIGGGYISFEFASIALATGREVHIIHHNSEPLKKFDPDFVAALVSNMKEEGIHFHFDTDITKVENKGEKLHIHGKDGFSLQTDLIIGATGRKPNIAHLSLENANIDYTKKGIIVNEKLQTTNNPHIYACGDVAATKGAPLTPVVSMEAAFVAKNVIGGDEKMIYPAIPSVVFTSPKLASIGISAEEAKAHPEKYQIKNHDTTNWYTYKRTNEQIALAKIIEDRESGQIKGAHFLSEEADYMINYVAILMKANLTLSDLQSVIFAYPSPASDLTALN

SEQ ID NO: 26955 - protein, 376 aa, Listeria monocytogenes str. 4b F2365
MAKRDYYEVLGVSKSASADEIKKAYRKLSKQYHPDINKEAGADEKFKEISEAYEALSDPQKRAQYDQYGHVDPNQGFGGGAGGGFSGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 26956 - protein, 342 aa, Listeria monocytogenes str. 4b F2365
MKNNVLVTGGTGFLGMHIIFQLLQQGYQVKTTVRSLKSKEKVIEVMQNNGITDFTQLSFVELDLSKDEGWKEAMLDCKYVLSVASPVFFGKFKNEEELIRPAIEGITRILQAAKEAKVKRVVMTSNFGAIGFSNADKNSITTEAYWTDELAKGLSAYEKSKLIAEKEAWKFMENETELEFATINPVAIFGPSQSSHVSGSFDLLKNLLNGSMKRIISIPLNVVDARDVADLHIRAMITPEANGERFIASADGEISMADIAHLLQRERPELVSKMPKKTLPNAAIRAAAIFSKHAKEGELMINMNRQISNSKARDLLGWQPISTKEEAVLAAVDSLAKYGLLD

SEQ ID NO: 26957 - protein, 282 aa, Listeria monocytogenes str. 4b F2365
MKIAYLGPAASFTHAAAAKAFPKEEMIAKSTIPDCIMAIEKEDVDVAVVPIENTIEGSVNITLDYLFHFSSVPVVAEIVLPIAQHLMVHPAHVSAWKSVQKVMSHPQALAQCHTFLQAELYGVEREVTPSTAYAAKWVSNNPTELVAAIAPRMAANEYGLEIVKENAQDLELNQTRFFVLSRKPVSILLPKEEEKTSISVILPNNMPGALHKVLSTFAWRDIDLSKIESRPLKTSLGEYFFLIDVLSEGKETLVTNALDEITLLGGTANKLGTYHVHRLQTT

SEQ ID NO: 26958 - protein, 429 aa, Listeria monocytogenes str. 4b F2365
MQNYSKSEKAFKEAKKVLPGGVNSPVRAFNSVDASPVFMDHGKGAYITDVDGNEYIDYVLSWGPLILGHADPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAELAFQKYGEEIAAVIVEPVAGNMGVVPPIDGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTEKEIDKTLEAFDTTCKILRG

SEQ ID NO: 26959 - protein, 294 aa, Listeria monocytogenes str. 4b F2365
MLGDLFTKPKKRKYATIPSDGTKADVPEGIMTKCPECKKIMYTKELQKNLMVCNYCGFHHPIGAKARIDMLVDEGSFEEIDASLTTANPLGFEDYMDRIEKDKQKSGLNEAIVTGHATIDGNPLVIAVMDSRFRMASMGSVVGEKIFRAVEDADKTNKPFVIFTASGGARMQEGMLSLMQMAKTSAAFKRFSNHGGLIITVMTHPTTGGVSASFASLGDYNFAEPGALIGFAGRRVIEQTVREELPEDFQTSEFLLKHGQLDDCISRLDLQNKLSFILSIHVKTPEVGGEADGE

SEQ ID NO: 26960 - protein, 386 aa, Listeria monocytogenes str. 4b F2365
MKHVFPTYKRFPIDLVNGTGTVVTDKNGKTYLDFTSGIAVCNLGHCPANVAEAVQQQLTNIWHTSNLYECALQDSVAELIADGKDRLVFFCNSGTEANEAALKLARKYTGKEKIITFEKSFHGRTFGSMSATAQAKIHQGFGGLVPGFTYVPYNDIEAFRAEIDEHTAAVMLEVIQGEGGVIPANAAFLLEVQLLCKKMGVLLIIDEVQTGLGRTGTLYGFEQIGLEPDIFTLAKGLGNGLPIGAMVGKANLSSAFGPGSHGSTFGGNKLALAAAKEILRTMKQAGFLEEVNAKADYFRYLLEVHLEALDNVSVIRGGGFLIGIELENTAEPVVTELRDKGLLILTAGANVLRILPPLTVSYAEIDQAIYLLKSVLENQLIGSEEG

SEQ ID NO: 26961 - protein, 276 aa, Listeria monocytogenes str. 4b F2365
MKKITPKAMCAWIPKREDETHKGDYGRVLIVAGNKQFGGAAIMAAEACVKSGAGLTTVASDSVNRPALQTRIPECMFIDYENISSLSEQISQFDTILIGPGLGLDAYAEEIFRLVLEKSTEQQQVIIDGDGITIYAKGENPHPAAKLTFTPHAGEWERLKVLAPDAVTPTDVALAIDATIVLKGHRTKVYSGESAWQNMYGTPAMATGGMGDTLAGTICGLMAQTEKPITGTLAAVFLHSYIGEILAKKRYVVLPTEIAEELPTYLKIFSETDEHA

SEQ ID NO: 26962 - protein, 257 aa, Listeria monocytogenes str. 4b F2365
MTKTLTNKLAKKDHAAVVTYIMGGDGGLDNLEEQLLFLEKSGVSAIEIGIPFSDPVADGPIIQLAGLRALKEQVSLEAILNKLARSKVQIPLIIMSYINPIFHLGIPKFVELVQKTPVKGLIIPDLPYEHQTLITPELQGTDIALIPLVSLTSPKERLEEIAKQAEGFIYAVTVNGTTGVRSEFDAHIDNHLAYLKSISPVPVLAGFGVSSIEHVEKFAHVCDGVIIGSKVVQMLHEEKTAELGAFLQKAAEVRIEN

SEQ ID NO: 26963 - protein, 467 aa, Listeria monocytogenes str. 4b F2365
MTNWLQKRVRLSPKETALVFEGKEETFEEISEAVKQLAGKLFALGIRKDEMVALLGKNDRMTFLLIHALQQLGAVTLFLNNRLTKKEISFQLANAEVKHVIVADSLVDKVATGISYATLAETDYEAPALLETWDLSRAASVMYTSGTTGKPKGVVQTYENHWWSAVASVLNLGLTEKDSWLCAVPIFHISGLSIMMRSVIYGIPVYLEEHFDEEKITQLLESGKISTISVVTSMLERLLKIHSGSYHPNVRTVLLGGGPASKAVLEICKQRDIPLVQSFGMTETASQIVTLPPKDALNKIGSSGKALFPAEVKIADDGEILLKGPSITPGYLHNKKATEASFVDGWFKTGDIGYLDEEGFLFVLERRSDLIISGGENIYPTEIEHVISEYEGVKEVAVIGKPDDKWGSVPVAFIVAEETFDEAELRLICETNLAGYKIPKQITIVEKLPKTASGKIQRNKLKERHSM

SEQ ID NO: 26964 - protein, 432 aa, Listeria monocytogenes str. 4b F2365
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDFASFKEALAVWGDQVAAVLVEPIVGNFGMVAPEDGFLEAVNELAHANGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAALKHGIAVTVNQIVGALTVYFTEDPVTNYAEAGATNGELFGRFFKGMLEEGINLAPSKYEAWFITSAHSEADILETIQAVDTVFGKMVQDN

SEQ ID NO: 26965 - protein, 489 aa, Listeria monocytogenes str. 4b F2365
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAVGIHFAVPYLSQSTRDNLDNGGVQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 26966 - protein, 215 aa, Listeria monocytogenes str. 4b F2365
MLEIKNLSKKFDQKTILDNVNISLQDGEILSIVGPSGGGKTTLLRCISGLEKMDTGEIFIDEEKIDPMSRKDVENTIGVVFQEFHLFPHLSVLDNLILAPTLARKTKKADAVKEAERLLGLLDLADKANSMPYQLSGGQKQRVAIARALAMNPKVLLFDEPTSALDPDLRDHVAALILSLKKVGITQIIVTHDHTFAEKVADQMMEVEPLKKEAI

SEQ ID NO: 26967 - protein, 509 aa, Listeria monocytogenes str. 4b F2365
MKRALISVSDKNGIVPFAEKLVELGVEIISTGGTKAAFEQAGVPVTGIEEVTEFPEMLDGRVKTLHPAIHGGLLARRDTAEHMEAIAAHDIKPIDLVVVNLYPFQETIQKSGVTLEEAIENIDIGGPSMLRSAAKNYAAVTVVVDTADYDTVLTELEEHGATTFETRQRLAAKVFRHTAAYDALIAEYLTNITGETFPEKVTLTYNRKQVLRYGENPHQDAAFYTEPGTVENSISSAKQLHGKELSYNNIRDADAALKIASEFTEPVAVAVKHMNPCGVGVGENIEEAYLKAYEADETSIFGGIVALNKEVDAKTAEHMSKIFLEIIIAPSFSEEAFAILAKKKNIRLLTVPFAGSVKGFEKTSVNGGLLIQASDSVIEDTASYEVVTEKQPTEAEMKALIAQWKIVKHVKSNAIVVGSDKQTLGIGAGQMNRIGSALIALKQAGEKAKGAVLASDAFFPMDDTVEAAAKAGITAIIQPGGSIKDKESIEMANKYGISMVLTHVRHFKH

SEQ ID NO: 26968 - protein, 218 aa, Listeria monocytogenes str. 4b F2365
MGKIAPSILSADFANLARDIKEVENCGADYIHIDVMDGHFVPNITFGPAVVQAIRPETKLPLDVHLMIENPDTYIPEFAKAGADYITVHVEACTHLHRTLQLIRYYGVKAGAVLNPATPIDVLQHVLNELDMVLFMTVNPGFGGQKFIPEVLEKISAFKKIVDEKGLDIEIEVDGGVDHETAKLCRDAGANVFVAGSYIYGNKNRQTPIDKLRAIVGE

SEQ ID NO: 26969 - protein, 427 aa, Listeria monocytogenes str. 4b F2365
MQKFFNKVFRLNEHKTNFRTEFLAGMIGFFTVAYIIVVNSSILAEAGVPYQGAVLATIFISALGCLIMGFWANAPLILMPGMGINALFAYTLVQGMGLSWQVALAAVTMSGLLFMILAFTPLAGKLNEAIPLILKQAITVGLGLFLIFLGLEKGGIVTRGKHAIIAVGDLGDPFVLATLVTLLLTMILVIRKIPGAFLWSLIIGTVVGVMFGVAGKAGGASISVAPWSDVLFKADFSGMASVGFWSAVFTMTMVIVFETVGLTNGQVRQLKQTEKLPRILKASSLTAFLSGLFGTSPTISALESGSMFASGAKTGLATITTGLFFIASLFLMPVLSFIPNSAIAPILIIIGMSMLQEFKEMDLSNAAETFSALLIIVLIPLTYSIADGIAAGFIAYPILRAFTKNEERTSPVMYVIAALFLLQFIIQ

SEQ ID NO: 26970 - protein, 456 aa, Listeria monocytogenes str. 4b F2365
MQQTVTYGAKWKQFLTIFTPIVITQLTLFSMTFFDTTMSGNYSNQALAGVAIGSSFWAPVNAAFSGLLMAITPIIAQLIGAKKEKQVKNTVHNGLYIALFLAFILILINFLVVPTILTHMPVTAEVAGIARHFLNGICIGIPAFFISAILRSFIDSLGLTRVTMLITLCTVPFNIFLNYCFIFGNFGFPEMGGAGSGYATGITYWLVVLVSVILIQTQTRLRKFGIFKGLTALRFSKIKEIIGIGVPNGLTILFETSIFSAVTILMGAFGTETIAAHQSANSVCTLLYAFPLSVASTLTILGGYETGAKRLKDAKQYRHIGMAAAIFIGCVNGAILFFFRDIIAGFYTNDPALSNLIMHFLVYAILFQFADAVLSPVLGALRGYKDVTVTSIVAFISYWLIGLPVGYGLSFTNLGPFGYWIGLSTGLFVAAFILSIRVRKTEQKLSFNTKDAEISS

SEQ ID NO: 26971 - protein, 263 aa, Listeria monocytogenes str. 4b F2365
MRVAVSGFKGRMGHEVVKTVLREADLELVAVLDHEPKEKNINEIVEFSSLDVPVFGNLSEMLEEIKPDCVVDFTTPKVGYSNTKTILEHGVRAVVGTTGFTPEQISELRSIAESKKIGALIAPNFAVGAVLMMQFAQKAAKYFPNVEIIELHHDNKLDAPSGTAVKTAEMMAETREFVKQGAADEVELIEGARGAEYEGMRIHSVRLPGLVAHQEVIFGAEGQGLTIRHDSYDRISFMSGVALSVRKTKELETLIYGLENILD

SEQ ID NO: 26972 - protein, 331 aa, Listeria monocytogenes str. 4b F2365
MEYVKFGNTGMDVSKICLGTMGFGDKDKWIHKWVLNEANSRPIIKKALDLGINFFDTANIYSYGESEKIVGRALKDYANRDDVVLATKVQQTMRPDRPNSGGLSRKTILSEIDHSLKRLETDYVDLYIIHRFDENTPIEETMEALHDVVKSGKARYIGASAMYAWQFQKAQRVAERNGWTKFVSMQNHYNMIYREEEREMIPFCRDEKIAITPYSPLASGRLTRDLNETTNRSETDPVQKSKYDDMMNADRGIIERVAELAETHQVSRDKIALAWLLNKDEITSPIIGAQKESHLESAVEALNIQLTAAEVNYLEELYIPHPVVGALPTTK

SEQ ID NO: 26973 - protein, 347 aa, Listeria monocytogenes str. 4b F2365
MKNTIKWIAIGFAGIILLPLLIVFFIYKKAVGKKEYNPEVLENLDEASQEFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 26974 - protein, 229 aa, Listeria monocytogenes str. 4b F2365
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPAGENLKVTLERVIPYWMDTIAPEIKEGRRVVIAAHGNSLRALVKFLEGIGDDEIMDLEIPTGVPLVYELNDDLKPVNKYYLDK

SEQ ID NO: 26975 - protein, 241 aa, Listeria monocytogenes str. 4b F2365
MIDIKNLHKHFGKLEVLKGIDLEIASGEVVVVIGPSGSGKSTFLRCLNLLEQPTTGTILFENKDLMAKQTNVNELRQKMGMVFQNFNLFPHKNVLENLMLAPMKVKNEDSAAAKKHALSLLEKVGLADKATSYPSQLSGGQQQRVAIARALAMNPDVMLFDEPTSALDPEMVGEVLSVMKSLAKEGMTMVVVTHEMGFAREVADRVVFMDAGVIQEQGTPEEVFGNPQNDRTKDFLGKVLA

SEQ ID NO: 26976 - protein, 430 aa, Listeria monocytogenes str. 4b F2365
MFQLKANGTDVKTEVISGFTTFLTMVYIVVVNPAILSAAGVPFNTVFMATIISAVIGTLWMAIFANYPIAIAPGLGMNAYFVTVVTTQKLDYSVAFAAVFVAGIIFLLLSLTPLREKIIEAIPHNLKAGITAGIGLFIAFLGFRMTGIIVSNDSNLVGLGDLHSKEAILAIVGLLITLILLALNVKGALFIGMIATGIIAFITGELKFTEGIVKLPPMPEFVFTNPIHAFGDVMSYGLYAVVLSFLLITIFDTTGTMIGVAKKAGLMKGESLPNAKQALMADAVATSVGSMFGTTPTSAYIESSAGVATGGRTGLTTLTVAILFMVSAFFAPLVGAVSGISAITAPALIVVGSMMIGAVKEIDWDTLDEAFPAFLVILAMPLTSSIAIGLAFGFISYPVLKVFTGKWRELNWFLIVIAVLFFILVAFLPH

SEQ ID NO: 26977 - protein, 259 aa, Listeria monocytogenes str. 4b F2365
MITIKNIQKSFGENKVLKGIDLTVKKGEVVTILGPSGSGKTTFLRCLNLLERPENGEISMHDQIINCKKPSKKEVLQLRKNTAMVFQQYNLFSHKTVIQNVMEGLTVARKMPKKIAREIAERELTKVGLADKFSAYPSQLSGGQKQRVGIARALAINPDVILFDEPTAALDPELVGEVLEVMLEIARAGATMIVVTHEMEFAKRVADQVVFMDGGLIVEQGTPDEVFNHTKEERTKRFLHRVSADYLYEIKEVKKERVI

SEQ ID NO: 26978 - protein, 226 aa, Listeria monocytogenes str. 4b F2365
METLLSFDKVYKDYPSGPSIIHALKETNFEAKKGELIAIVGPSGSGKSTLLSLAGALLTPTGGTISINGKSVGNLSSKEQTALRLEEIGFIFQAAHLVPYLHVKDQISFIGKMAGKSAAELEKDTASLLSQLGISDRANFYPKDLSGGQKQRVAIARALINQPSVILADEPTASLDTERSREVVELIRNEVVQTSRTAIMVTHDERMLDLVNHVYRMEDGILTQES

SEQ ID NO: 26979 - protein, 430 aa, Listeria monocytogenes str. 4b F2365
MSIITEVYAREVLDSRGNPTVEVEVYTEAGAFGRALVPSGASTGEYEAVELRDGDKARYLGKGVLKAVENVNDIIADKIIGFDVTDQIGIDKAMIELDGTPNKGKLGANAILGVSLAAARAAADELGVHLYEYLGGVNGKVLPVPMMNILNGGEHADNNVDVQEFMVMPVGAPNFKEALRMGAEILHALKAVLKGKGLNTGVGDEGGFAPNLKSNEEALETIMQAIKDAGYKPGEEVKLAMDAASSEFYNRETGKYELKGEGVTRTSEEMVTWYEEMITKYPIISIEDGLDENDWDGFKLLTERIGDRVQLVGDDLFVTNTTKLKEGIEKGIANSILIKVNQIGTLTETLDAIEMAKRAGYTAVISHRSGETEDSTIADIAVATNAGQIKTGAPTRTDRVAKYNQLLRIEDNLADLAEYHGNETFYNLKK

SEQ ID NO: 26980 - protein, 510 aa, Listeria monocytogenes str. 4b F2365
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVNAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 26981 - protein, 396 aa, Listeria monocytogenes str. 4b F2365
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGNKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 26982 - protein, 338 aa, Listeria monocytogenes str. 4b F2365
MSKLFSEYKLKDVTLKNRIVMSPMCMYSVENKDGIATDFHFAHYVSRAAGGTGLVILEATAVQEVGRISEFDLGLWNDEQVPALKKLVDGLHYHGAKAGIQLAHAGRKAVLPGEIVAPSAIAFDEKSDKPVELTKEAIKEVVADFKRAAYRAKEAGFDVIEIHAAHGYLIHQFLSPITNRREDNYGGPAGNRYKILSDIIKAVKEVWDGPIIVRVSATDYAHGGLQLEDHIPFAKWMKADGVELIDVSTGGLVNVAPPVFPGYQVPFADEIRRGAGIATGALGLITRGEQAEEILCNERADLIIVGRELLRNPYFAKDAAKQLGETIEGPKQYSRAWK

SEQ ID NO: 26983 - protein, 222 aa, Listeria monocytogenes str. 4b F2365
MTLMMKNISKNYQDGEQVIEVLKNVSLEVAQGEFVAIVGPSGAGKSTFLSIAGALLSPTEGEIAIGGKVLNDLTSKELTKVRLDKVGFIFQGANLIPYLNVRDQLLVIAELSGEKGRGAKEKADELLKELGLTARENNYPESLSGGEKQRVAIARALMNDPDIILADEPTASLDANRGHKVVQMIADEVKRKNKAAIMVTHDERVLDLVDRVIRIEDGYLKD

SEQ ID NO: 26984 - protein, 215 aa, Listeria monocytogenes str. 4b F2365
MKLVLMGLPGAGKGTQAEQIVEKYNIPHISTGDMFRAAMKNNTELGKKAKSFMDNGDLVPDEVTNGIVRERLAEDDAKNGFLLDGFPRTVEQAEELENILNDLGTELDAVINIEVDKDVLMKRLTGRWICRTCGKTYHEIYNPPKVPGKCDLDGGELYQRDDDKKETVEKRLNVNMKQTKPLLDFYSEKGKLHNINGEQDIKDVFVDVEKILASF

SEQ ID NO: 26985 - protein, 214 aa, Listeria monocytogenes str. 4b F2365
MTFVAPSLLAADYMNMANSIKEAEHAGADYLHIDVMDGHFVPNLTFGIDMVEQIKKTATIPLDVHLMLSNPENYIEKFAAAGAHIISVHIEAAPHIHRVIQQIKAAGCKAGVVLNPGTPASVLDAVLADVDLVLQMTVNPGFGGQAFIDSTIKNMRYLDHWRRENNGSYVIEVDGGVNAETAEKCKQAGVDVLVAGSYFFRADDKIACIKELKA

SEQ ID NO: 26986 - protein, 224 aa, Listeria monocytogenes str. 4b F2365
MRKIAASIMCADQLHLGEELRRLESAGVELLHCDVMDGVYVNNLALGPEYLEIVRNNTEIPLDIHLATITPLKYIDMFGPVKPEYISFHVEVAEDVSEVIRKIRSYNVKPSIAINPETPIEAIYPYLDDVEMVLMMTVNPGFAGQKFQTDVLQKLHDLKAKLAGKVHAPLIEVDGNINKETVGLMRDCLPDIYVLGTSALFHDRDKTSYAERLVHIWSDVEKHV

SEQ ID NO: 26987 - protein, 484 aa, Listeria monocytogenes str. 4b F2365
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFKRFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 26988 - protein, 482 aa, Listeria monocytogenes str. 4b F2365
MSNTKFPDGFMWGGATAANQFEGGYNSGGKGLACADLFTGGTHTEPRRITAQLEESTFYPSHEAVDFYHHYKEDIKLMAEAGFKVFRMSINWTRIFPTGKEAEPNEEGLQFYEDVFKELKKYQIEPLVTIAHFDIPLALTNEVNGWASRDLIDYYLHYCEVIFKRYKHLVKHWLTFNEINTATMEIGNYLSLGIRHAEGDFLHQKDDPTVRYQALHHQFVASAKAVKLGHSINPEFMIGCMIAYMPRYPRTCEPTDVLLAKQTEAMHSHFCGDVHVKGYYPFYAKTFFKDNGIELEFDPEDEQVLREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVEKYDDGTGDYSRKKKASYYWYKDVISSNGEIGLRE

SEQ ID NO: 26989 - protein, 113 aa, Populus deltoides x Populus maximowiczii
NDIGGKIPKELGNLKNLVSMDMYGNKFEGEIPKSFAKLKSLVFLRLNNNKLSGSIPRELATLKDLKVFDVSNNNLCGTIPVDGSFASFPMESFANNRLNGPELKGLVPYDFGC

SEQ ID NO: 26990 - protein, 112 aa, Populus deltoides x Populus maximowiczii
TFVGKKWFVTYHAYAMGRMESIWGKNCRDFVPERWLENGIYRQESPFKFPVFHAGPRMCLGKDMAYIQMKSIAASVIERFEIDVQNKEKCPDHLLSLTLRMKGGLQVKVKER

SEQ ID NO: 26991 - protein, 138 aa, Populus deltoides x Populus maximowiczii
MSIIWQLASVVSVLEEASGFKAMMKSRELLKGKMWVAIIIFFKLNLSSLALHILFENKVVHGSSLGILNRASFGILSLLMLLVLYLFGLVIQTVIYFVCKSYHHENIDKSALSDHLEVYLGEYVPLKSKDVQLEQFDV

SEQ ID NO: 26992 - protein, 494 aa, Ammi majus
MKMLEQNPQYLYFFSLFLVTIFLYKWLTLKKTPLKNLPPSPPQYPIIGNLHQIGPDPQASLRDLAQKYGPLMFLKFGTVPVLVVSSADAAREALKTHDLVFADRPYSSVANKIFYNGKDMVFARYTEYWRQVKSICVTQLLSNKRVNSFHYVREEEVDLLVQNLENSHSKVANLTELLIEVTGNVVCRVSVGSGDKVDSYKILILEIMDMLGYSRSIEDFFPLLGWVDWLTGLRGKVAEAAKGVDTFLEGVLKEHLSTTGSKYNDFVSILLEIQEADAGSSMDNECIKSLIWDMLGAGTETISTALEWTLAALIKNPDAMFKLQNEVREIGKGKSKISEADLVKMNYLQAVMKESMRLYFTAPLLVPREARQDIKFMGYDISSGTQVLINAWAIARDPLLWDKPEEFRPERFLNSPIDYKGFHYEFLPFGAGRRGCPGIQFAMCINELVVANLVHKFNFELPDGKRLEDLDMTAASGITLRKKSPLLVVARPHV

SEQ ID NO: 26993 - protein, 509 aa, Ammi majus
MALFLYLIIPCTIILLHQLYHKLRFKLPPGPRPWPIVGNLYDIEPVRFRCFNNWSKTYGPIISVWFGSTLNVIVNNTELAKEVLKDKDQQLADRHRSRSAAKFSRDGQDLIWADYGPHYVKVRKVCTLELFTPKRLEAIRPVREDEVTAMVESIYKDCTNSDTIGKSLLVRQYLGGVAFNNITRLAFGKRFVNSEGVMDEQGKEFKSIIANGLKLGASLATAEHIQWLRWLFPLEEEAFAKHGARRDNLTRAIMEEHTLARQKSGGTKQHFVDALLTLQSKYDLSEDTIIGLLWDMITAGADTTAIVVEWGMAELIKNPRVQEKAQEELDRVIGYERVLTELDFSNLPYLQCVAKEALRLHPPTPLMLPHRANANVKIGGYDIPKGSNVHVNVWAVARDPAVWKNPLEFRPERFLEEDVDMKGHDYRLLPFGAGRRVCPGAQLGINLVTSMLGHLLHHYSWAPPSGLSSDEIDMSESPGMVTYMKTPLQAVPTPRLPSQLYKRLAVEDM

SEQ ID NO: 26994 - protein, 1320 aa, Salmonella typhimurium
MGTTTMGVKLDDATRERIKMAASRIDRTPHWLIKQAIFSYLDKLENSDTLPELPALFVGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVADGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRRVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNILLERLYIERSLSVNTAAAGGNASLMTIG

SEQ ID NO: 26995 - protein, 254 aa, Hyacinthus orientalis
KSKKLKHKVKDPVRFNPNSEPKSSAAAAEPKAAFDDEWWFSFWNKNCDSGSNIPLDEEAAFKYFFRVSRPTFEYICSLVRDDLVSRPPSGLINIEGRLLSVEKQVAIAMRRLASGESQVSVGGAFGVGQSTVSQVTWRFVESMEERARHHMRWPEPERMEQIKARLEAAFGLPNCCGSIDATHIVMTLPAVESSDDWCDQERNYSMFLQGIVDDEDEGSYMVTGWPGSMTFFRLVEVLGLLQTVPQPGSRLMVP

SEQ ID NO: 26996 - protein, 126 aa, Hyacinthus orientalis
QGRNMTAAPMQGGMYSSAHGHDREQQQPIIALASALANASPEHQRMMLGENLYPLVAQLETEHAAKVTGMLLEMDQTEVLHLLESPESLRGKVAEAMEVLRNVAQQQHASNALHNQLSSLALNDDS

SEQ ID NO: 26997 - protein, 152 aa, Hyacinthus orientalis
METGGKMKKGAGGRKGGGPRKKSVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKTASKEKEGAKSPAKAGRSPKKAAV

SEQ ID NO: 26998 - protein, 152 aa, Hyacinthus orientalis
METGGKIKKGAGGRKGGGPRKKSVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKMASKEKEGAKSPAKAGRSPKKAAV

SEQ ID NO: 26999 - protein, 209 aa, Hyacinthus orientalis
MADDSETHIPTVKFGTQGLQVSKLGFGCMGLTGVYNSPIHEEDAISLILYAFSHGISFFDTSDAYGPLKNEVLLGKALKQLPREKVQLATKFGFAGVGPSGVIVKGTPEYVRKCCEASLERLGVDYIDLYYQHRVDKSVPIEETMGELKKLVEEGKVKYIGLSEASPDTIRRAHAVHPISALQMEWSLWTRDIEEDIIPALHGELRHLG

SEQ ID NO: 27000 - protein, 220 aa, Hyacinthus orientalis
ADLNIAIGTHHEVSHPGALKAALAEFISTLIFVFAGQGSGIAFSKLSGGGPATPAGLISAALSHAFALFVAVSVGANISGGHVNPAVTFGAFLGGNITLFRGLLYWVAQLLGSTAACLLLRFSTGEETGSFGLSGVSVWNALVLEIVMTFGLVYTVYATAIDPKKGSLGTIAPIAIGFIVGANILAGGAFDGASMNPAVSFGPPLVSWEWPNHWVYWAGP

SEQ ID NO: 27001 - protein, 268 aa, Hyacinthus orientalis
ALRFLAMAIALAASSVLAVDEADVRPTPVKFSKSSFPSGFVFGSASAAYQIEGAAKEGGRGPSIWDYFIDKHPVFFTEKIADRSNADVAIDFYHRYKEDIELMKDTGINAFRLSLSWSRILPNGKISGGINKEGVEFYNNVFNELLSKGIQPYVSIFHWDLPQSLDAEYGGFLSHRIVEDYKAYTDLVFELYGDRVKHWITFNEPFSFCFYGYASGDVCAWALLQISWGVPRGTLAVSLTSLPITCCLLMPLLLSSTETNFRHHKREP

SEQ ID NO: 27002 - protein, 141 aa, Hyacinthus orientalis
DNEHKSTSGQIDARCSSCEMAVIWLQNQLLQNKTEEHILNYANQLCEKLPNPMGESAIDCKKLARMPTVSFTIGGKTFDLTAEQYVLKVGEGAAAQCISGFTALDVPPPRGPLWILGDVFMSAYHTEFDYGKLRVGFAKAA

SEQ ID NO: 27003 - protein, 147 aa, Hyacinthus orientalis
FQLSEMLHVQLLLPVLGEEEKLKQLRVRDFAGEKVEMKKLVDVNCKEAAEKAKVQGAPPSALDNILEQIKKRPKLSVLDKTKKDWGEFKEENKGVEDQLDAYKKSSNQYLDRVSFLQRTDMREFERERDARLASQAKRRTDMREDDM

SEQ ID NO: 27004 - protein, 206 aa, Hyacinthus orientalis
MISNEDKKKNAASKPSGSRGGIRTLADLNRPAGPGSDSDSDGPQEYYTGGEKSGMLVQDPTKGGHDIDALFDQARQRGAMQGPFEHQPSSSSRSFTGTGRLLSGETVPSAPRSPENVVHNIYFWRNGFTVDDEPLRRFDDPANASFLESIRDSVCPKELEPKDRSSTVHVNLIRTAEEDCPEPAKLHTPFSGGRKNAWIFTTEAVA

SEQ ID NO: 27005 - protein, 161 aa, Hyacinthus orientalis
PGSRETKPAAEKKARAPKAPKEGKPKGSNSTAAPSHPPYFQMIKEAILALKEKTGSSPYAIAKYMEGKHGGVLPANFRKTLAVQLRNFATKGKLVKVKASFRLSDSGKTDKDRKKKISAAADKKKKKKPVVKRAKMAAAAKPKQPKSIKSRAAKRTKNAAA

SEQ ID NO: 27006 - protein, 405 aa, Trichoderma asperellum
MQTFGAFLVSFLAASGMAAALPAEGQQKTISVPVIYNANHAPHGPSALYKAKKKFGAPISESLKNNVAQHKAAKLARRQTGSAPNHPSDSEDDEYITNVSIGTPAQVLPLDFDTGSSDLWVFSSETPSSQAKGHTLYNPTKSSTSKKLSGYSWTISYGDGSSSSGDVYTDTVSVGGFSVTGQAVESATKVSSEFVSDTSNSGLLGLALDSINTVSPKQQKTWFSNASSKLAQPVFTADLNHQASGSYNFGYIDTSLASGPISYVPISTANGFWEFTSASYAIGSGSTKKHSTDGIADTGTTLLLLDDTIVDAHYGQVSSAQYDNSQEGYTFDCDENLPSFTFAVGSSKITVPGSLINFAPVSGNTCFGGLQSNDGIGINIFGDVAIKAALVVFDLGNKRLGWAQK

SEQ ID NO: 27007 - protein, 160 aa, Aspergillus niger
VAIKKMTPFDHSMFCLRTLREMKLLRYFNHENIISILDTQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAID

SEQ ID NO: 27008 - protein, 134 aa, Aspergillus niger
DTAGQEDYDRLRPLSYPQTDVFLVCFSVTSPASFENVREKWFPEVHHHCPGVPCLIVGTQTDLRDDPAVREKLARQKMQPIRKEDGDRMAKELGAVKYVECSALTQYKLKDVFDEAIVAALEPAPKKSKKCVLL

SEQ ID NO: 27009 - protein, 199 aa, Aspergillus niger
MATGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKAKWFPEIEHHAPNVPIILVGTKLDLRDDRGTIDALRQRKMEPVSYEQALAVAKEIRAHKYLECSALTQRNLKSVFDEAIRAVLNPRPAAKPKNKKCVIL

SEQ ID NO: 27010 - protein, 105 aa, Piromyces sp. E2
ERVALAYNLIVKGEGKQATDLVEAVQQSYDEDVTDEFIKPIHNADVEGNLEDGDAVIFFNFRNDRAKELTICFTQRDIPEQNLKTIPNLHYCTMTPYDPTFKGLH

SEQ ID NO: 27011 - protein, 155 aa, Picea glauca
MASADVEFRCFVGGLAWSTDDRSLQEAFSPYGEVVESKIISDRETGRSRGFGFVTFNDEQSMRDAIDAMNGKMLDGRSITVNPAQSRGNGGGGGGGGSRGYRGGGGGGGYGGSRDRGDRGYGGGGGGYGGGGGGYGGGGGSRYGGGGSEGGSWRR

SEQ ID NO: 27012 - protein, 475 aa, Enterococcus faecium
MKLKKNFLWGGSIAAHQCEGAWQEGGKGPAIMDYVRQGSYQVPRQIDTIISSEATYPSHMGIDLYHQYKSDIRLFSEMGFTALRISIDWSRIFPNGDDEQPNQEGIMYYIDVVDTLLSYDIEPIVTLYHFEMPKNLVQKYGSWTNRKVIELYLKFCQTMFESLKGKVHYWVTFNEMNHIDPQTEATDIFTYIIAGLKYSELENKSQTLAEIGYNMTVASCSAIVLGKKIDPENKIGCVFGIEPVYPVDCNPTNVMNAFKQMDRDFYQIDAMCTGKFPDYKINEYADQGIKLTITENDKYMFSKGTLDFIGMNYYASSVAKYEGAAEEKSALFGGLQNPYLVTSKWGWTIDPTGLRYLLNYTYRKYGLPIIITENGLGAIDVLTDDKNIHDEYRIEYLKQHIQQMKIAIEEDQVDCFGYLTWAPIDLVSATTGEMKKRYGFIYVDKDDEGNGTLERYKKDSFYWYKEVIGSNGDIL

SEQ ID NO: 27013 - protein, 197 aa, Chenopodium rubrum
PSWAFGGMIFALVYCTAGISGGHINPAVTFGLLLARKLSLTRAVFYMVMQCLGAICGAGVVKGFQPTPYDVLGGGANKVNHGYSKGDGLGAEIVGTFVLVYTVFSATDAKRSARDSHVPILAPLPIEFAVFLVHLATIPITGTGINPARSLGAAIIYNKERSWNDHWIFWVGPFIGAALAAVYHQIVIRAIPFKSKG

SEQ ID NO: 27014 - protein, 369 aa, Claviceps purpurea
MSTSNLFSTVPFGKNVLNHKIVLSPMTRFRADDNGVPLSYMKTFYAQRASVRGTLLVTDAVAICPRTKGFPNVPGIWHKDQIAAWKEVVDEVHSKGSFIWLQLWATGRAADLEALTSQGLKLESSSEVPVAPGEPTPRALDEDEIQQYILDYVQGAKNAVHGAGFDGVEIHGANGFLIDQFLQSSCNRRTDQWGGSIENRSRFGLEITRGVVDAVGHDRVGMKLSPWSTFQGMGTMDDLVPQFEHFITCLREMDIAYLHLANSRWVEEEDPSIRTHPDFHNQTFVQMWGKKRPILLAGGYDPDSARRLVDQTYSDRNNVLVVFGRHYISNPDLPFRLRMGIACRSTIETHSIFPARERAMWTIPSVKNI

SEQ ID NO: 27015 - protein, 448 aa, Geobacillus stearothermophilus
MKAKTKKYIQVKTAIPGPKAKELLRKKEENVPRGPFHTVPTFAVKGEGALLTDVDGNTFIDLAGAIGSLNVGHCPPKVVEAIQKQAEQYIHPCFHVMMYEPYVELAETLNRITPGNHSKKTFFLNSGAEAVENAVKIARKYTGRRAILSFERGFHGRTLLAMSLTSKVKPYKFGFGPFAPDTYKLPYPYYYRKPAGMTNEELDAELLRRLEDFFLSDVPAEEVAAIIMEPVQGEGGFIVPSKTFVQGVKRICEKYGILFIADEIQTGFGRTGKMFAIEHFDVIPDLITMSKSIGAGVPISAVTGRAEVMDAPNPGEIGGTYGGSPLGCVAALEVIRMLQQEQLVERANVIGQIAIDRFRRLQEKYETVGDVRGLGAMVAVEFVTDAKTKTPNKELTAAILRECHQRGVIVMGAGLYSNVIRLLTPLVITDEQLEEALDVIEEVIAELA

SEQ ID NO: 27016 - protein, 324 aa, Geobacillus stearothermophilus
MYKPKDSSQSPRFCGVRTFMRLEPIKTTNGIDFAVLGVPFDTAASNRTGQRYGPQHIRNFSVLLRPYNPDMDIDIFAYCSGVDYGDVDVIPGNALRTYDRIVEELRPLLKKNIVPILMGGDHSITLGHLRAFYERFGPVALVHFDSHSDTWDHYYGEKYMHGTPFRRAVEEGLLDVNHSIQVGMRGPLYSADDLEDARRLGFEVIPMREVRQIGFSEVMRRIHQRVGNKPVFVSYDIDFVDPAFAPGTGTPEVGGPTSYEALEYVRGLDGLNIVGFDLVEVLPAYDSGEMTAILASAIIYEMITLVALKKRRAQANRLSTATTP

SEQ ID NO: 27017 - protein, 482 aa, Geobacillus stearothermophilus
MIYVNGKWSKGEGKKRPVINPANEEIIIEINEASQQQAVEAIQAARHAFQYTDWPFNPAKRIAALRQLADLLEQNAETFASIETLNTGKPIRESRLDVSDSIQCLRYYADFVEQRAIEEIKRTDGTTSKIIEEPIGVCALIVPWNFPLLLGIWKLAPALAAGNTVVFKPSELTPLSFIELTKLIDSIGLPPGVFNLVPGGGSPVGETLVTHPDVEKISFTGGTKTGRWIYEQGARRLKRVSLELGGKSPLLIFDDADLASTIEWALFASFFNQGEVCVAASRILVQRRVYDSFLDQLTQRLASLRIGDPFAEHTEMGPLISSSHLEKVETYIQIGLQEGGVLLQGGKRMKELGYYLTPAVFAHVRQDMRIVQEEIFGPVITVQPFEHDEEAIKLANDTIYGLAAGLFSRDLERAEQIAGKLRAGTIWINSYHTPYVDAPWGGLKQSGIGRELGPQGFAAFTETKHVNISQHGKPLGWYSSHS

SEQ ID NO: 27018 - protein, 486 aa, Pseudomonas sp. ST41
MKEIKHFINGAFVYSADGRTFEDINPVNGQVIGRVHEAGRAEVDAAVKAARAALKGPWGKMTVAERAEILHRVADGITARFDEFLEAECLDTGKPKSLASHIDIPRGAANFKVFADLIKNVPTEAFEVATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKHREKVLNYYQQAVDDGATVVTGGGVPDMSAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 27019 - protein, 327 aa, Nocardia uniformis subsp. tsuyamanensis
MGALPRVPLITAPTRLHPVDGLAPRRVLVKRDDENSPVFGGCKTRALEFVLGAARAAGATAVLTSGTAGSNHVAATALHAGRLGFRVTALVLPQEPGALVARNLRLAAGAGARLEPVPDGVSVHPDRERHRAAVAELRERGERVHVIPFGGADPVAGVAHALAGLELAEQARGLPGPLRVHLPAASTLTAAGIAAGLALSGLPFQVTAVDVVGSSSTLGPGLLGRAREVAALLGGPADAVRPEHVRHVGYAGAPYGVPDPEAGRCADLLREAADVRVDECYGAKAFHHLLGEVGDADGTHLFWHTGSTREAGEVFGPVPPELLCYVE

SEQ ID NO: 27020 - protein, 149 aa, Pseudomonas syringae pv. maculicola
AETRDLLVSLAGEVGLKEAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27021 - protein, 149 aa, Pseudomonas syringae pv. maculicola
AETRDLLVALAGEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27022 - protein, 149 aa, Pseudomonas syringae
TETRDLLVSLAGEVGLKDAIKAQYDGELVNSSEGRPVLHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27023 - protein, 149 aa, Pseudomonas syringae pv. syringae
TETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMRIRAETTLFIVSS

SEQ ID NO: 27024 - protein, 149 aa, Pseudomonas syringae pv. syringae
TETRDLLVSLAGEVGLKDAINAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27025 - protein, 149 aa, Pseudomonas syringae pv. syringae
TETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27026 - protein, 149 aa, Pseudomonas syringae pv. tabaci
TETRDLLVSLAGEVNLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27027 - protein, 149 aa, Pseudomonas syringae pv. theae
AETRDLLVALASEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27028 - protein, 149 aa, Pseudomonas syringae pv. tomato
TETRDLLVSLAGEVGLKEAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27029 - protein, 149 aa, Pseudomonas syringae pv. tomato
AETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 27030 - protein, 486 aa, Listeria monocytogenes str. 4b H7858
MTEVKKQFPKGFLWGGATAANQVEGAYDVDGKGLSTADMVKFIPKEERTQDHALDVSKAEIEAIIAGKVEGRFPKRDGVDFYHHYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSYMNRFFQENDIHIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLIGYTSWGPIDLVSASTSEMSKRYGFIYVDQDDWGKGTLERSRKDSFFWYKKVIETNGEDLD

SEQ ID NO: 27031 - protein, 338 aa, Listeria monocytogenes str. 4b H7858
MIELHQVSKSFNVNGKTVEAVKNVSITVEKGEIFGVVGYSGAGKSTLVRCINLLERPDAGQVVIDGKNLSTLSSKELRVARRKIGMIFQGYNLLKTATVYDNIAKPLKLEGVPKDEIETRVNKYLSIVGLEDKRNNYPSQLSGGQKQRVAIARALAHEPEILLSDEATSALDPETTEAILQLLLKINAELGITIFLITHELDVIQRICDRVAVMENGHLVEQGTVLDIFTKAKHSTTKRFVGSEASFDIPQDLLEKYVATGKLVSLHFIGDEADEPALALVSRKFDVLPSILAGGIDHLKNGTLGKLLVHLKGDEVEYSKAISYLKESGVVVEEVELL

SEQ ID NO: 27032 - protein, 393 aa, Listeria monocytogenes str. 4b H7858
MKISKRLQNLPDQFFSSLVEKVGKKVAEGHDVINLGQGNPDQPTPKHIVEAMKTASEKPLNHKYSLFRGKHELKQAAADFYAREYNVTIDPNTEVAILFGTKTGLVELPMCLMDPGDTMLLPDPGYPDYLSGVVLGEVQFEKMPLIAANNFLPDFTKIPEDIAEKAELMYLNYPNNPTGAVATADFFEETVAFAKNHNIVVAHDFAYGGIGFDGKKPISFLEANGAKEVGIELYTLSKTYNMAGWRVGFAVGNSEVIEAINLIQDHMYVSLFPGIQDAAIEALTGDQTCVGELTARYESRRDAFISACKKIGWEAVAPAGSFFAWMPVPENFTSSEFADYLLEEVSVAVADGSGFGEFGEGYVRVGLLMDEERLEEAVTRVSKLHLFDKVTQQ

SEQ ID NO: 27033 - protein, 463 aa, Listeria monocytogenes str. 4b H7858
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGVDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVAKVDDAYRIAFMNDHINAIFNAIDAGCDVRGYYAWSPFDLYSWKNGVEKRYGLVAVDFKNNQIRKPKASYYWFKEMIESQGKLIKRREF

SEQ ID NO: 27034 - protein, 480 aa, Listeria monocytogenes str. 4b H7858
MKELLTFPKDFWWGSAWSAEQAEGRGDTGKAKTVWEHWFETEPNRFYEGVGSEITTDHFNRYKEDVQWMKKTGQNSFRISISWARMFPNDGVGEVNPKAIAFYRDLLTEMNENGIKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYDTSKLVGTKREETTNG

SEQ ID NO: 27035 - protein, 488 aa, Listeria monocytogenes str. 4b H7858
MADVRKLKNYIDGEWVESKTDKYEDVINPATGEVLCQVPISTRAELDQAAVIAEQAFEKWSQVAVPRRARVLFSFQQLLIQHKEELARLITLENGKNLSEARGEVQRGIENVEFAAGSPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLAALRTAAQNVKIGNGLDDGVFLGPVIREENQKRTIAYIEKGLEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 27036 - protein, 325 aa, Listeria monocytogenes str. 4b H7858
MNLNKHSERKFDLITVGRACIDLNAVEYNRPMEETMTFSKYVGGSPANIAIGTAKLGLKVGFIGKISADQHGRFIEKYMRDLNINTDGMVKDTEGRKVGLAFTEIKSPDECSILMYRENVADLYLTPEEISEDYIKEARVLLISGTALAQSPSREAVLKAVSLARKNDVAVAFELDYRPYTWTNTEETAVYYSLVAEQADVIIGTRDEFDMMENQVGGKNEATKAHLFQHQAEIVVIKHGVEGSFAYTKAGETFQAKAYKTKVLKTFGAGDSYASAFLYGLFSGESIETALKYGSAAASIVVSKHSSSDAMPTADEIKALIAQAE

SEQ ID NO: 27037 - protein, 463 aa, Listeria monocytogenes str. 4b H7858
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIISLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPFYPVLPIVSFLLCAFLISRLSVHTWILCGIWFVIGLIVYFAYGRKHSELLKK

SEQ ID NO: 27038 - protein, 347 aa, Listeria monocytogenes str. 4b H7858
MKNTIKWIAIGFAGIILLPLLIVFFIYKKAVGKKEYNPEVLENLDEASQKFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 27039 - protein, 496 aa, Listeria monocytogenes str. 4b H7858
MTNLFQDDSLTLHTDLYQLNMMKAYFDDGLHERRSVFEVFFRDMPFDSGFVVFAGLERIIHYMQNLRFTETDIAYLHDELGFEGPFLEYLRNFKFKGNILAAKEGEFVFKTEPILQVEASLAEAQLIETALLNIVNFQTLIATKAARIRSVIDDETFAEFGTRRAQEMDAAIWGTRAAYIGGCDSTSNVRAGKIFGIPVSGTMAHAMVQAYRDELEAFRSYAKTHFDSIFLVDTYDTLKSGVPNAIKVAKEMGDKINFIGIRLDSGDMAFLSKKARQMLDEAGFTEAKIFASSDLDEHTILSLKAQKAKIDSWGVGTKLITAYDQPALGAVYKMAAIADENDILQDSIKLSSNTEKVSTPGKKKVYRIITNEDGLKAEGDYIALADESLENVDKLTMFHPVHTYIMKTVENFTARELLVPIFQNGELVYDMPSLDEIKAYKEENLALLWDEYKRTVRPEQYPVDLSVKCWKNKMRNIEKVRKSVQLHSPVELDMPF

SEQ ID NO: 27040 - protein, 461 aa, Listeria monocytogenes str. 4b H7858
MSLFSLKRKNHFVPLEIQRQQWFKHFIVAFMSVFICYLTVYLLRNNFKAAQTLLIEQNHFSTTELGMIGLAFSVMYGIGKTILGYAVDGRNAKKIMSFLLGISAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGIQIFGYTLHGWGATFTIMFTALIIAGLMMIPVALKQEKIIRQAKVLHL

SEQ ID NO: 27041 - protein, 503 aa, Listeria monocytogenes str. 4b H7858
MFYEIYMKSFQDSNGDGLGDFKGLTSRLDYLVDLGIDGIWLTPFYPSPQVDNGYDVSDYCDINPDYGDMTDFRAFMKAADARGIKVIIDLVLNHSSTEHAWFKESRSSKTNPKRDYYIWREKPNNWESFFGGSAWEMDELTGEYYYHSFAKEQADLNWANEAVRAEMEQVLAFWLNEGVAGFRLDVINNLTLVLEFTDNPVTSGEMEHVYDRNQSGLEQALEDIASFCRKERDVFLVGEISSDQLAEIARYSSKKMLDVTFNFNFGSVDQLDAKSVFTTLNEMETALNEGQWPTLFFGSHDMSRFRSRLASGDIVKTQLLAFLMLTAKGVPFIYYGEEVGMPDLTFSSVKEMRDIQGTAAYYQALQTGSDEKQALEIAIEKTRDKARGPMIFPDGKPFTLGEPWIKMATLPEKEARTMWRFYQGLLAFRKENDFKEMEYTFLKLDGEVLSYQRGEFIFLLHFGEEEVTYPLQGNYQLVFGEAVMVGNGIRMGAHTGIALRVEE

SEQ ID NO: 27042 - protein, 449 aa, Listeria monocytogenes str. 4b H7858
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAVPQKVEKNPDGSLTLSLEDGRTETVDTLIWAIGRKPVIQGLQIEKAGVKLLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 27043 - protein, 491 aa, Listeria monocytogenes str. 4b H7858
MVFLSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVKQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIVISNPETPFGGVKHSGFGRENGHYGMEEYIQVKFINLKYRD

SEQ ID NO: 27044 - protein, 483 aa, Listeria monocytogenes str. 4b H7858
MFENYQFPKDFLWGGAIAANQAEGAFKVDGKGISLADLHKYHKGKTNDEISEEQHKGVSLADIKASMEDKVNYYPKRHGIDFYHTYPEDLALLAEMGFKTFRTSLDWTRIFPTGEETEPNEAGLKYYDQLIDKIIELGMEPIITILHYETPVEIVLNHGGWHNRKVIDLFEKYGKTVLDRYNKKVKYWIIINQINLIQFEPFNSTAIPYDAVDDYLSATYQAVHNQFVASAKIYEYGKALNPDLMIGTMLADCTAYPFSCDPDDIVLAMKRNRMEYFFADVQFQGEYPQYALNYFDENNIHIEITEDDKAILQKNTMDYLALSYYYSQMVDSKKNDLDPASITPNPHLKANPWGWAVDPKGLYNALSQYWDRYHKPIIIAENGFGMYDKLENGEIHDDYRIDYLSAHLKEMKRAMYDGVEIIAYCAWGPIDIVSCSSAQMEKRYGFIYVDLDNEGNGTGKRIKKDSFSWYKKVIESNGEDLEA

SEQ ID NO: 27045 - protein, 327 aa, Listeria monocytogenes str. 4b H7858
MKKRQLGNTGLVTSELGFGCMGLNYHWGPAKDRKEMIEVVRTAMDTGITMFDTAEVYGPYTNEELVGEALVGKRNHVQIATKGGFKINGLNNEVDSRPESIKAAVEGSLKRLKTDYIDLYYIHRIDPSIPIEEVAGTIQNLKQEGKILHWGLFEASAKTIRRAHKVEPLAAVENEYSIWWREAEKEIFPVLEELGIGLVAYSPLGRGYLTGKLDINANFNENDNRGGLPRFQKEAMEANQVLLDFMKEIADEQNVTTAQLAIAWILDQKPWIVPIPGTTKQSRIKENIASTDIRFDDGARQKIADALSQIEIVGDRYSAAENKRIGK

SEQ ID NO: 27046 - protein, 371 aa, Listeria monocytogenes str. 4b H7858
MEYKKALAFIKSNSILEQEEGTEVIFKQAQETVRGNLDPFLLKDLKQHLGGTNDAIKEAPQEIQMPDFSNLEIATAAALQMRATMGSPNIDLSNGVTTEYRVVEGDYGDIPVRIYRHEEATKPVPAFIFYHGGGFVGGTPAVVENFCKGIAEKLPAVVINVDYHLAPEFPAPAAPKDCYRALEWVVEQSDELGIDASKIGVSGDSAGGTLAAAVSYMDYEAETNYVGFQALLYPALTLVDEDNDKYQWDISKFGASEETLPLVAPGIIGMNSSGELLRTAYVRDENPASPIYSPLSAVDKSIYPPTLIASAEFDALRAFADIFAKELRASGVQTKVIVYQGMCHAFIDKYGIFPQAEDVADEIVQMMKEIF

SEQ ID NO: 27047 - protein, 482 aa, Listeria monocytogenes str. 4b H7858
MSNTKFPDGFMWGGATAANQFEGGYNLGGKGLACADLFTGGTHTEPRRITAQLEESTFYPSHEAVDFYHHYKEDIKLMAEAGFKVFRMSINWTRIFPTGKEAEPNEEGLQFYEDVFKELKKYQIEPLVTIAHFDIPLALTNEVNGWASRDLIDYYLHYCEVIFKRYKHLVKHWLTFNEINTATMEIGNYLSLGIRHAEGDFLHQKDDPTVRYQALHHQFVASAKAVKLGHSINPEFMIGCMIAYMPRYPRTCEPTDVLLAKQTEAMHSHFCGDVHVKGYYPFYAKTFFKDNGIELEFDPEDEQVLREGTVDFYTFSYYLTLCASNDPAYKNSGKSVIGGAENPYLKTNDWGMQTDPVGLRIALNDLYTRYNIPLMVVENGLGAFDKLEDDGTINDPYRIDYFKEHILQMHKAIQDGVDLIGFTIWGCIDLVSASTGEMAKRYGIIYVDKYDDGTGDYSRKKKASYYWYKDVISSNGEIGLRE

SEQ ID NO: 27048 - protein, 446 aa, Listeria monocytogenes str. 4b H7858
MAKFTYDVVIIGSGASGTTVAFEAQAAGLKVAIVEERSWGGTCVLRGCDPKKVLVGAREARNLSTRLRGKGIKQAATISWTDLMAFKETFVENVPESRLENFQEAGIETFFGAASFQDSHSLQVGDDLIQANKIVIATGATPSTLKVEGQEYIQTSDDFLSLEKLPDSVVFIGGGYISFEFASIALATGREVHIIHHNSEPLKKFDPDFVAALVSNMKEEGIHFHFDTDITKVENKGEKLHIHGKDGFSLQTDLIIGATGRKPNIAHLSLENANIDYTKKGIIVNEKLQTTNNPHIYACGDVAATKGAPLTPVVSMEAAFVAKNVIGGDEKMIYPAIPSVVFTSPKLASIGISAEEAKAHPEKYQIKNHDTTNWYTYKRTNEQIALAKIIEDRESGQIKGAHFLSEEADYMINYVAILMKANLTLADLQSVIFAYPSPASDLTALN

SEQ ID NO: 27049 - protein, 489 aa, Listeria monocytogenes str. 4b H7858
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAVGIHFAVPYLSQSTRDNLDNGGVQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTERHTIDAAKGFYRTSEEGVFACGDARHGQSLVVTAIAEGREAAREVDFYLMGETFLP

SEQ ID NO: 27050 - protein, 477 aa, Listeria monocytogenes str. 4b H7858
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGYYPSYTKRFFKEHNINIKMEDGDLDVLRDHTVDYVAFSYYSSRLTSADPEKNKETEGNVFATLKNPYLKASEWGWQIDPLGLRITMNTIYDRYQKPLFIVENGLGAVDTVAEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 27051 - protein, 218 aa, Listeria monocytogenes str. 4b H7858
MGKIAPSILSADFANLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKKIVDEKGLDIEIEVDGGVDHETAKLCRDAGANVFVAGSYIYGNKNRQTPIDKLRAIVGE

SEQ ID NO: 27052 - protein, 222 aa, Listeria monocytogenes str. 4b H7858
MKMIAASIMCSDSLHLADELRALEQANVKMLHCDVMDGVFVENAAMGAYVLQDIKNNTDMLLDIHLATVNPDKFVDLYAAIKPAYMSFHVEASPDVDATIKHIRALGIKPSIAISPDTEIEQIYPFLDKVDMVLMMTVNPGFAGQKFQHHVLEKIKKLQRELESHTNKPLIEVDGNIFEETVRLLEPIGADVYVVGTAALFNDKAGSYTEKLAPLREIIQER

SEQ ID NO: 27053 - protein, 342 aa, Listeria monocytogenes str. 4b H7858
MKNNVLVTGGTGFLGMHIIFQLLQQGYQVKTTVRSLKSKEKVIEVLQNNGITDFTQLSFVELDLSKDEGWKEAMLDCKYVLSVASPVFFGKFKNEEELIRPAIEGITRILQAAKEAKVKRVVMTSNFGAIGFSNADKNSITTEAYWTDELAKGLSAYEKSKLIAEKEAWKFMENETELEFATINPVAIFGPSQSSHVSGSFDLLKNLLNGSMKRIINIPLNVVDARDVADLHIRAMITPEANGERFIASADGEISMADIAHLLQRERPELVSKMPKKTLPNAAIRAAAIFSKHAKEGELMINMNRQISNSKARDLLGWQPISTKEEAVLAAVDSLAKYGLLD

SEQ ID NO: 27054 - protein, 332 aa, Listeria monocytogenes str. 4b H7858
MKAVGLTRASTDFVDIEIDKPVPENHDLLVRIKAISINPVDTKQREATKLSGDEVRILGWDAVGEVVDTGSEVALFQTGQDVYFAGDVTRQGAYAEYTLIDERLVGLKPHNLNVEEAAAMPLTTITAWEALFDRLTITENDKGKSILIINGAGGVGSIATQLAAHAGLEVIATASRPETVEWTKSHGANYVINHRENIPEQLEELGFEQGVDFILCLHNTSAHWDEMQEAIRPQGKICSIVELAEPVKMTLLKDKSATFSYEFMFTRSKYDTTDKIRQHEILTEAAHMLDAGELTTTLNQVLSPVNAATIEEAHKIISSGKMIGKLVVKGFE

SEQ ID NO: 27055 - protein, 432 aa, Listeria monocytogenes str. 4b H7858
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLASFKEALAVWSDQVAAVLVEPIVGNFGMVAPEDGFLEAVNELAHANGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAALKHGIAVTVNQIVGALTVYFTEDPVTNYAEAGATNGELFGRFFKGMLEEGINLAPSKYEAWFITSAHSEADILETIQAVDTVFGKMVQDN

SEQ ID NO: 27056 - protein, 413 aa, Listeria monocytogenes str. 4b H7858
MLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 27057 - protein, 366 aa, Listeria monocytogenes str. 4b H7858
MIVTETIIRFENVTKQFDNDPPVLDNVSFEIEKGKFYTLLGPSGCGKTTILRLIAGFLEASEGQIYLGDKVINQIPANKRPVNTVFQDYALFPHLNVYENVAFGLRIKKLKKDAIDEKVKEALRFVNLKGYEKREISEMSGGQRQRVAIARAIVNEPEVILLDEPLSALDLKLRTEMQYELRDLQKRLGITFIFVTHDQEEALAMSDEIFVLNKGEIQQSGTPIDIYDEPINKFVADFIGESNIVNGKMIQDFEVEFVERRFECVDQGFRPNEVVEVVIRPEDLEITSAEKGQLQVTVDWMLFRGVHYEVGCIDTDGNEWLVHTTRKVRVGDKIGLAFEPEAIHVMRLGETEEEFDKRLDSYDEVQ

SEQ ID NO: 27058 - protein, 210 aa, Listeria monocytogenes str. 4b H7858
MGLPGAGKGTQAEQIVEKYNIPHISTGDMFRAAMKNNTELGKKAKSFMDNGDLVPDEVTNGIVRERLAEDDAKNGFLLDGFPRTVEQAEELENILNDLGTELDAVINIEVDKDVLMKRLTGRWICRTCGKTYHEIYNPPKVPGKCDLDGGELYQRDDDKKETVEKRLNVNMKQTKPLLDFYSEKGKLHNINGEQDIKDVFVDVEKILASF

SEQ ID NO: 27059 - protein, 396 aa, Listeria monocytogenes str. 4b H7858
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 27060 - protein, 456 aa, Listeria monocytogenes str. 4b H7858
MQKTVTYGAKWKQFLTIFTPIVITQLTLFSMTFFDTTMSGNYSNQALAGVAIGSSFWAPVNAAFSGLLMAITPIIAQLIGAKKEKQVKNTVHNGLYIALFLAFILILINFLVVPTILTHMPVTAEVAGIARHFLNGICIGIPAFFISAILRSFIDSLGLTRVTMLITLCTVPFNIFLNYCFIFGNFGFPEMGGAGSGYATGITYWLVVLVSVILIQTQTRLRKFGIFKGLTALRFSKIKEIIGIGVPNGLTILFETSIFSAVTILMGAFGTETIAAHQSANSVCTLLYAFPLSVASTLTILGGYETGAKRLKDAKQYRHIGMAAAIFIGCVNGAILFFFRDIIAGFYTNDPALSNLIMHFLVYAILFQFADAVLSPVLGALRGYKDVTVTSIVAFISYWLIGLPVGYGLSFTNLGPFGYWIGLSTGLFVAAFILSIRVRKTEQKLSFNTKDAEISS

SEQ ID NO: 27061 - protein, 328 aa, Listeria monocytogenes str. 4b H7858
MRLIYVSCLYSFFIFTTLKIVNNHNRKRKWGGLSLLGDLFTKPKKRKYATIPSDGTKADVPEGIMTKCPECKKIMYTKELQKNLMVCNYCGFHHPIGAKARIDMLVDEGSFEEIDASLTTANPLGFEDYMDRIEKDKQKSGLNEAIVTGHATIDGNPLVIAVMDSRFRMASMGSVVGEKIFRAVEDADKTNKPFVIFTASGGARMQEGMLSLMQMAKTSAAFKRFSNHGGLIITVMTHPTTGGVSASFASLGDYNFAEPGALIGFAGRRVIEQTVREELPEDFQTSEFLLKHGQLDDCISRLDLQNKLSFILSIHVKTPEVGGEADGE

SEQ ID NO: 27062 - protein, 272 aa, Listeria monocytogenes str. 4b H7858
MMDTSLATQFLGEVIGTAILIILGAGVVAGVSLKRSKAENGGWVVITLAWGLGVTMGVYVSGYMSMAHLNPAVTIGMALAGAFPWNYVLPYILAQFIGAFIGATLIWLHYYPHWKQTEDKPTKLGVFATAPAIRHFTSNFFGEALGTFILVFGLLSLGANSFSDGLNPLVVGALIVAIGMSLGGTTGYAINPARDLGPRIAHFVWPISGKGGSDWGYSWVPVIGPIMGGALGALGYNAIINGELGMWFWVFAVLFVLILILTMQLDKKKDLA

SEQ ID NO: 27063 - protein, 482 aa, Listeria monocytogenes str. 4b H7858
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCK

SEQ ID NO: 27064 - protein, 450 aa, Listeria monocytogenes str. 4b H7858
MTHIKFDYSKALRFFEERELDYLEPAVKAAHDSLHNGTGAGNDALGWINLPTDYDKEEFARIKKATEKIHSDSDVLIVIGIGGSYLGARAAIETLNHSFYNVLEKGARKTPQVFFAGNSISSSYLHDLIEVVGDRDFSVNVISKSGTTTEPAIAFRVFKELLIKKYGEEGAKKRIYATTDKAKGALKTLADNEGYETFVVPDDVGGRFSVLTAVGLLPIAVSGVDIDALMNGAAAASKDFDKPELKNNIAYQYAAARNVLYRKGKVTELLISYEPGLQYFNEWWKQLFGESEGKDKKGIYPSSANFSTDLHSIGQYIQDGRRNLFETVIKVDKPRHNLTINKEDVDLDGLNYLAGETVDFVNTKAFEGTLLAHTDGEVPNFVVEVPELDAYTFGYLVYFFEKAVAISGYLNGVNPFDQPGVEAYKANMFALLGKPGFEDKKAELEKRLND

SEQ ID NO: 27065 - protein, 459 aa, Listeria monocytogenes str. 4b H7858
MGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKDERVYASTVLSGPSNYRFEGDKKAFVESVRRALYFSKIASYAQGFAQMRAASEENDWDLQYGEIAKIFRAGCIIRARFLQKITDAYNKDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 27066 - protein, 222 aa, Listeria monocytogenes str. 1/2a F6854
MKMIAASIMCADSLHLADELRALEQANVKMLHCDVMDGVFVENAAMGAYVLQDIKNNTKMLLDIHLATVNPDKFVDLYAAIKPAYMSFHVEASRDVNATINHIRELGIRPSIAISPDTEIEQIYPFLDKVDMVLMMTVNPGFAGQKFQHHVLEKIKKLQKELESHTNKPLIEVDGNIFEETVRLLEPIGADVYVVGTAALFNEKAGSYTEKLAPLREIIQER

SEQ ID NO: 27067 - protein, 348 aa, Listeria monocytogenes str. 1/2a F6854
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 27068 - protein, 366 aa, Listeria monocytogenes str. 1/2a F6854
MIVTETIIRFENVTKQFDNDPPVLDNVSFEIEKGKFYTLLGPSGCGKTTILRLIAGFLEASEGQIYLGDKVINQIPANKRPVNTVFQDYALFPHLNVYENVAFGLRIKKLKKEAIDEKVKEALRFVNLKGYEKREISEMSGGQRQRVAIARAIVNEPEVILLDEPLSALDLKLRTEMQYELRDLQKRLGITFIFVTHDQEEALAMSDEIFVLNKGEIQQSGTPIDIYDEPINKFVADFIGESNIVNGKMIQDFEVEFVERRFECVDQGFRPNEVVEVVIRPEDLEITSAEKGQLQVTVDWMLFRGVHYEVGCIDTDGNEWLVHTTRKVRVGDKIGLAFEPEAIHVMRLGETEEEFDKRLDSYDEVQ

SEQ ID NO: 27069 - protein, 461 aa, Listeria monocytogenes str. 1/2a F6854
MSLFSLKRKNHFVPLEIQRQQWFKHFIVAFMSVFICYLTVYLLRNNFKAAQTLLIEQNHFSTTELGMIGLAFSVMYGIGKTILGYAVDGRNAKKIMSFLLGVSAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGDSETKDLSRFQIFCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 27070 - protein, 242 aa, Listeria monocytogenes str. 1/2a F6854
MTKLKVTGLKKSFGANEVLKGIDIEVKEGEVVCVIGPSGSGKSTFLRCMNNLEEITAGEVVVDDFNITDKKVDINKVRENIGMVFQHFNLFPHLSVLENITLAPVELKKMDKEAAKSNALRLLEQVGLREKADEFPNQLSGGQKQRVAIARALAMDPDIMLFDEPTSALDPEMVGEVLGVMKELAKGGMTMMIVTHEMGFAREVGDRVIFMDGGYIVEEGKPADIFDNPTNERTISFLDKVL

SEQ ID NO: 27071 - protein, 510 aa, Listeria monocytogenes str. 1/2a F6854
MEFWRRSVFYEIYMKSFQDSNGDGLGDFKGLTSRLDYLVDLGIDGIWLTPFYPSPQVDNGYDVSDYCDINPDYGDMTDFRAFMKAADSRGIKVIIDLVLNHSSTEHAWFKESRSSKTNSKRDYYIWREKPNNWESFFGGSAWEMDELTGEYYYHSFAKEQADLNWANEAVRAEIEEVLAFWLNEGVAGFRLDVINNLTLALEFPDNPVASGEMEHVYDRNQNGLEQALEDIASFCRKERDVFLVGEISSDKLPEITRYSSKKMLDVTFNFNFGSVDQLDAESVFTTLNEMETALNEGQWPTLFFGSHDMSRFRSRLASGDLVKTQLLAFLMLTAKGVPFIYYGEEVGMPDLTFSSVKEMRDIQGTAAYYRALQTGTDKKQALEIAIEKTRDKARGPMIFPDGKPFTLGEPWIKMATLPEEEARMMWDFYRALLAFRKENDFKEMEYTFLKLDGEVLSYQRGEFIFLLHFGEEEVTYLLQGNYQLVFGEAMMVENGIRMGAHTGIALRVEE

SEQ ID NO: 27072 - protein, 449 aa, Listeria monocytogenes str. 1/2a F6854
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRINGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAIPQKVEKNPDGSLTLSLEDGRTETVDTLIWAIGRKPVIKDLQIENAGVELLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 27073 - protein, 491 aa, Listeria monocytogenes str. 1/2a F6854
MVFLSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDNVNVGPLIREDAIDKIDKQLKNATDKGAKVLTGGGRLTGSDYDNGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 27074 - protein, 483 aa, Listeria monocytogenes str. 1/2a F6854
MFENYQFPKDFLWGGAIAANQAEGAFKVDGKGISLADLHKYHKGKTNDEISEEQHKGVSLADIKASMEDKVNYYPKRHGIDFYHTYPEDLALLAEMGFKTFRTSLDWTRIFPTGEETEPNEAGLKYYDQLIDKIIELGMEPIITILHYETPVEIVLNHGGWHNRKVIDLFEKYGKTVLDRYNKKVKYWIVINQINLIQFEPFNSTAIPYDAVDDYLSATYQAVHNQFVASAKIYEYGKALNPDLMIGTMLADCTAYPFSCDPDDIVLAMKRNRMEYFFADVQFQGEYPQYALNYFEENNIHIEITEEDKAILQKNTMDYLALSYYYSQMVDSKRNDLDPASITPNPHLKANPWGWAVDPKGLYNALSQYWDRYHKPIIIAENGFGMYDKLENGEIHDDYRIDYLSAHLKEMKRAMYDGVEIIAYCAWGPIDIVSCSSAQMEKRYGFIYVDLDNEGNGTGKRIKKDSFSWYKKVIESNGEDLEA

SEQ ID NO: 27075 - protein, 477 aa, Listeria monocytogenes str. 1/2a F6854
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGHYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 27076 - protein, 327 aa, Listeria monocytogenes str. 1/2a F6854
MKKRQLGNAGLVTSELGFGCMGLNYHRGPAKDRNEMIEVVRTAMDAGITMFDTAEVYGPYTNEELVGEALVGKRNHVQIATKGGFKINGLNNEVDSRPESIKAAVEGSLKRLKTDYIDLYYIHRIDPSIPIEEVAGTIQNLKQEGKILHWGLSEASAKTIRRAHKVEPLAAVESEYSIWWREAEKEVFPVLEELGIGLVAYSPLGRGYLTGKLDINADFNANDNRGGLPRFQKEAMEANQVLLDFMKEIADEQNVTTAQLALAWILDQKPWIVPIPGTTRPSRIEENIASTEFHFDDGARQKIADALSQIEIVGDRYSAAENKRIGK

SEQ ID NO: 27077 - protein, 371 aa, Listeria monocytogenes str. 1/2a F6854
MDYEKALAFIKSNSTLEQEEGTEVIFKQAQETARGNLDPFLLKDLKQHLGGTNDAIKEAPQEIQMPDFSNLEIATAAALQMRATMGSPNIDLSNGVTTEYRVVEGDYGDIPVRIYRHEEATKPVPAFIFYHGGGFVGGTPAVVENFCKGIAEKLPAVVINVDYHLAPEFPAPAAPKDCYRVLEWVVEQSNELGIDASKIGVSGDSAGGTLAAAVSYMDYEAETNYVGFQALLYPALTLVDEDNEKYQWDISKFGASEDTLPLVAPGIIGMNSSGELLRTAYVRDENPAAPIYSPLSAVDKSIYPPTLIVSAEFDALRAFADVFAKELRASGVQTKAIVYQGMCHAFIDKYGIFPQAEDVADEIVQMMKEIF

SEQ ID NO: 27078 - protein, 502 aa, Listeria monocytogenes str. 1/2a F6854
MAFYFEEPSRTFSEFLLVPGYSSAECVPTNVSLKTPIVKFKKGEESAITMNIPLVSAIMQAVSDDNMGIALATEGGVSFIFGSQSIESEAAMVSRVKNHKAGFVISDSNISPDKTLQDILDLKEKTGHSTVAVTEDGTAHGKLLGIVTSRDYRVTRMSPDEKVADFMTPFEKLVTANKSTTLKEANNIIWDNKLNALPLVDDNKNLVHMVFRKDYDSNKENKLELLDSSKRYVVGAGINTRDYEERVPALVEAGADILCIDSSEGYSEWQKRTLDYVRGKYGDTVKVGAGNVVDRDGFRYLAEAGADFVKVGVGGGSICITREQKGIGRGQATALIDVAKARDEYFEETGVYIPICSDGGIVYDYHMTLALAMGADFIMLGRYFSRFDESPTNKVNLNGTYMKEYWGEGANRARNWQRYDLGGDKKLSFEEGVDSYVPYAGSLKDNVAISLSKVRSTMCNCGALNIPELQQKAKITLVSSTSIVEGGAHDVVVKDASNNLIK

SEQ ID NO: 27079 - protein, 457 aa, Listeria monocytogenes str. 1/2a F6854
MFNLQKGFPENFKWGSSTNAQQFEGGYKEGGKGLSIADVRVIPDMPDESDFESFKTASDHYHHYKEDIAYYGEMGFQIYRFTMAWSRIFPNGDETEPNDAGVEFYSNMLAELEKYNIEPVVTLYAYDMPLQLLEKYNGWLDRAIIKDYLHYVETVVKLFKGRVKYWVPFNEQNFISIDSEYMSGYRAKNKAEVFQIQHHFNLCYAEATKLVHQIDPDAKVGGNIGNICPYPMTCKPEDVEASDKVAQQLGYAYGDIYFRGYYPKYFLKEYEGVDFDQIILDDDLTIIKSSEPDFMSLTYYMSSAIEAKGEEEVVVMNGIKAPNPYCETTEWGWTIDPYGFKHYLQEFYHRYQLPILILENGMGARDEKNTDDTIDDTYRIDYLASHIARMQEAVEEGCEIIGYLTWSATDLYSTREGFEKRYGFVYVDKDNSYKRLKKKSFYWYKKVIETNGNDLNY

SEQ ID NO: 27080 - protein, 446 aa, Listeria monocytogenes str. 1/2a F6854
MAKFTYDVVIIGSGASGTTVAFEAQAAGLKVAIVEERNWGGTCVLRGCDPKKVLIGAREARNLSTRLRGKGIKQAATISWTDLMAFKETFVENVPESRLASFQEAGIETFLGAASFQDSHSLQVGDDLIYAEKIVIATGATPSTLKVEGKEYIQTSDDFLSLEKLPDSVVFIGGGYISFEFASIALAAGRDVHIIHHNSEPLKKFDPDFVAALVANIKDEGIHFHFDTDITKIENDGGKLHIKGKDSFSLQTDLIIGATGRMPNIAHLSLENASIDYTKKGIVVNEKLQTSNNSHIYACGDVAATKGAPLTPVVSLEAALVAKNVIGGNEKITYPAIPSVVFTSPKLASIGISTEEAKANPEKYQIKNHDTTSWYTYKRTNEQIALAKIIEDRESGQIKGAHFLSEEADYMINYIAILMKANLTLADLQSVIFAYPSPASDLTALN

SEQ ID NO: 27081 - protein, 342 aa, Listeria monocytogenes str. 1/2a F6854
MKNNVLVTGGTGFLGMHIIFQLLQQGYQVKTTVRSLKSKEKVIEILQNNGITDFTHLSFVELDLSKDEGWKEAMLDCEYVLSVASPVFFGKFKNEEELISPAIEGITRILQAAKEAKVKRVVMTSNFGAIGFSNADKNSITTEAYWTDELAKGLSAYEKSKLIAEKEAWKFMENETELEFATINPVAIFGPSQSNHVSGSFDLLKNLLNGSMKRVINIPLNVVDARDVADLHIRAMITPEANGERFIASVDGEISMADIAHLLQRERPELVDKMPKKTLPNAAIRAAALFSKHAKEGELMINMNRQISNSKARDVLGWKPISTKEEAVLAAVDSLAKYGLLD

SEQ ID NO: 27082 - protein, 343 aa, Listeria monocytogenes str. 1/2a F6854
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 27083 - protein, 484 aa, Listeria monocytogenes str. 1/2a F6854
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSNDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 27084 - protein, 489 aa, Listeria monocytogenes str. 1/2a F6854
MGKATGFMEYDRIPSPGRDPKSRTRDWNEYSLPMPVADLTIQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAAGIHFAVPYLSQSTRDNLDNGGVQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 27085 - protein, 215 aa, Listeria monocytogenes str. 1/2a F6854
MLEIKNLSKKFDQKTILDNVNISLQDGEILSIVGPSGGGKTTLLRCISGLEKMDAGEIFIDGEKIDPMSRKDVENTIGVVFQEFHLFPHLSVLDNLILAPTLARKTKKAEAVKEAERLLGLLDLADKANSMPYQLSGGQKQRVAIARALAMNPKVLLFDEPTSALDPDLRDHVAALILSLKKVGITQIIVTHDHAFAEKVADQMMEVEPLKKEAI

SEQ ID NO: 27086 - protein, 475 aa, Listeria monocytogenes str. 1/2a F6854
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHILSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANHIAGKAAEKLDYDLVPRCIYTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 27087 - protein, 338 aa, Listeria monocytogenes str. 1/2a F6854
MSKLFSEYKLKDVTLKNRIVMSPMCMYSVENKDGIATDFHFAHYVSRAAGGTGLVILEATAVQEVGRISEFDLGLWNDEQVPALKSLVDGLHYHGAKAGIQLAHAGRKAVLPGEIVAPSAIPFDEKSAKPVELTKEAIKEVVADFKRAAYRAKEAGFDVIEIHAAHGYLIHQFLSPITNRREDNYGGPAGNRYKILSDIIKAVKEVWDGPIIVRVSATDYAHGGLQLEDHIPFAKWMKADGVELIDVSTGGLVNVAPPVFPGYQVPFADEIRRGAGIATGALGLITRGEQAEEILCNERADLIIVGRELLRNPYFAKDAAKQLGETIEGPKQYSRAWK

SEQ ID NO: 27088 - protein, 305 aa, Listeria monocytogenes str. 1/2a F6854
MKRITIGNSALTASEISLGCMRMADLSKEDANKVINTALENGIDFFDHADIYGGGKSEEVFADAIDMNATIREKMILQSKCGIRQGFFDFSKEHIIASVEGSLKRLKTDYLDTLLLHRPDTLFEPEEVAAAFTELEKSGKVRHFGVSNQNPGQIELLKKYVDQELIANQLQFSIMHTGMIDTGFNVNMTIDPSLDRDGGILEYSRLNNMTIQAWSPFQYGFFEGVFLDNDKFPELNKTIDKIAADKGVTNSAIAVAWIQRHPASFQTVVGTMNPGRIADIAKASDVTLSREEWYEIYRAAGNQLP

SEQ ID NO: 27089 - protein, 159 aa, Listeria monocytogenes str. 1/2a F6854
MNVHDFSEKAMNGKEIALSDYKGKVLLIVNTASKCGLTPQLEGLEAMYKKLGGDNFEILGFPCNQFLRQDPGSDEEILEFCQMNYGVTFQMFSKIKVKGKDASPLYKYLTEQTGGKKVEWNFAKFLIDENGEVVERFPSKMKPEDFEDKVEALVAKVNN

SEQ ID NO: 27090 - protein, 286 aa, Listeria monocytogenes str. 1/2a F6854
MEKIGFVGIGVMGSSMAGHLLEAGYEVLVYTRTKTKAEDLLDKGALWVETPGELANKVDILISMVGYPKDVEELYLGENSFLENLAVGTVAIDMTTSSPALAKKMAEFGHEKGIGVLDAPVSGGDIGAKNGTLSIMVGGSEDVFLKVKPIFDILGSSVILQGDAGAGQHTKMVNQIAIASNMIGVTEAIIYAEAAGLNPSRVLDSISGGAAGSWSLANLIPRVLKDDFSPGFFIKHFIKDMGIAISEAKQMGLELPGLTLAEKMYQTLAEQGLSEEGTQALIKYYR

SEQ ID NO: 27091 - protein, 478 aa, Listeria monocytogenes str. 1/2a F6854
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 27092 - protein, 393 aa, Listeria monocytogenes str. 1/2a F6854
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQTCVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 27093 - protein, 463 aa, Listeria monocytogenes str. 1/2a F6854
MSNNFLWGGATASYQCEGAWNVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTQKTMIAAYNVMYASALGVKAFKEGGYPGQIGIVHSYTPVNGVDESIETKIAMRYADNYCNNWILDTAALGEFPVDLVAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIESQGKLIKRREF

SEQ ID NO: 27094 - protein, 471 aa, Listeria monocytogenes str. 1/2a F6854
MHTNTGFPADFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSHPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEQDENGNYTVNDDYRINYLSAHLSQVKEAIKDGVDLMGYTSWGCIDLVSASTAEMKKRYGFIYVDRNNDGTGTLNRYKKKSFDWYKNVIATNGEDL

SEQ ID NO: 27095 - protein, 486 aa, Listeria monocytogenes str. 1/2a F6854
MTEVKKQFPKGFLWGGATAANQVEGAYDVDGKGLSTADMVKFIPKEERTKDLELDVSKTEIEAIIAGKVEGRFPKRDGVDFYHHYKEDIALFAEMGFKTFRLSLNWARIFPNGDDKEPNEKGLEFYDKVFDELLKYDIEPLVTLSHYETPLNLTLKYNGWADRRVIGFFTNYAETVFKRYKNKVKYWLTFNEINVISLSAYTGGGVLLEDAKNPLELSYQAGHHQFVASALATKLAHEIIPGSQVGCMLARMATYPATNNPDDILKAQYENQQNLFFTDVHARGEYPSYMNRFFQENDIHIVKEVGDDEILKAHTVDFISFSYYMSLSATASPEGDRSAGNLMGGVKNEYLESSDWGWQIDPKGLRWTLNDLYSRYELPLFIVENGLGAYDTVEEDGKIHDDYRIDYLRKHIEQMKEAIADGVDLIGYTSWGPIDLVSASTSEMSKRYGFIYVDQDDWGKGTLERSRKDSFFWYKKVIETNGEDLD

SEQ ID NO: 27096 - protein, 218 aa, Listeria monocytogenes str. 1/2a F6854
MGKIAPSILSADFANLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKEIVDKKGLDIEIEVDGGVDHETAKLCRDAGANVFVAGSYIYGNKNRQTPIDKLRAIVGE

SEQ ID NO: 27097 - protein, 488 aa, Listeria monocytogenes str. 1/2a F6854
MADVRKLKNYINGEWVESKTDKYEDVINPATGEVLCQVPISTRAELDQAAVIAEQAFEKWSQVAVPRRARVLFGFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLEALRTAAQNVKIGNGLDDGVFLGPVIREENQKRTIAYIEKGIEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 27098 - protein, 325 aa, Listeria monocytogenes str. 1/2a F6854
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAKSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 27099 - protein, 331 aa, Listeria monocytogenes str. 1/2a F6854
MKYVKFGNTGMDVSKICLGTMGFGDKDKWIHKWVLDEANSRPIIKKALDLGINFFDTANIYSYGESEKIVGRALKDYANRDDIVLATKVQQTMRPDRPNSGGLSRKTILSEIDHSLKRLETDYVDLYIIHRFDENTPIEETMEALHDVVKSGKARYIGASAMYAWQFQKAQRVAERNGWTKFVSMQNHYNMIYREEEREMIPFCRDEKIAITPYSPLASGRLTRDLNEKTNRSETDPVQKSKYDDMMNADRGIIERVAELAETHQVSRDKIALAWLLNKDEITSPIIGAQKESHLESAVEALNIKLTTSEVNYLEELYIPHPVVGALPTTK

SEQ ID NO: 27100 - protein, 254 aa, Listeria monocytogenes str. 1/2a F6854
MRKPLVGINMKNYINTRAQTSEWLEATIPLLGNFSDVDTFIFPSMGTLETTANLLSGTSFGFGPQNMAPEKSGPLTGEFSVESIIDLSANYVEIGHAERKNLFHEKTSEIAKKIKLALDEKITPVVCVGEGIRANDTNELKNALKKQIEALFDTIQVTQFKNVVLAYEPEWAIGKANSADTNYIESAHQALREIIRELGGDETLVRIIYGGSVSKENAAEIVRQKNVDGLFVGRFGHKPQNFADIVSIVSKTKG

SEQ ID NO: 27101 - protein, 480 aa, Listeria monocytogenes str. 1/2a F6854
MKELLTFPKDFWWGSAWSAEQAEGRGDTGKAKTVWEHWFETEPNRFYEGVGSEITTDHFNRYKEDVQWMKKTGQNSFRISISWARMFPNDGVGEVNQKAIAFYRDLLTEMNENGVKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGSFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 27102 - protein, 429 aa, Listeria monocytogenes str. 1/2a F6854
MQNYSKSEKAFKEAKKVLPGGVNSPVRAFNSVDASPVFMDHGKGAYITDVDGNEYIDYVLSWGPLILGHADPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAKLAFEKYGEEIAAVIVEPVAGNMGVVPPIEGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTENEIDKTLEAFDTTCKILRG

SEQ ID NO: 27103 - protein, 352 aa, Listeria monocytogenes str. 1/2a F6854
MQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEILPAFEKSAAVVVEEGGLTSHAAVVGINLGIPVIVGAKDATSLVKDGEIITVDSRQGVVYNGKTATH

SEQ ID NO: 27104 - protein, 467 aa, Listeria monocytogenes str. 1/2a F6854
MTNWLQKRVRLSPKETALVFEGKEETFEEISEAVERLAGKLFALGIRKDERIALLGKNDRMTFLLIHALQQLGAVTLFLNNRLTKKEIAYQLANAEVKQVIVADTFEDKVGAGISYSELAETDYKEPELLETWDLSRTASIMYTSGTTGKPKGVIQTYENHWWSAVASVLNLGLTEKDSWLCAVPIFHISGLSIMMRSVIYGIPVYLEEHFDEEKITQLLESGKVSTISVVTSMLERLLKIHGGSYHPNVRTILLGGGPASKTVLEICKQRDIPLVQSFGMTETASQIVTLPPKDALNKIGSSGKALFPAEVKIADDGEILLKGPSITPGYLHNKKATEASFVDGWFKTGDIGYLDEEGFLFVLERRSDLIISGGENIYPTEVEHVISEYEGVKEVAVVGKTDDKWGSVPVAFIVAEETFDEDELQLICQTNLASYKIPKQIIIVEKLPKTASGKIQRNKLKERHSK

SEQ ID NO: 27105 - protein, 294 aa, Listeria monocytogenes str. 1/2a F6854
MLGDLFTKPKKRKYATIPSDGTKADVPEGIMTKCPECKKIMYTKELQKNLMVCNYCGFHHPIGAKARIDMLVDEGSFEEIDANLTTANPLGFEDYMDRIEKDKQKSGLNEAILTGHATIGGNPLVIAVMDSRFRMASMGSVVGEKILRAVEDADKTNKPFVIFTASGGARMQEGMLSLMQMAKTSAAFKRFSNHGGLIITVMTHPTTGGVSASFASLGDYNFAEPGALIGFAGRRVIEQTVREELPEDFQTAEFLLKHGQLDDCISRLDLQNKLSFILSIHVKAPGVGGEVDGE

SEQ ID NO: 27106 - protein, 349 aa, Listeria monocytogenes str. 1/2a F6854
MCIILRNSGKGNERCCQMKAVGLTKASTDFVDIEIDKPVPENHDLLVKIKAISINPVDTKQREAAKLSGEEVRILGWDAVGEVVDTGSEVTLFQTGQDVYFAGDVTRPGVYAEYTLIDERLVGLKPHNLNVEEAAAMPLTTITAWEALFDRLTITENDKGKSILIINGAGGVGSIATQLAANTGLEVIATASRPETVEWTKSHGANYVINHRENIPEQLEELGFKKGVDFILCLHNTSAHWDEMQEAIRPQGKICSIVELTEPVEMTLLKDKSATFSYEFMFTRSKYDTADKIRQHEILTEAAHMLDKGNLTTTLNQVLSPVNAATIEEAHKIISSGKMIGKLVVKGFE

SEQ ID NO: 27107 - protein, 406 aa, Listeria monocytogenes str. 1/2a F6854
MVYIVVVNPAILSAAGVPFNTVFMATIISAVIGTLWMAIFANYPIAIAPGLGMNAYFVTVVTTQKLDYSVAFAAVFVAGIIFLLLSLTPLREKIIEAIPHNLKAGITAGIGLFIAFLGFRMTGIIVSNDSNLVGLGDLHSKEAILAIVGLLITLILLALNVKGALFIGMIATGIIAFITGELKFTDGIVKLPPMPEFVFTNPIHAFGDVMSYGLYAVVLSFLLITIFDTTGTMIGVAKKAGLMKGESLPNAKQALMADAVATSVGSMFGTTPTSAYIESSAGVATGGRTGLTTLTVAILFMVSAFFAPLVGAVSGISAITAPALIVVGSMMIGAVKEIDWDTLDEAFPAFLVILAMPLTSSIAIGLAFGFISYPVLKVFTGKWRELNWFLIVIAVLFFILVAFLPH

SEQ ID NO: 27108 - protein, 458 aa, Listeria monocytogenes str. 1/2a F6854
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQILKASNRKTKIRHN

SEQ ID NO: 27109 - protein, 229 aa, Listeria monocytogenes str. 1/2a F6854
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNDDLKPVNKYYLDK

SEQ ID NO: 27110 - protein, 432 aa, Listeria monocytogenes str. 1/2a F6854
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLASFKEALAVWGDQVAAVLVEPIVGNFGMVAPEDGFLEAVNELAHVNGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAAAKHNIAVTVNQIVGALTVYFTEDTVTNYAEAGATNGELFGRFFKGMLEEGINLAPSKYEAWFITSAHSEADILETIQAVDTVFGKMVQDN

SEQ ID NO: 27111 - protein, 193 aa, Listeria monocytogenes str. 1/2a F6854
MSIITEVYAREVLDSRGNPTVEVEVYTEAGAFGRALVPSGASTGEYEAVELRDGDKARYLGKGVLKAVENVNDIIADKIIGFDVTDQIGIDKAMIELDGTPNKGKLGANAILGVSLAAARAAADELGVHLYEYLGGVNGKVLPVPMMNILNGGEHADNNVDVQEFMVMPVGAPNFKEALRMGAEILHALKAVL

SEQ ID NO: 27112 - protein, 510 aa, Listeria monocytogenes str. 1/2a F6854
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSVDAEVAFKPIEMKNVIGEVLSNEGLAQLRIAETEKYPHVTFFMNGGRNEEFPGESRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 27113 - protein, 251 aa, Listeria monocytogenes str. 1/2a F6854
MRKPIIAGNWKMNKTAAKAGQFAEDVKNNVPSSDAVESVVAAPALFLQELVRLTEGTNLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 27114 - protein, 396 aa, Listeria monocytogenes str. 1/2a F6854
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEAAIAELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 27115 - protein, 166 aa, Listeria monocytogenes str. 1/2a F6854
MKIAYLGPAASFTHAAAAKAFPKEEMIAKSTIPDCIMAIEKEDVDVAVVPIENTIEGSVNITLDYLFHFSSVPVVAEIVLPIAQHLMVHPAHVSAWKSVQKVMSHPQALAQCHTFLQAELYGVEREVTPSTAYAAKWVSNNPTELVAAIAPRMAANEYGLEIVKEN

SEQ ID NO: 27116 - protein, 362 aa, Listeria monocytogenes str. 1/2a F6854
MIMGFWANAPLILMPGMGINALFAYTLVQGMGLSWQVALAAVTMSGLLFMILAFTPLAGKLNEAIPLILKQAITVGLGLFLIFLGLEKGGIVTRGKHAIIAVGDLGDPFVLATLVTLLLTMILVIRKIPGAFLWSLIIGTIVGVMFGVAGKAGGASISVAPWSDVLFKADFSGIASVGFWSAVFTMTMVIVFETVGLTNGQVRQLKQTEKLPRILKASSLTAFLSGLFGTSPTISALESGSMFASGAKTGLATITTGLFFIASLFLMPVLSFIPNSAIAPILIIIGMSMLQEFKEMDLSNAAETFSALLIIVLIPLTYSIADGIAAGFIAYPILRAFTKNEERTSPVMYVIAALFLLQFIIQ

SEQ ID NO: 27117 - protein, 169 aa, Listeria monocytogenes str. 1/2a F6854
MKKITPKAMCAWIPKREDETHKGDYGRVLIVAGNKQFGGAAIMAAEACVKSGAGLTTVASDSVNRPALQTRIPECMFIDYENITSLSEQISQFDTILIGPGLGLDAYAEEIFRLVLQKSTEHQQVIIDGDGITIYAKGENPHPAAKLTFTPHAGEWERLKVLAPDAVTP

SEQ ID NO: 27118 - protein, 257 aa, Listeria monocytogenes str. 1/2a F6854
MIDTSLATQFLGEVIGTAILIILGAGVVAGVSLKRSKAENGGWVVITLAWGLGVTMGVYVSGYMSMAHLNPAVTIGMALAGAFPWNYVLPYILAQFIGAFIGATLIWLHYYPHWKQTEDKPTKLGVFATAPAIRHFTSNFFGEALGTFILVFGLLSLGANSFSDGLNPLVVGALIVAIGMSLGGTTGYAINPARDLGPRIAHFVWPISGKGGSDWGYSWVPVIGPIMGGALGALGYNAIINGELGMWFWVFAALFVL

SEQ ID NO: 27119 - protein, 197 aa, Listeria monocytogenes str. 1/2a F6854
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKG

SEQ ID NO: 27120 - protein, 477 aa, Methylocystis sp. SC2
MSVQATHSGSARIDPRYDHAALAAARESDRFSLHTKHLNEMWVRVLKTIGYDVGFTRGLGPYLWDRKGDRYLDLLSGWGVFALGRNHPAVRDALVSVLDGELANLVQLDVSVLAGVLAEKLLGYAPWLEKVFFANSGAEAVEAAIKFARAATGRPGILHCAHSFHGLTYGSLSMNGDDIFKKGFGPLLPNAREVAFDDLDALERALAGRDVAAYFVEPIQGKGVNIPQEGYLLGAQALCRKYGTLFVADEIQTGIGRTGRFFAIDHYPGVEPDMIVVAKALSGGHVPVGAVLTRKWIFDKVFDRMDRAVVHGSTFSKNDLAMAAGVATLDVLKNERVIENAAKTGDRLLASFQRMAGGYELVADVRGKGLMIGVEFGPPKSFKLKAAWNLLETVNSGLFCQLISIPLFRDHKVLTQVAGHGNHTIKLLPPLTISDEDCDWIEQSFDAVIADAHKAPSAVWSLGKTLAEHAIKARMSG

SEQ ID NO: 27121 - protein, 394 aa, Methylocystis sp. SC2
MSEEKRKARRKLKPATLVTQAGRAPFDHFGFVNPPIYRGSTVLFPTVAALEALRQPYTYGTKGTPTTRALEQGWSEIAGAADTVLTPSGLAAIGLALLTATQAGAHALIVDSAYQPTRIFCDGLLARFGVKVDYYDPLIGGGVAAMMKPETTAVLVESPGSLSMEVQDIPAIAAAAHAHGACVIADNTWATPLLFPPHERGCDLVIDAGTKYLSGHADLLMGLVSANSAWAKRLRATFNAFSMGSSPDDAALALRGMRTMALRLREQERAALDVAQWLENRPEVSRVLHPGLATHPGHALWRRDFTGASGVFSVILKATSKKAVAAFVDGLELFGIGFSWGGYESLVLPFDCSSYRTATRWTPEGPTLRFSIGLEDVADLKSDLEAGFARLNAH

SEQ ID NO: 27122 - protein, 333 aa, Oligotropha carboxidovorans
MPDYSLAPLRPALEKSLKRSVRFVETDWRNGAPRAEVAKAIPGDILLMENTRFHPGEEENDPEFSRTLADLGDIFVNDAFSVSHRAHASTEGVARLLPSFAGRGMEAELTALDRALGKPMRSVGAVVGGAKVSTKITVLENLVTRVDELIIGGGMANTFLYAKGINVGRSLCEPDFKETVERILQRAADHHCNIVLPRDVVIAKEFAPNAPHEVVDVHAVPADSMILDVGPESVADIMEQFGDLKTLLWNGPVGAFETEPFGRGTFALARCAARLTKAGKLVTVAGGGDTVAALSAAGIQDDFSYVSTAGGAFLEWLEGRGLPGVDVLKISHA

SEQ ID NO: 27123 - protein, 202 aa, Oligotropha carboxidovorans
MEAIDAAGADWIHCDVMDGHFVPNISFGPDVIKAIRPRTKKVFDVHLMIAPVDPYLEAFAKAGADVITVHAEAGPHLDRSLQAIRNLGKKAGATICPATPENVLANVLDRLDLILVMSVNPGFGGQQFISSQLDKIRRIRAMIGERPIRLEVDGGVNVETAAQVAAAGADTVVAGAAVFKGGTQSAYATNIAAIRAAAGTAR

SEQ ID NO: 27124 - protein, 335 aa, Aeropyrum pernix
MKRPRVFVTREVFPEALELLSKYYDVEVWDKYQPPPYETLLSKAREADALYTLLTDRIDCDLLSQAPRLRIVAQMAVGFDNIDVECATRLGIYVTNTPGVLTEATAEFTWALILAAARRVVEADHFVRWGEWWRLRTGWHPMMMLGVELRGKTLGILGMGRIGSRVAEIGKAFGMRIIYHSRSRKREIEKELGAEYRSLEDLLRESDILSIHLPLTDETRHLIGESELKLMKKTAILVNTGRGAIVDTGALVKALREGWIAAAALDVFEEEPLNPNHPLTAFKNVVLAPHAASATRETRLRMAMMAAENLVAFAQGKVPPNLVNREVVKVRQPGF

SEQ ID NO: 27125 - protein, 440 aa, Tropaeolum majus
MTLPGSSTKQDNSDNKDRSSYFNLPALDIYAAFPQATPASKLPPTVSDYYKFDDLLTPEEQALRIKVRECMEKEVAPIMTEYWEKAEFPFHIVPKLGALRIAGGTIKGYGCPGLSITGSAIATAEVARVDASCSTFILVHSSLAMLTIALCGSESQKQKYLPSLAQLSDVACWALTEPDYGSDASGLRTIATKVEGGWLLEGQKRWIGTVPLQISWIIFARNTSTNQINGFIVKKDAPGLTATKIQNKIGLRIVQNGDILLKKVFVPDEDRLPGVNSFQDTNKVLAVSRVMVAWQPIGISMGIYDMCHRYLKQRKQFGAPLAAFQINQQKLVTMLGNVQAMVLVGWRLCKLYEKGQMTTGQASLGKAWISSKARETAALGRELLGGNGILSDFLVAKAFCDLEPIYTYEGTFDINTLVTGREVTGLASFKPATSSQRSRL

SEQ ID NO: 27126 - protein, 454 aa, Escherichia coli
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAVLVILNGLFQGMGVGPSFITIANWFPRRERGRVGAFWNISHNVGGGIVAPIVGAAFALLGSEHWQSASYIVPACVAIVFAVIVLILGKGSPRQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 27127 - protein, 181 aa, Candida orthopsilosis
DCGDNYVMGHEIAGTVAAVGDDVTSYKVGDRVACVGPNGCGGCKYCRGSIDNVCKRAFGDWFGLGYDGGYQQYLLVTRPRNLALIPDNVSSDVAAASTDAVLTPYHAIKMAKVSPTSNLLLIGAGGLGGNAIQVAKSFGAKVTVLDKKKEARDQAKKLGADEVYESLPGSISPGSFSACFD

SEQ ID NO: 27128 - protein, 482 aa, Oryza sativa
MEKSELLLGSYSYAALCGVTLIIGWLAHWVYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWREEKRSSMLKNYMPFGGGVRLCLGAEFSKLFIALFLHILVTEYSWTEIEGGEVLRISEIMFPQGYHIQLVPQT

SEQ ID NO: 27129 - protein, 159 aa, Codonopsis lanceolata
MAGYGDSFQTGRDQARQTDDYGNLVRQTDEHGNPIHPTTGGTIGDHISTGGYGTGTGEHNAGHQGQQHHGDTGGVTGVLHRSGSSSSSSSEDDGMGGRRKKGIKEKIKEKLPGGRKEEQRTSTTTPGTGAVYGGHEVEPEKKGLVEKIKEKLPGAHAHH

SEQ ID NO: 27130 - protein, 396 aa, Hordeum vulgare subsp. vulgare
MAAAMAATTMVTKNNGGSLAMDKKNWFFRPAPEVAFSWSSQPESRSLEFPRRALFASVGLSLSHDGKARPADDVAHQLAAAGDAGVQQTQKAKKAKKQQLGLRKVRVKIGNPHLRRLVSGAIAGAVSRTFVAPLETIRTHLMVGSSGADSMGGVFRWIMRTEGWPGLFRGNAVNVLRVAPSKAIEHFTYDTAKKYLTPEAGEPAKVPIPTPLVAGALAGVASTLCTYPMELVKTRLTIEKDVYDNLLHAFVKIVRDEGPGELYRGLAPSLIGVVPYAAANFYAYETLRGAYRRASGKEEVGNVPTLLIGSAAGAIASTATFPLEVARKQMQVGAVGGRQVYKNVLHAMYCILNKEGAAGLYRGLGPSCIKLMPAAGISFMCYEACKKILIENNQEA

SEQ ID NO: 27131 - protein, 227 aa, Pyrococcus furiosus
MVEVKKHKFPGVYVVIDDDGSEKIATKNLVPGQRVYGERVIKWEGEEYRIWNPHRSKLGAAIVNGLKNFPIKPGKSVLYLGIASGTTASHVSDIVGWEGKIYGIEFSPRVLRELVPIVEERRNIIPILGDATKPEEYRALVTKVDVIFEDVAQPTQAKILIDNAKAYLKRGGYGMIAVKSRSIDVTKEPEQVFKEVERLLSEYFEVIERLNLEPYEKDHALFVVRKP

SEQ ID NO: 27132 - protein, 312 aa, Bacillus subtilis
  misc_feature (1)..(1): Xaa can be any naturally occurring amino acid
  misc_feature (51)..(51): Xaa can be any naturally occurring amino acid
  misc_feature (143)..(143): Xaa can be any naturally occurring amino acid
XKKAKLGKSDLQVFPIGLGTNAVGGHNLYPNLNEETGKELVREAIRNGVTXLDTAYIYGIGRSEELIGEVLREFNREDVVIATKAAHRKQGNDFVFDNSPDFLKKSVDESLKRLNTDYIDLFYIHFPDEHTPKDEAVNALNEXKKAGKIRSIGVSNFSLEQLKEANKDGLVDVLQGEYNLLNREAEKTFFPYTKEHNISFIPYFPLVSGLLAGKYTEDTTFPEGDLRNEQEHFKGERFKENIRKVNKLAPIAEKHNVDIPHIVLAWYLARPEIDILIPGAKRADQLIDNIKTADVTLSQEDISFIDKLFAPG

SEQ ID NO: 27133 - protein, 333 aa, Bacillus subtilis
  misc_feature (1)..(1): Xaa can be any naturally occurring amino acid
  misc_feature (27)..(27): Xaa can be any naturally occurring amino acid
  misc_feature (74)..(74): Xaa can be any naturally occurring amino acid
  misc_feature (140)..(140): Xaa can be any naturally occurring amino acid
  misc_feature (162)..(162): Xaa can be any naturally occurring amino acid
  misc_feature (185)..(185): Xaa can be any naturally occurring amino acid
  misc_feature (215)..(215): Xaa can be any naturally occurring amino acid
  misc_feature (323)..(323): Xaa can be any naturally occurring amino acid
XEYTSIADTGIEASRIGLGTWAIGGTXWGGTDEKTSIETIRAALDQGITLIDTAPAYGFGQSEEIVGKAIKEYXKRDQVILATKTALDWKNNQLFRHANRARIVEEVENSLKRLQTDYIDLYQVHWPDPLVPIEETAEVXKELYDAGKIRAIGVSNFSIEQXDTFRAVAPLHTIQPPYNLFEREXEESVLPYAKDNKITTLLYGSLCRGLLTGKXTEEYTFEGDDLRNHDPKFQKPRFKEYLSAVNQLDKLAKTRYGKSVIHLAVRWILDQPGADIALWGARKPGQLEALSEITGWTLNSEDQKDINTILENTISDPVGPEFXAPPTREEIPG

SEQ ID NO: 27134 - protein, 295 aa, Anabaena sp.
DVPVNLYRPNAPFIGKVISNEPLVKEGGIGIVQHIKFDLTGGNLKYIEGQSIGIIPPGVDKNGKPEELRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 27135 - protein, 310 aa, Alicyclobacillus acidocaldarius
MPLDPVIQQVLDQLNRMPAPDYKHLSAQQFRSQQSLFPPVKKEPVAEVREFDMDLPGRTLKVRMYRPEGVEPPYPALVYYHGGGWVVGDLETHDPVCRVLAKDGRAVVFSVDYRLAPEHKFPAAVEDAYDALQWIAERAADFHLDPARIAVGGDSAGGNLAAVTSILAKERGGPALAFQLLIYPSTGYDPAHPPASIEENAEGYLLTGGMSLWFLDQYLNSLEELTHPWFSPVLYPDLSGLPPAYIATAQYDPLRDVGKLYAEALNKAGVKVEIENFEDLIHGFAQFYSLSPGATKALVRIAEKLRDALA

SEQ ID NO: 27136 - protein, 296 aa, Capsicum annuum
ISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 27137 - protein, 466 aa, Luffa quinquefida
SVGFKAGVKDYKLTYYTPEYQTKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKAIKFEFEAVDTL

SEQ ID NO: 27138 - protein, 333 aa, Alcaligenes faecalis
MKPRIVTTHRIHPDTLALLETAAEVISNQSDSTMSREEVLLRTNDADGMMVFMPDSIDADFLSACPNLKVIGAALKGYDNFDVEACTRHGIWFTIVPDLLTSPTAELTIGLLLSITRNMLQGDNYIRSRQFNGWTPRFYGTGLTGKTAGIIGTGAVGRAVAKRLAAFDMQIQYTDPQPLPQESERAWNASRTSLDQLLATSDFIIPMLPMSSDTHHTINARALDRMKPGAYLVNACRGSIVDERAVVHALRTGHLGGYAADVFEMEEWARPDRPHSIPDELLDPALPTFFTPHLGSAVKSVRMEIEREAALSILEALQGRIPRGAVNHVGAGR

SEQ ID NO: 27139 - protein, 1953 aa, Saccharomyces cerevisiae
MLKNSGSKHSNSKESHSNSSSGIFQNLKRLANSNATNSNTGSPTYASQQQHSPVGNEVSTSPASSSSFRKLNAPSRSTSTEARPLNKKSTLNTQNLSQYMNGKLSGDVPVSSQHARSHSMQSKYSYSKRNSSQASNKLTRQHTGQSHSASSLLSQGSLTNLSKFTTPDGKIYLEMPSDPYEVEVLFEDIMYKRNIFQSLSEDKQEALMGYSIEKKWLIVKQDLQNELKKMRANTTSSSTASRTSMASDHHPILTANSSLSSPKSVLMTSASSPTSTVYSNSLNHSTTLSSVGTSTSKGKKLVSGSLKKQPSLNNIYRGGAENNTSASTLPGDRTNRPPIHYVQRILADKLTSDEMKDLWVTLRTEQLDWVDAFIDHQGHIAMANVLMNSIYKTAPRENLTKELLEKENSFFKCFRVLSMLSQGLYEFSTHRLMTDTVAEGLFSTKLATRKMATEIFVCMLEKKNKSRFEAVLTSLDKKFRIGQNLHMIQNFKKMPQYFSHLTLESHLKIIQAWLFAVEQTLDGRGKMGSLVGASDEFKNGGGENAILEYCQWTMVFINHLCSCSDNINQRMLLRTKLENCGILRIMNKIKLLDYDKVIDQIELYDNNKLDDFNVKLEANNKAFNVDLHDPLSLLKNLWDICKGTENEKLLVSLVQHLFLSSSKLIEENQNSSKLTKQLKLMDSLVTNVSVASTSDEETNMNMAIQRLYDAMQTDEVARRAILESRALTKKLEEIQAERDSLSEKLSKAEHGLVGQLEDELHERDRILAKNQRVMQQLEAELEELKKKHLLEKHQQEVELRKMLTILNSRPEESFNKNEGTRGMNSSLNSSEKANIQKVLQDGLSRAKKDYKDDSKKFGMTLQPNKRLKMLRMQMENIENEARQLEMTNFAEFEKDRLEPPIHIKKPKVKKMKNKDRKPLVKPQEADVNKLNDLRRALAEIQMESNDISKFNVEERVNELFNEKKSLALKRLKELETKYKGFGIDFNVDEIMDSPKKNTGDVETEEDANYASLDPKTYQKKLDEINRITDQLLDIQTQTEHEIQVEEDGESDLSSSSSDDESEEIYQDASPTQELRSEHSELSSGSGPGSFLDALSQKYGTGQNVTASAAFGENNNGSGIGPLHSKVEKTFMNRLRKSTVSSAPYLEELTQKVNKVEPYEQNEDEGLDKKSLPENSTASAASAFDKAEKDMRQHVENGKQGRVVNHEEDKTADFSAVSKLNNTDGAEDLSTQSSVLSSQPPPPPPPPPPVPAKLFGESLEKEKKSEDDTVKQETTGDSPAPPPPPPPPPPPPMALFGKPKGETPPPPPLPSVLSSSTDGVIPPAPPMMPASQIKSAVTSPLLPQSPSLFEKYPRPHKKLKQLHWEKLDCTDNSIWGTGKAEKFADDLYEKGVLADLEKAFAAREIKSLASKRKEDLQKITFLSRDISQQFCINLHMYSSLSVADLVKKILNCDRDFLQTPSVVEFLSKSEIIEVSVNLARNYAPYSTDWEGVRNLEDAKPPEKDPNDLQRADQIYLQLMVNLESYWGSRMRALTVVTSYEREYNELLAKLRKVDKAVSALQESDNLRNVFNVILAVGNFMNDTSKQAQGFKLSTLQRLTFIKDTTNSMTFLNYVEKIVRLNYPSFNDFLSELEPVLDVVKVSIEQLVNDCKDFSQSIVNVERSVEIGNLSDSSKFHPLDKVLIKTLPVLPEARKKGDLLEDEVKLTIMEFESLMHTYGEDSGDKFAKISFFKKFADFINEYKKAQAQNLAAEEEERLYIKHKKIVEEQQKRAQEKEKQKENSNSPSSEGNEEDEAEDRRAVMDKLLEQLKNAGPAKSDPSSARKRALVRKKYLSEKDNAPQLLNDLDTEEGSILYSPEAMDPTADTVIHAESPTPLATRGVMNTSEDLPSPSKTSALEDQEEISDRARMLLKELRGSDTPVKQNSILDEHLEKLRARKERSIGEASTGNRLSFK

SEQ ID NO: 27140 - protein, 483 aa, Oryza sativa
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 27141 - protein, 506 aa, Hordeum vulgare subsp. vulgare
MEVEAGAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKRGDMAKDKFSKVLWGAVTNYRTWIFVLLYGYCMGVELTTDNVIAEYYFDHFHLDLRAAGTIAACFGMANIVARPMGGYLSDLGARYFGMRALWNIWILQTAGGAFCIWLGRASALPASVTAMVLFSICAQAACGAIFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHIAGQKFAENSRSERGRRNVIFATSATPPNNTPQQV

SEQ ID NO: 27142 - protein, 507 aa, Hordeum vulgare subsp. vulgare
MEVEAGAHGDAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTGNVIAEYYFDHFHLNLRAAGTIAACFGMANIVARPMGGYLSDLGARYFGMRARLWNIWILQTAGGAFCIWLGRASALPASVTAMVLFSICAQAACGAIFGVEPFVSRRSLGIISGLTGAGGNVGAGLTQLLFFTSSQYSTGRGLEYMGIMIMACTLPVALVHFPQWGSMFLAASADATEEEYYASEWSEEEKSKGLHIAGQKFAENSRSERGRRNVILATSATPPNNTPLHV

SEQ ID NO: 27143 - protein, 442 aa, Streptomyces spectabilis
MSTTAMPASTHHTIALEQSHRLPGGQSMTDLSGLVVDRARNAEVWDKDGKRYIDFFTGVGVCNIGHSHPRFLAEVGEQLSACAVGTFYTDARSRYYELLAAQLPERLGRIHMFSTGSEAVEAAVKLARAATGKHEVVSFWGGFHGKTQGALSLHGGPRKHRSGPFPPGSHQVPYAYCYRCPLQLEHSTCGQRCVDLAEQSIENGSVGDIAAIIVEPVQGTNGNIIPPAGYLRAVRRLADRHGALLILDEVITGFGRTGSLFAFEQDPEVRPDVVVLGKAMASGVPASAIVSRAELVEGTSFGQPSAAASTFGGNPLASAAALATLRILLDERLPERSRLLGETVARRLASWKEEFPFVGNAANVGLMVGVELVEPGTRRPLPKDVTRRIFQGLLAEGVLAMAYDSRIRIYPPLSIPADHLDEGLTAFESVFRSLRSLRSTQT

SEQ ID NO: 27144 - protein, 398 aa, Klebsiella oxytoca
MTRQLVIIGNGMAATPGEALVERDARRFSITIIGDEPRQAYNRIQLSPVLGAEKTAGATRLLPAEWYSQHNVTVRAGETVTAVDMAARTLQTTAGELGWDELVFATGSLPFLPPLPGITLPHVFAFRTLADVEGILAIDGPAVVIGGGVLGVEAAAALRRHGDSVTLLHRGSWLMEQQTDAFVGEQLQMLLAERGIGCVMESRIAAIDEHQVLLEDGRAFAASRVVLATGVQPNKRLAERSGLACGRGILVDRRLATAQPGVSALGECCEIDGQTWGLVAPCLRQAEVLADRLCAIPGEDFRWQDSGTRLKVTDIELFSAGELRADEQDDVYTSWDPLDRHYRRLLLRDGKLRGVLLLGDCSSAAPLTALLGRHGPRRQSGFSTHLQRCSRALWDKLR

SEQ ID NO: 27145 - protein, 394 aa, Aspergillus saitoi
MVVFSKTAALVLGLSTAVSAAPAPTRKGFTINQIARPANKTRTVNLPGLYARSLAKFGGTVPQSVKEAASKGSAVTTPQNNDEEYLTPVTVGKSTLHLDFDTGSADLWVFSDELPSSEQTGHDLYTPSSSATKLSGYSWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESYEAGGYVFSCSTDLPDFTVVIGDYKAVVPGKYINYAPVSTGSSTCYGGIQSNSGLGLSILGDVFLKSQYVVFNSEGPKLGFAAQA

SEQ ID NO: 27146 - protein, 159 aa, Zea mays
  misc_feature (56)..(56): Xaa can be any naturally occurring amino acid
MDSTGTGAGGKGKKGAAGRKVGGPRKKSVSRSVKAGLQFPVGRIGRYLKKGRYAQXVGTGAPVYLAAVLEYLAAEVLELAGNAARDNKKTRIIPRHVLLAIRNDEELGKLLGGVTIAHGGVLPNINPVLLPKKTAEKASSGGSKEAKSPKKAAKSPKKA

SEQ ID NO: 27147 - protein, 230 aa, Streptomyces purpurascens
MQAWQVHENGEPSEVMRLEDASATPAKAGLLSARANITPDACCAALQSARCLIGVEICGETEDGRRVIANPALPHGFAEYAVADAAALLPAPDALDDAEAAALHIGYQTGWFGLHRRAGLEAGETLLVHAAAGGVGSAAVQLGKAAGATVIGVVGGPGKAAVARELGCDVVIDRRAEDVVAAVKEATGGRAPNVIYDPVGGEAYTQSAKVVAFEGRIIVVFAGGTIPARP

SEQ ID NO: 27148 - protein, 155 aa, Arabidopsis thaliana
MATNIGMMDSAYFVGRNEILTWINDRLHLNLSRVEEAASGAVQCQMLDMTFPGVVPMHKLVDLKISTDLLEKERDFYFSKLRDVEILCQTPELDDLPVNVSVEPIVVAVKKILYATDANESALEDAQEYLNQSLGVEDDEAEGNGEQLEEEKTQA

SEQ ID NO: 27149 - protein, 360 aa, Aralia cordata
MGSLEAERKTTGWAARDPSGVLSPYTYTLRETGPEDVFIKIIYCGICHTDIHQIKNDLGASNYPMVPGHEVVGEVVEVGSDVTKFKVGDCVGDGTIVGCCKTCRPCKADVEQYCNKKIWSYNDVYTDGKPTQGGFSGHMVVDQKFVVKIPDGMAPEQAAPLLCAGVTVYSPLTHFGLKEISGLRGGILGLGGVGHMGVKLAKAMGHHVTVISSSDKKKEEAIDHLGADAYLVSSDATQMQEAADSLDYIIDTVPVFHPLEPYLSLLKLDGKLILMGVINTPLQFISPMVMLGRKAITGSFIGSMKETEEMLDFCNEKGITSTIEVVKMDYINTAFERLEKNDVRYRFVVDVAGSKLDQET

SEQ ID NO: 27150 - protein, 504 aa, Alcaligenes sp. AL3007
MQTVNEMLRRAATRAPDHCALAVPARGLRLTHAELRARVEAVAARLHADGLRPQQRVAVVAPNSADVVIAILALHRLGAVPALLNPRLKSAELAELIKRGEMTAAVIAVGRQVADAIFQSGSGARIIFLGDLVRDGEPYSYGPPIEDPQREPAQPAFIFYTSGTTGLPKAAIIPQRAAESRVLFMSTQVGLRHGRHNVVLGLMPLYHVVGFFAVLVAALALDGTYVVVEEFRPVDALQLVQQEQVTSLFATPTHLDALAAAAAHAGSSLKLDSLRHVTFAGATMPDAVLETVHQHLPGEKVNIYGTTEAMNSLYMRQPKTGTEMAPGFFSEVRIVRIGGGVDEIVANGEEGELIVAASDSAFVGYLNQPQATAEKLQDGWYRTSDVAVWTPEGTVRILGRVDDMIISGGENIHPSEIERVLGTAPGVTEVVVIGLADQRWGQSVTACVVPRLGETLSADALDTFCRSSELADFKRPKRYFILDQLPKNALNKVLRRQLVQQVSS

SEQ ID NO: 27151 - protein, 349 aa, Mycoplasma mobile 163K
MLKPKNRIAMLPMDTKMAKNGFVNDFHVQHYGARIWGEVGTIIVESVAVSPEGRIEHDDLGIWSDEHIEGYKHLVRLAKVKNALIGLQLNHASSASFDKENKINVSTKYDKDQNVKLATISQLNQIIENFILAAKRAKKAGVDFVEIHAAHGYLFSQLISPITNEINPSENIVERSRLLIDFVKRLKKEVDIPFGIRLSVNDYFPNGNTAKDFKPLIKELEKYVIYFNVSSWILSGAPLLEESVKKTKLYRLEDALTIKSFTNKQVIASGNFNTKEDIDFALNKGIDFVGIGRELLFNPNFLLNNYFSPEELKTQNFEWVKGNRFYNHIQYLEDKIKNNYTFNSRKWDK

SEQ ID NO: 27152 - protein, 455 aa, Mycoplasma mobile 163K
MSAIMRIHAREVLDSRGNPTIQIEVESEYGYGSAMVPSGASTGEKEAKELRDKGTKYEKNWYGGKGVQTAVDNVNNIIAPKIEGYDVLDQRAIDYEMIKLDGTEFKEKLGANAILGVSLAVAKAAADELNIPLYRYVGGTNGFKLPVPMLNVINGGEHASNTVDFQEFLIMPIGAKTFKEAMQVANKVFHNLKDLLASQGHSTAVGDEGGFAPDLKSHEEVLDFIVSAIKKAGYEPSKKGDKAVAIAIDAASSELFDKKSKTYTFKKLKKAILTKQPGFENLGKVKVEYSSDELVEYFKDLFKKYPIISLEDGFSEHDWDAFTKLNNSVGATHQIMGDDLVTTNPKFIKKAIETKAINSVLIKLNQIGTLSETMDAIEMAHKAGMTCVVSHRSGETEDTTIADLAVALNTGQIKTGSISRTDRVAKYNRLLVIEEELGIVASYEGIQVFHNLKVK

SEQ ID NO: 27153 - protein, 217 aa, Mycoplasma mobile 163K
MIRNLIFLGAPGSGKGSTALEISTKYDIEHISTGEIFRNEIKNKTPLGLKVAEIVNDGKYVPDELTNQIVLKKLKELKQENKKFILDGYPRTLNQAMFLSSVLDEKILAVLLEVPTNLIIERLSFRRICPICKSIYHLKYNPSKKGEFCENHLENLTKIEARQDDSEESIKKRLKIYNEETKPMIDYYKKNQSLVVINSEESVKKVASLVIKKVFND

SEQ ID NO: 27154 - protein, 483 aa, Mycoplasma mobile 163K
MNVLEKEKGVNLTDKRSKMIATIGPSSQNKEILKQMMLKGMTTVRANFSHGDHAEQLNKFVLAKEVAKELNLPMSLMLDTKGPEIRVGKMKDGSQKIEVGKIITVLTDEVSYKTFEGIPTKFTVSHRMDKDVKVGSYILFDDGKLTTIVTGVKSGIVEVKTINSHVLKSNKRINIPGAQLSLEFLSKKDKEDIIFGIKNDVNYIAASFVNSKQDVLDLRKLLKDNNGEHIQIISKIESVFGIENIDEIIEASDGIMIARGDLGLEIPYFEVPFYEKQIIRKCRNVGKPVIVATQMLDSMEKLPQPTRAEVSDVYWATELGADATMLSGESANGDFPVESVEVMSTINRRAEKEFYNKLYYPAHLETLIQNPVGVHSKLASEVALKVMNGDYKFSVILSETGRLLKEIARFRPNTVIIGVINNDKLIHGFGITHSVFMSVDSKAVKSEIEKNLTKAREVLKPFFPKKGDKYLVVENNKISEYIY

SEQ ID NO: 27155 - protein, 510 aa, Mycoplasma mobile 163K
MKKTVILSVIDGLGLREEKQGNAFKLAKTPNFDKLFNEYPNSVIQASGDYVGLPDDQMGNSEVGHLNIGAGQIVYTGLSLINKDIKDNKFKQNAKFIAAFNAVKKNNETNTLHLMGLLSDGGVHSHEEHLFKLIEAAHENGLKNVSVHVFGDGRDVAPRSILTSIKKLEAITKKYNYAIGSIMGRFYAMDRDQIFTRNEQALEVMMGKTTNYFTNASEYIKAQYQKDISDEFFIPAINKDYLAKKLNLKDNDAVIFYNFRPDRARQLSHLLIQSNLYNYQSKNQVKLSNFTSMMKYEGLDTNIAYEEMKITNPLGNILAKNGLSQLRIAETQKYAHVTFFFDGGNDVLYENEERILIDSVKADSFADYPEMSAAGITDTLIANLGKYDVIILNYANPDMVGHTGNLKATIKALEFLDFQYGKILKAIEKTNHTLFITADHGNAEITEDENGNPATKHTTSPVMLIVTDKNLKLNSGTLANIAPTILDYLKIPKPKNMLDSLIMNNKRTSK

SEQ ID NO: 27156 - protein, 242 aa, Mycoplasma mobile 163K
MRKKIIIGNWKMNKTKTEAENFVKEFNKITSELNLKLDKNLVAGLALPFTSLGIKKEGNFANLVIAAQNFHQNNSGAFTGEISAEMLLDLGVKMVVLGHSERREFFHETDEIVNMKMHQAIKNNLVPIVCVGETELQYNSNKSKEVIKNQIEKSLKNLSDFSKIIIAYEPIWAIGTGKTATVEYAQEMCKYIRSLTNEKTIIQYGGSVKPNNIKELLSQKDIDGALVGGASLNVKDFIDLIK

SEQ ID NO: 27157 - protein, 186 aa, Mycoplasma mobile 163K
MKHKSNDPRFTEILFTSEEIQIKVKELANWVNETYKNSKDLIFIGLLKGCLPFLIDLAKNVTVEHIWDFMTLSTYSGSTESSGNVKVVMDLKQNIFDKDVLIIEDIVDSGITLEKVVGMLKMKQPKSLKILTLLDKRVNRKNKLEVDKAGFIVPNKFLAGYGLDVKEKLRNIDFIGVFNQEYLDKL

SEQ ID NO: 27158 - protein, 169 aa, Mycoplasma mobile 163K
MMKINNEIKDLREIDVYDENGKKLKGIVLFTFEEAGDTFICYTIKEEVFFSKLNEDNSLSNLEEDEYKIVEQIWEDFIQSDKFKELAEKYNFEGIGGPLVDGGDDEDDDDEDEDDEDDEDEDDEDEDDDEEYYGDYDEDEDEYEEDYEEFSKDIKDSYKNLIEKRNIIN

SEQ ID NO: 27159 - protein, 511 aa, Mycoplasma mobile 163K
MKKTLDQISLKNKKVIIRVDFNVPIVNGIVTSNKRIEAVIPTIKKVVNEGGKAILMSHLGRVKSEEDLKKKSLAPVVEILVNLLGMPITFVPATNGTELEETINSMKSGEIVMMENTRFEDLNNDAESSNNPDLGMYWASLGDVFINDAFGTVHRKHASNVGISTYIAESGIGYLVEKEIKNLDKALSRPERPIVAILGGAKVSDKIGVLNNLLKYVDKIIIGGAMAYTFLAAQGIGIGKSLVEEDKIDLAREYLKNNLDKFVLPIDYALAKDFEDVKPFYNLENTLEIPNGYMGLDIGPKSIEVFKKYIKDAKTILWNGPLGVTEFKYFKEGTKAIAKAITELKGNVYTVVGGGDSVAIIEELGLDRRFSHVSTGGGATLEFLEGKELPGIQAIQNEGELGRTKEEIFSILTQNSEEVLHEHTAAFSTSEVEPANEEFPSEYNDSNSQTYFSNEVENDEDFLLNTNDFPTREASFPNEVKTEEIILNENDDEFDIEDEELDSLPNDDIKF

SEQ ID NO: 27160 - protein, 373 aa, Mycoplasma mobile 163K
MKKDYYEILGLTKSASKDEIKKAYRTLAKTYHPDVNKETNAEEKFKEITEAYEILNDDVKREQYNQFGHAAFDPNAGGFGGQNPFTNAEGFSGFSDFSGFGSIFTDFFGGFGNSQRANPNRAQRGEDRHAVIKISFIDSVLGKEIVEPLEKFETCNTCNGSGAKSQSDIITCTQCSGMGEQIKITKTFLGQMQQNVICSKCNGIGKEIVEKCLICKGKTHTKTTKNITIKIPAGIQNGQTLRVENYGNAGLNGGSNGNLILSIKVSPHKHFVRKNNDIILRLPVSIKSVIGSEKVEVPTPYGFEIIKIDPNIKTGDELIIKNKGIITKYESGKMIVIFEIFIPKLTSFEKKEISTILEKNADKFYEKWIKEFE

SEQ ID NO: 27161 - protein, 433 aa, Mycoplasma mobile 163K
MEKIKLNLLNAIDSSEILNYKDQVKEINEKMNRFEMIGSDFLGWKDLPNQINWDEFLNMEEKAKWLIKENVEILVVIGIGGSYLGARAAIEFVNGTFPLSGSKKLEIIYAGTNLSSTATAQLLAYVENKKFAINIISKSGTTLEPSIAFRFFRELLEKKVGKAESRKFIIATTDANKGLLREIVRKEGYTSFIIPDDVGGRYSVLTPVGLFPMLCAGLNVREILVGAQKSNDFYKKSDLEENIAYQYAVARHIMHTQKKYAVEVLISYEPYFQYFLEWWKQLFGETEGKNELGLYPSSKIFSTDLHSLGQFIQEGSRILFETVINLKKPKIDLDISEDKENFDGINYLVNKTLHGINVAALDATVSAHTDVAKVPNIILEIADSTEETLGWLFMFFERACAMSAYLLNLNPFNQPGVEVYKANMFKILGKPKK

SEQ ID NO: 27162 - protein, 218 aa, Mycoplasma mobile 163K
MKLISPSLLNVEESKRAEIATKMIELGIKWIHYDFMDGKFVPETAISFENYMEIKEKSPSHIKDIHLMVQDVSFYVEKFLNKAEYITFHFEALNYNEIKKILKKYHGLQKFGIALKPKTNIEQIYEYLPYVDLVLIMSVEPGYGGQKFIPNSLEKITKLKKYLLERSLDIVIQVDGGINEESGPQAFESGADILVSGSYLVKNLTKEQIDSLFPKEKN

SEQ ID NO: 27163 - protein, 214 aa, Diospyros kaki
AFGADLVLTEPTKGMGGTVKKAYELLESTPNAFMLQQFSNPANTQVHFETTGPEIWQDTNGKVDIFVMGIGSGGTVSGVGQYLKSQNPNVKIYGIEPEESNVLNGGKPGPHDITGNGVGFKPDILDMDVMEEVLMVSSEDAVNMARTLALKEGLMVGISSGANTVAALRLARRPENKGKLIVTVHPSFGERYLSSVLFQELRKEAENMQPVAVD

SEQ ID NO: 27164 - protein, 214 aa, Diospyros kaki
AFGADLILTDPTKGMGGTVKKAYELLESTPNAFMLQQFSNPANTQVHFETTGPEIWEDTCGTVDIFVMGIGSGGTVSGVGRYLKSQNPDVKIYGLEPAESNVLNGGKPGPHHITGNGVGFKPDILDMDVMEEVLMVSSEDAVSMARELALKEGLMVGISSGANTVAALRLARKPENKGKLIVTVHPSFGERYLSSILFEELKKEAENMEPVPVD

SEQ ID NO: 27165 - protein, 486 aa, Pseudomonas putida
MRQIENFIAGEFVAAASGKRFDKRSPVDNRIICSISEAGRSEVDAAVSAARSALHGEWGSLSTDQRIELLLCVANEITRRFDDFVEAEMSDTGQPEHVMKHVFIPRGAANFKVFADVIKSVASESFKMDTPDGRGALNYSIRRPKGVIGVVCPWNAPFMLMTWKVGPALACGNTVVVKPSEESAQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 27166 - protein, 485 aa, Ginkgo biloba
MASIFVPVCVSVAVITITCLKKFNGWRYECGLSSKKPLPPGDMGWPLLGNMLSFLIAFKFNRPNSFVSAFVSRFGRTGLYKPFMFGSPTILATTPETCKQVLMDDAHFVPGWPVSTVQLMGRKSFVALSHEDHDRLRKLTAPSINGHEALSNYLGWIEQRVVSAYEDWANQDRIVLLNELKKVTFDIISYIFLSYESKTGTKLASLEREYTSLNMGIRAMAINLPGTAYHKALKARKNLVAILQSVTEERRSSPDPQAKSNKDVLNALLHVKDENGSLLTDEEIIDLLVMYLNAGHESSAHITMWAIIFLVSHPRLYAEAKAEQEKIVNKRPDGQTHLIMYEIREMNYLRKIIDESLRMVNISLMVFREAMDDVEINGYTIPKGWKTQVWLRSVHMDPQVYPNPTKFDPDRWDKLIPKSGMFIPFGAGSRLCPGSDLAKMEICVFIHHLLFHYKIERLNPDCPVRYLPHPRPTDYCKGRVRKLST

SEQ ID NO: 27167 - protein, 183 aa, Rosa roxburghii
GHGGFGKVYLGVLEDSTKLAIKRGNPNSEQGINEFRTEMDMLSKLRHRHLVSLIGFCDENNEMILVYEYMANGPLRDHLYGSNLLPLSWKQRLEVCIGAARGLHYLHTGAAQGIIHRDVKTTNILLDENFVAKVADFGLSKAAPSLEQTHVSTAVEGSFGYLDPEYFRRQQLTEKSDVYSFGV

SEQ ID NO: 27168 - protein, 183 aa, Rosa roxburghii
GEGVFGKVYLGVLEDSTKLAIKRGNPNSEQGINEFRTEMDMLSKLRHRHLVSLIGFCDENNEMILVYEYMANGPLRDHLYGSNLLPLSWKQRLEVCIGAARGLHYLHTGVAQGIIHRDVKTTNILLDENFVAKVADFGLSKAAPSLEQTRVSTAVKGSFGYLDPEYFRRQQLTEKSDVYSFGV

SEQ ID NO: 27169 - protein, 184 aa, Rosa roxburghii
GEGGFGKVYKGLIDGASTEVAIKRSNPSSEQGVNEFQTEIEMLSRLRHRHLVSLIGFCEEEGEMILVYDYMANGTLREHLYKCNKPPLSWKQRLEICIGAARGLHYLHTGARYTIIHRDVKTTNILLDENWVAKVSDFGLSKTGPNLHQTHVSTMVKGSFGYLDPEYFRRQQLTEKSDVYSFGV

SEQ ID NO: 27170 - protein, 387 aa, Gossypium hirsutum
MVHCLPKVFVIQDKPMLPSTAAVAKDEHRPLAFDASILGSESNIPSQFIWPDDEKPCLDAPALVIPTIDLGAFLLGDSLAVSKAAEVVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPIPGAFVVNVGDTFMALTNGFYKSCLHRAVVNTETVRKSLAFFLCPKLERPVTPAAGLVTAENPRKYPDFTWAALLKFTQNHYRADMKTLVAFSKWVQEQESNYKLIP

SEQ ID NO: 27171 - protein, 470 aa, Synechococcus sp.
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLRWRRVIAIRQNEEFRFRFQCFPGLLRQLPARSLPQNLTQAQRDYFGAHTYERTDRSGSFHAQWF

SEQ ID NO: 27172 - protein, 469 aa, Bacillus anthracis str. Ames 0581
MENLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYNWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 27173 - protein, 441 aa, Bacillus anthracis str. Ames 0581
MKRYFQFDELGTNYKTEFIAGLTTFLSMAYVLFVNPATLSLGNVKGLPAGTGMDPGAVFVATALAAAIGSLIMGIFAKYPIALAPGMGINAFFAYTAVLTMGIPWQTAIAGTLMSGIIFIILTASGIREKIINAIPSELKFAVAAGIGLFIAFLGFQNAGIIVKNDAVLVGLGDLTKGTTLLAIFGVVTTIIFMIKKVNGAVFYGMILTAILGVATGLIDTPKAVVGAIPSLEPTFGAALTHFGDIFTVQMGIVIITFFFIDFFDTAGTLVAVANQAGLMKNNKLPRAGKALFADAIATVIGAILGTSTTTSYIESSAGVAAGGRSGFTAVVTAGFFLLALFFSPLLSVVTPAVTAPALIIVGILMVSSLGEIDWKKFEIAVPAFFTIISMPLTYSIATGIAIGFIFYPITMVVSGRRKEIHPIMYVMGVLFVLYFIYVRK

SEQ ID NO: 27174 - protein, 257 aa, Bacillus anthracis str. Ames 0581
MTKIFILASTLSLSFFSGLNIGNAATENFSPITNAIVQNNDYFVEGNSKDNNKPPGNGGSQDDSGSDGNGSDGSGSGDNGSGDNGSGGNGSGGNGSGENGSGGNGSGSSGSGDNGSGGNGSGGNGSGSSGSGENGSGGNGSGSSGSGENGSGGNGSGSSGSGENGSGGNGSGGNGSGGNSSGGSGSGGSGSQGGNRVKGDSSSQGGNGSQGGNVKDNAKKQGDKLPNTATHYPASILMGLSTFLIGMLLFIRRKNAK

SEQ ID NO: 27175 - protein, 309 aa, Bacillus anthracis str. Ames 0581
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 27176 - protein, 434 aa, Bacillus anthracis str. Ames 0581
MVVKFTKSEALHKEALEHIVGGVNSPSRSFKAVGGGAPIAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 27177 - protein, 430 aa, Bacillus anthracis str. Ames 0581
MFQLQKYNTSVKQEFLAGITTFFTFAYILVINPKILSDAGVPFDQAFTATIIATVVGTIGMAIFANYPIVIAPAMGMNAYFAYSVVQKAEGITYVIAFSAVFVTGIIFLLLSFTSFRQKLILAIPDSLKHAIAGGIGLFIAFIGLRLFGIIVDHPSNLVTIGDFHSPAVILTLIGLILAAVLMALRVSGALFISMIVTGVIAFFTGQLKFTDKIVAMPHLPEGIIVSNPINAFSDVIEYGLYGVVFSFLLVLLFDTTGALLGLIKQAGLITDNTEKRFGKAFIADAIGGTTGSIFGTSPTAATIESSAGIAAGGKTGLTGIVVVGLTIITAFFSPVIASLSSVAAITAPSLIIVGSLMAQSIRDINWNEFEDALPAFLIFVGIPLTSSIANGIAIGFLVYPVLKIVKGKGMEVHPLLYLFTILFGCHLFL

SEQ ID NO: 27178 - protein, 313 aa, Bacillus anthracis str. Ames 0581
MRNVFCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 27179 - protein, 244 aa, Bacillus anthracis str. Ames 0581
MISIQHLQKSFGDNTVLKHIDLTVEKGEVVVIIGPSGSGKTTFLRCLNVLETPNAGNIRIGDKELNFSQKVTKKDIVNLRTQTGMVFQHHNLFPHLTALQNVMEGLVTVKKMGKEEAKKKANYFLEKVGLADKVDLYPFQLSGGQQQRVGIARALAMEPEVLLFDELTSALDPELVQEVLKVMKELAKEGMTMVIVTHEMRFAHQIANRVIFMDGGVVVEQGTPEDVFTNPKEERTKKFLQMLQ

SEQ ID NO: 27180 - protein, 273 aa, Bacillus anthracis str. Ames 0581
MSAFLGELIGTALLIVLGGGVCAGVSLKKSFAKDSGWIVITMGWGLAVAVAAYVVGSISGAHLNPALTIGLAFKGAFPWGDVPGYIAAQMIGAIIGAVIVYLHYLPHWKETEDPGTKLGVFATGPAIPNTFANLLSEMIGTFVLVFGILAIGANKFADGLNPFIVGFLIVSIGLSLGGTTGYAINPARDLGPRIAHFFLPIAGKGGSNWKYAWIPVVGPILGGSLAGLFHQVVFEGKQNAALIYVIIATVIVLAISYMTSKKSGSNTNSRKVA

SEQ ID NO: 27181 - protein, 433 aa, Bacillus anthracis str. Ames 0581
MRVGKIHTRKLFICFCLAVVLFVPIHTFADEKREWRDEVIYSIMIDRFNNGEPKNDKQLEVGNLEGYQGGDIRGIIKRLDYIKEIGFTTVMLSPLFESVKYDGVDVRNFQKVNEHFGTENDVKELVQEAHTKGMKVILQFPLGENEQQVIDSMKWWVKEVDLDASYVMHSEKKSPAFWDDVQKDMQVIKKDFRVMTKEDSEYNEKIVESFSKADVSVKSLYDVSKKDEEFITFLDNQDTKRFARIAKENMNYPPSRLKLALTYLLTSPGIPNFYYGTEIALDGGDTPDNRRLMDFKSDEKFMQHITKLGELRQMRPSLRRGTFELLYDKNGMSVLKRKYKGEVTLVAINNTKETQKVALPASTIGEKQELRGLLEDEIIREENGKFYLVLKREESNVYKVNRETGVNWLFISLIVGVNVLFITFLIAVKKRRK

SEQ ID NO: 27182 - protein, 266 aa, Bacillus anthracis str. Ames 0581
MKEMKVIIAGPRGRMGHEAVLLMERTEHFNLVAAVDYKHGGEKISDLPGMPALDATIYADLHTCLEEVEADVLLDLTTPEVGKQHVTLAVERGLRSVIGTTGFTEEELKQLTETAKEKAVGTIIAPNFAIGAVLMMKFSQMAAKYFQDVEVIELHHDQKLDAPSGTAVKTVELIRQNRESKQQGHPNEVEQLEGARGANVDGIHIHSVRLPGLIAHQEVMFGGDGQMLTVRHDSFNRASFMSGVKLSIETVMNLDHLVYGLENIID

SEQ ID NO: 27183 - protein, 311 aa, Bacillus anthracis str. Ames 0581
MKYTKLQKAGLHISKLGLGTNAVGGHNLYADVNEEEGKQLIEEAMGQGITFFDTADSYGFGRSEELVGEVLKGKRHEIVLATKGGIQPLLNGEVYINNERSYLRNAVENSLRRLQTDYIDLYYLHFTNPETSYIDSIGELTRLKEEGKIRSIGISNVNVEQLKEANQHGHIDVVQSPYNMLDRTAGEELLPYCIESGISFIPYGPLAFGILGGKYTEDFKLNEGDWRQSVNLFEENTYKSNFKKVEKLKGVAKEEAVEVSHLALAWLLNKKGIDTVIPGGKRAEQIRESVRAVEVSLNENVMKEIESILED

SEQ ID NO: 27184 - protein, 345 aa, Bacillus anthracis str. Ames 0581
MNSELFSPYTIKDVTLKNRIVMSPMCMYSSENEDGQVTNFHLIHYGTRAAGQVGLVMIEATAVLPEGRISNKDLGIWDDSLIEGLHKTTTFIHDNGAKAAIQLAHAGRKAELETDALAPSAVPFNETMKIPVEMSIHQIKNTILAFQQAAIRSKQAGFDVIEIHGAHGYLINEFLSPLSNKRTDEYGGSPENRYRFLREIIDSINEVWNGPLFVRISANDYHPDGLTVQDYVQYTKWMKEQGVDLIDCSSGAVVPARIDVYPGYQVQYAKHIKEHANIATGAVGLITTGAQAEQILNNNEADLIFIGRELLRNPYFPRIAANELGFELEEPHQYERAPGKISTNK

SEQ ID NO: 27185 - protein, 328 aa, Bacillus anthracis str. Ames 0581
MKAIVVTSFGGSEVMKYTDVDIPAISEDQVLIRVVATSVNFADIKSRYGKKGNKALPFILGIDAAGIVERVGSHVKNIYPGQRVIAFPQNGSYAEYVVANENLTFVLPDEVDFQTAAACPIVSFTSYNLLANVARLQQGESVLIHAAAGGIGTTAIQLAKLLGAGTVIGTVGSEAKKEIALDAGADYVIGHQDEDFVEKVNELTNGEGVDVILDSISGTVSERSLKCLAYYGRLIHFGNASGEIGNFQTKDLHASCRSILGFSFGTTRKKRPELLQETANEVFRYLRDGHLQIKATKSFPLQDAGKAHEWVESRKSTGKVILTVQSSS

SEQ ID NO: 27186 - protein, 389 aa, Bacillus anthracis str. Ames 0581
MKSPNFQLSLQTSNLIIGFMVWVILSSLMPYIKVDIPLTAGQISMVTAVPVILGSVLRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 27187 - protein, 332 aa, Bacillus anthracis str. Ames 0581
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 27188 - protein, 477 aa, Bacillus anthracis str. Ames 0581
MKIVLRKESNIPYYKQIYMQIVERIQSGMLSHGDSLPSLRSMAEDLQINLLTVRKAYKHLEKKEYIRIEQGKGAYIHKHVKKDSKPIPYKWQQTKTINVMRSQYAMNQHRKYYDFSQAILYPRLLPNPFLADEMHKILNKDKMILATYGPVQGDYELRVEIANYLNEHQKLVTDPSQLLITSGAQQGIDLIAQTLLKPGDIVLVESPCYSAALDIFINKGAQIIPVSLDNHGVRSDLIDDICQSKNPVLLYTNPTFQNPTGTVMSKERRMELIELAELYEFFIIEDDSFGEIYFEDAIVPPPIKNFDTNGHVLYIKGFSKTLAPGLRIASLIADGPIFAWLYAVKGSMDIGSPLLTQKALLPFLRAERMKHHLEKLRTALQIRRDITIDMLSPLKEIQFEIPDGGFNLWITLPNSIDPFTLLQKANEVDVSFLPGTACLLHNDINNNQFRISYSMLNEKDMLIGLEKLHDTIRKFKL

SEQ ID NO: 27189 - protein, 494 aa, Bacillus anthracis str. Ames 0581
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 27190 - protein, 405 aa, Bacillus anthracis str. Ames 0581
MSDWFQLDKEYMMSTYCRTKIAIERGEGCKLYDVDGKEYLDLFSGVGVNVLGYNHPKIVQTTMDQVTKSLHLPFHFLNPVAIEYAKKLVDCSLKNGKVFFTNSGTEATETTLKLIDKYRAITNEEREGIVVLKNSFHGRTLGALHFTRQESVYQNFPTTSIPVYEVERENIEQLEETIINENPIAILLEPVLGSGGIYPLSREYLHGVQNLCDKYNVILIVDEVQSGMGRTGKLFAYQNFNITPHIIQIGKGAGGGIPLGGIIVGEKLCDVFAPGDHGTTFAHSSMGTALGLTVLNTLLDDGLMQEAYEMSLYLNDKLQEIQKENSYYIEEVRHAGMMFGISLNDTNENVKKLQVELMEKGILVDVTQGNIIRLLPPYIITKEEIDTFITQFIFCIDKVAAVVSA

SEQ ID NO: 27191 - protein, 1065 aa, Bacillus anthracis str. Ames 0581
MDKKVSAIPQPKTYGPLGNLPLIDKDKPTLSFIKLAEEYGPIFRMQTLSDTIIVVSGHELVAEVCDETRFDKSIEGALAKVRAFAGDGLFTSETQEPNWQKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEEYQLDVKQTLTLKPGDFKIRIVPRNQTISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKGDELKGVQYAVFGCGDHNWASTYQRIPRYIDEQMAQKGATRFSTRGEADASGDFEEQLEQWKQRMWSDAMKVFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFEPFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNVGEAHLYFGCRHPEKDYLYRTELENDERDGLISLHTAFSRLEGQAKTYVQHVIKEDRIHLISLLDNGAHLYICGDGSKMAPDVEDTLCQAYQEIHEVSEQEARNWLDRLQEEGRYGKDVWAGI

SEQ ID NO: 27192 - protein, 469 aa, Bacillus anthracis str. Ames 0581
MKSSIDSIQESKRLKNQQKEEKATWKAMSMFLVPLLLSNILQSVGQLFGMVVVGRWLGVNELAAISAFFPLFFLLVSFVIGIGSGSSILIGQAFGAHNEERLKAIVGTTLTFTFIIGVILAIVGNVFALNIMRLMGTPENIIDMSVHYARILFISMPVLFLYFSYTTFIRGTGDSKTPFYFLIVSTVLNIMLLPILIFGWVGIPKIGVYGAAYASVISTIITFIVMIIYLKKKNHPLQLDETVRKYLRMDWGLLKLLLRLGIPASINMILVSLSEIAVIAFVNRFGSDATAAYVVVNQVASYVQMPAVSLGITVSIFAAQSIGAKQFNRLQEVIRAGIVMNYIIGGILIAFIYLFSREILSLFLTSSNTIEIAHSLVMITLWSYLIFGHAQIIGATMRASGTVLWPTIIGVVSIWLVEVPVAYYLSYHTNLGIKGIWIGYPAAFIVSLLLQYGYYKLSWKKKRISRLVS

SEQ ID NO: 27193 - protein, 159 aa, Bacillus anthracis str. Ames 0581
MWKTTDLCDEFENELQICRQPFRSFGKKEQFHGKIATVKVKDDNVLVKEGLQTLPEGTVLVVDGGASTNCALLGDNLAAIAEERKLAGIIVNGYVRDSSELKNINIGILALGTMPNRSVKEGKGERNISLQFGQVEWKPDEYVYVDEDGVIISDKSLHR

SEQ ID NO: 27194 - protein, 488 aa, Bacillus anthracis str. Ames 0581
MQSPNLEALVGGEKRYSFQQYNERVNQLAHYLLHSGVQRGDRIGILCKNNHPFPSVMMASLKIGAVFIPLNHQLTVYELETIVKEAKLKVLVIDEEFSEVLLKVDAVKEIPYVIETTKEGFGSFELTLQEQPMTEPNVEVHEEDDAIYLFTSGTTGQAKACVIGHKNLHHYFDEIAGQREIPAGERFLSVHPLFHMSGVLSILNCIYHGVTMIFLADSNPTLIWDKIEEEKITTMLAFPAVYSYMLDELNKKERNISTFKVAQSGGTKVPETLIQKYMEKGIYMVQGYGSTEGWVVTSWHPMMGKEKMSSVGKALKNVEVKIVHPETGHELTTNEVGEIHVRSPYMFKGYWNNEKATKKVIKDNWFNMGDAGMIDDDGFLHIMGRYKDVIIRGGDNVYPDQVEDVIHEMHGVLEVAVVGVPDGFWGEIPRAYIVKDGETILTEESIIQYCKEKLASYKIPEVVFVEELPKNALGKVLKRELRDVVLVK

SEQ ID NO: 27195 - protein, 375 aa, Bacillus anthracis str. Ames 0581
MTSSNKKSASIYEGTNVNAWGSFENVAETKLFNSIQIGSWPLRNRIAMAPMTRCFADNETGAVGADVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQEVIGQYAQAAKNAIEAGFDGVEIHGAHGYLIDQFTYEFVNKRTDKYGGDLKQRLTFMKEVTEAVIEAIGADKTLLRFSAFKGDNPTYMWENPELAIETFVNMFKEVGLTMIHPSTMSYTQVIADGKNFHQLVRKYWDGAIVGVGNLNPKEAEEALQEGTIDVAAFGRPLIANPDFVHRIKSAESLVEYDAKEHLATLI

SEQ ID NO: 27196 - protein, 444 aa, Bacillus anthracis str. Ames 0581
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEIEWDIFRTQVHQWERDQYMSLY

SEQ ID NO: 27197 - protein, 214 aa, Bacillus anthracis str. Ames 0581
MIKIAPSILSADFSKLGEEIKDVEKGGADYIHVDVMDGHFVPNITIGPLIVEAIRPITSLPLDVHLMIENPDNYIPTFAKAGADIITVHVEACPHLHRTIQLIKSHGIKAGVVLNPHTPVSVIEHVLEDIDMVLLMTVNPGFGGQKFIHSVLPKIKQVAEMVKERNLEVEIEVDGGVNAETARLCVEAGANVLVAGSAVYNQKDRGEAIRVIRG

SEQ ID NO: 27198 - protein, 240 aa, Bacillus anthracis str. Ames 0581
MIKIENLHKSFGKNEVLKGITTTIEKGEVVAIIGPSGSGKSTFLRCMNVLEAPTNGHIWIGTEEVTNPKTNIMHVRENVGMVFQHFHLFPHMTVLENITYAPINVKGVTKQEAEKKAEKLLEKVGLLDKKDTYPNRLSGGQKQRVAIARALAMEPEVMLFDEPTSALDPEMVKEVLEVMKSLVTTGMTMAIVTHEMGFAKEVADRVLFLDGGKLVEDSAPAEFFAAPKSERAQQFLQKIL

SEQ ID NO: 27199 - protein, 371 aa, Bacillus anthracis str. Ames 0581
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLEFEEAIFGKELNVEIPVEDPCDTCKGSGAKPGTSKETCKHCSGSGQVSVEQNTPFGRIVNRQACSHCSGTGQMIKEKCTTCHGSGKVRKRKKINVKIPAGIDNGQQIRVSGKGEAGVNGGPAGDLYVVVHVRSHEFFEREGDHIICEMPLTFAQMALGAEVEVPTVHGKVKLKIPAGTQTGTEFRLKGKGAPNVRGYGQGDQYVVVRVVVPTKLTSHQKDLLREFAGQEEQDDSLFGKLKRAFKGE

SEQ ID NO: 27200 - protein, 429 aa, Bacillus anthracis str. Ames 0581
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTVHSDADIEATIAAAEIAMSKLKA

SEQ ID NO: 27201 - protein, 399 aa, Bacillus anthracis str. Ames 0581
MGKVKEISKRKLLGIAGLGWLFDAMDVGMLSFVMVALQKDWGLSTQEMGWIGSINSIGMAVGALVFGILSDKIGRKSVFIITLLLFSIGSGLTALTTTLAMFLVLRFLIGMGLGGELPVASTLVSESVEAHERGKIVVLLESFWAGGWLIAALISYFVIPKYGWEVAMILSAIPALYALYLRWNLPDSPRFQKVEKRPSVIENIKSVWSGEYRKATIMLWILWFSVVFSYYGMFLWLPSVMVLKGFSLIKSFQYVLIMTLAQLPGYFTAAWFIERLGRKFVLVTYLIGTACSAYLFGVAESLTVLIVAGMLLSFFNLGAWGALYAYTPEQYPTVIRGTGAGMAAAFGRIGGILGPLLVGYLVASQASLSLIFTIFCGSILIGVFAVIILGQETKQRELV

SEQ ID NO: 27202 - protein, 490 aa, Comamonas testosteroni
MKQYRNYINGEWVESARRFDDVNPVDGTVVAQVHEADREAVDSAIRAGHAAVRGAWGRTTVAERAAILCRIADEIDRRYDDFLAAEIADTGKPVAMASTIDIPRGAANFRVFADILKTAPLDTFQTDLPDGARALNYAVRKPLGVVGVISPWNLPLLLLTWKIAPALACGNAVVAKPSEETPGTATLLAEVMHTVGVPPGVFNLVHGFGPDSAGEFITTNDDIDAITFTGESRTGSAIMRAAATHVKPVSFELGGKNAAIIFADCDFEKMIDGMMRAVFLHSGQVCLCAERVYVERPIYNRFLDAFVERVKALKLGWPQDGTTGMGPLISAEHRDKVLSYFKLAREEGAQVLVGGGVPKFGDARDAGFWVEPTIITGLPQTARCIKEEVFGPICHVSPFDTEAEAIALANDTKYGLSATTWTGNLNRGHRVSEAMRVGLSWVNSWFLRDLRTPFGGVGLSGIGREGGMHSLNFYSELTNVCVRIDQEAVS

SEQ ID NO: 27203 - protein, 310 aa, Medicago truncatula
MEHINNEEIPSTPATPGTPGVPLFGGFKSERSGNGSNKYKKSLLKNCKCFGVQEWNLEDGALPTVTCSLMPPPPPVPLAKKIGAEFIGTLILMFAGAATAIVNQKTQGSETLIGCATSTGLAVMIIILSTGHISGAHLNPAVTISFAALKHFPWKHVPMYIGAQILASICAAFSLKAVFHPFMSGGVTVPSGGYGQAFALEFIISFNLMFVVTAVATDTRAVGELAGIAVGATVMLNILIAGPITGASMNPVRTLGPAIAANNYKAIWVYLLAPILGALGGAGTYTAVKLPEEDDNAKTNASSNHPSFRR

SEQ ID NO: 27204 - protein, 396 aa, Streptomyces coelicolor A3(2)
MTSMSSSARPLLNRRLAEFGTTIFAEMSALAVRTGAINLGQGFPDTDGPEEVREAAVRALRDGRGNQYPPGPGVPELRAAVAGHQQRRYGLSYDPDTEVLVTAGATEAIAAALLALLEPGDEVVALEPYYDSYAACIAMAGGTRVPVTLRPHEGTFRLDLDELRDAVTDRTRLLLLNTPHNPTGTVLTRDELAAIAELAVERDLLVVTDEVYEHLVFGTAEHIPLASFPGMRERTVTIGSAGKTFSFTGWKVGWVTAAPALLTAVRSAKQYLTYVASGPFQYAVAEALALPESYFAAYRQDMEAKRDLLAAGLAEAGFGVYRPAGTYFVTTDIRPLGERDGFAFCRSLPERAGVVAVPNAVFYNHREEGAPFVRFAFCKRLPVLEEAVGRLKTLSA

SEQ ID NO: 27205 - protein, 326 aa, Escherichia coli
MNIAIIGAGPAGIISARNAIKAGHSVVLFEKNTRIGGIWNPWSGGAYRNACMQNSRYTFHYTGFPPGDIDEFPGVEQVFRYLSAVAGEDALRESIRLNTEVVSLRKDAGHRVIRCASEGKDTEDIFDRVIIATGELWQPRRPPLPGEENFSGTLITSRDYQEPEAFKGKNILIIGGGVSGADIASDLVPFARSVSLSVKKMGLYLPRQFPTGPNDMMHSYLGRCLLSQMNYEDFIGYLDTMMPDYMQAYRASSLLPDMANNNAVHVNEKIIPNVAAGLIKVKPQAERFTGEGAIKFVDASQEKYDVIITCTGYEMPDYSFIRKRTA

SEQ ID NO: 27206 - protein, 442 aa, Arabidopsis thaliana
MAAILSVDFQNCFIFIVLCLFSLFCYSLFFKKPKHPRGCDLPPSPPSLPIIGHLHLLFSPLTHKSLQKLSSKYGHLLHLRIFNVPVILVSSASVAYEIFRAHDVNVSSRGVAAIDESLLFGSSGIITAPYGDYWKFMKKLIATKLLRPQSLESSRGIRGEELTRFYNSLLDKARMTESVEISTEAMKLVNNTLCRMSMGRSFSEENGEAEKIRGLVGESYALTKKMFLASLLRKPLKKLRISLFEKEIMGVSDRLDELLERILVEHEEKLHEEHQGTDMMDVLLAASGDENAEYNITRNHIKSFFVEIFIGATDTSVQTTQWTMAEILNHPNVLERLRKDIDSVVGKTRLIHETDLPNLPYLQAVVKEGLRLHPPGPLLVRTFQERCKIKGFYIPEKTTLVINAYAVMRDPDSWEDPDEFKPERFLRAPPMGGSLDKFIEFS

SEQ ID NO: 27207 - protein, 326 aa, Bacillus cereus G9241
MIKDYSVQIEGQEKVCLDQWVAHYRTYATKGRSASYIPALGEINVSQLGICIVKPDGTMIKSGDWEVPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLPFQDGCGIGIYGPAIDEYGNSLPGIMLLEHIAKEWDLSIF

SEQ ID NO: 27208 - protein, 1065 aa, Bacillus cereus G9241
MDKKVSGIPQPKTYGPLGNLPLIDKDKPTLSFIKIAEEYGPIFQIQTLSDTIIVVSGHELVAEVCDETRFDKSIEGALAKVRAFAGDGLFTSETHEPNWKKAHNILMPTFSQRAMKDYHAMMVDIAVQLVQKWARLNPNENVDVPGDMTRLTLDTIGLCGFNYRFNSFYRETSHPFITSMTRALDEAMHQLQRLDIEDKLMWRTKRQFQHDIQSMFSLVDNIIAERKSSGNQEENDLLSRMLNVKDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKNHETKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSKRGEADASGDFEEQLEQWKQSMWSDAMKAFGLELNKNMEKERSTLSLQFVSRLGGSPLARTYEAVYASILENRELQTSSSERSTRHIEVSLPEGATYKEGDHLGVLPINSEKNVNRILKRFGLNGKDQVILSASGRSVNHIPLDSPVRLYDLLSYSVEVQEAATRAQIREMVTFTVCPPHKKELESLLEEGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDEREGLISLHTAFSRLEGHPKTYVQHVIKEDRIHLISLLDNGAHLYICGDGSKMAPDVEDTLCQAYQEIHEVSEQEARNWLDRVQDEGRYGKDVWAGI

SEQ ID NO: 27209 - protein, 331 aa, Bacillus cereus G9241
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYIACAQEIMAQSFDQGIDFSSVVCVSGSGGMHAGLITGFAGTQSHIPVIGINVSRGKAEQEEKVAKLVDETSAHVGIPNFIPREAVTCFDEYVGPGYALPTPEMVEAVQLLAKTEGILLDPVYTGKAVAGLIDLIKKGTFKKEDNILFVHSGGSPALYANTSLFA

SEQ ID NO: 27210 - protein, 223 aa, Bacillus cereus G9241
MTSLLKLDKVSKVYGEGNTEVTALHPISLDVKAGEFIGIVGPSGSGKSTLLSIAGALLSPSKGDIYIREQNITQLSEKEMTDIRLKKIGFIFQFANLVPYLNVKEQLLYIAKLKKESKQESEKRADHLLAAFGLGERKNHYPNQLSGGEKQRVAIARAFMNNPDLILADEPTASLDSKRAREVVEMMKREVKESQKAAIMITHDERMLDVCDRILTLRDGQLI

SEQ ID NO: 27211 - protein, 159 aa, Bacillus cereus G9241
MWKTTDLCDEFENELQICRQSFRSFGKKEQFYGKIATVKVKDDNVLVKEGLQTLPEGTVLVVDGGASTNCALLGDNLAAIAEERKLAGIIVYGYVRDSSELKNINIGILALGTMPNRSVKEGKGERNISLQFGQVEWKPNEYVYVDEDGVIISEKSLHR

SEQ ID NO: 27212 - protein, 352 aa, Bacillus cereus G9241
MTIDRICTIGPASNNKETLAQLINNGMKIVRLNLSHGTHESHKDIIRLVKSLDDSIKILGDVQGPKIRLGEIKGEQITLQAGDSFILHTQPVTGSSTEASVDYEGIAHDVKVESRILMNDGEVELIVEKVSTDKIETKVKTGGNISSHKGVNLPGTIVSLPAITEKDKKDIQFLLEEGVDFIACSFVRKPRHIKEIRDFIKEHKETVPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPIESVKTLRLVSEFAEHVKKDGPFAMKDVLELLHKSLNE

SEQ ID NO: 27213 - protein, 297 aa, Bacillus cereus G9241
MQVGLIGLGKMGLNLGKNLMDHKHEVAAFDLNTSAVEEMKEYGAIGVSSLSELVQSLESPRILWVMVPHAVVDSVISEITPLLSKGDIVIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 27214 - protein, 472 aa, Bacillus cereus G9241
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIVFLAIVTISFYAFGIGKRPPLDVPNDQEISSK

SEQ ID NO: 27215 - protein, 332 aa, Bacillus cereus G9241
MKAMIIDKYGKVPMRMAEVPTPEINEYEVLAEIHAASINPIDFKIRDGKVKMLLKYEMPLILGNDFSGVITKVGSKVTRFKVGDEIYARPRKNKIGTFAEYIAIHEDDIALKPKNLSFEEAASIPLVGLTSYQALHDIMQLQKGQKILIHAGSGGVGTFAIQLAKIMGATVTTTASEAGANLVKSLGADEIINYKTEKFEDILKDYDAVFDTIGGTTLEKSFNIIKSGGNIVSVSGMPNARFGKEFGSGFFKTLLFSLASKKLTALEKKHNAQYSFLFMKPSGDQLRTIANYIESGKIKPVIDRVFPFEDAQKAMEYSEAGRAKGKIIVKMK

SEQ ID NO: 27216 - protein, 322 aa, Bacillus cereus G9241
MKVLEAISNIAGKYFAFCVICIAAIAYFIPAPFLGLTSYITILLGGVMFGMGLTLKAVDFKIIATKPLPVIIGVCAQFIIMPLVAYVLAYVMNLPAELAAGLVLLGSVPGGTASNVMVYLAKGNLALSIAMTSLSTLLAPIATPLILLLLAGQWMPVNAMSMFLSIVQVIIIPIILGLVVKKFFPKTVTKGMTVIPLISVVAIIIIVSAVVSANVSSITSSGLLIFIAVMLHNAFGFLLGYITAFILRLDEGTRRAISIEVGMQNSGLGVALATAHFGPAAALPSVLAAVWHNIAGPILATIWSKNAKNTFSDENVSVNIEK

SEQ ID NO: 27217 - protein, 433 aa, Bacillus cereus G9241
MFNLSKHKTSIKTEIMAGIITFLTMAYIIVVNPVILGDAGVPFEQAFTATIIAAVVGTLFMAIFTNLPIAIAPGMGLNAYFSYSVVKAHEGMTFAIAFSAVFVAGMILILLSFTSFRTKLMEAIPENLKHAITAGIGLFIAFIGLRLTGIVTKNEANLVGLGDLHSAPVLLALAGLGITIVLMSLNVNGALFIGMLLTGIIAFFTGQLSFSNGVTSMPGLPEGIIVSNPITAVSDVINYGLYGVVFSFFLVTLFDTTGTLLGVAQQGGFMKDGKLPKAGRALLSDSFSATIGSMFGTTPSTAYIESSAGVAAGGRTGLTTITVAVLFALAAFFGPLVSAVSGVSAITAPSLIIVGSLMMGSVRHIDWDAFDEAFPAFLVILSMPLTSSIATGIALGFISYPLMKVAKGKFRAVHPLVYVFGILFAYQLIFLPH

SEQ ID NO: 27218 - protein, 479 aa, Bacillus cereus G9241
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVGLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 27219 - protein, 244 aa, Bacillus cereus G9241
MISIQHLQKSFGDNTVLKHIDLSVEKGEVVVIIGPSGSGKTTFLRCLNVLETPNAGSIRIGNKELDFSQKVTKKDIVNLRTQTGMVFQHHNLFPHLTALQNVMEGLVTVKKMGKEEAKKKANYFLEKVGLADKVDLYPFQLSGGQQQRVGIARALAMEPEVLLFDEPTSALDPELVQEVLKVMKELAKEGMTMVIVTHEMRFAHQIANRVIFMDGGVVVEQGTPEEVFTNPKEERTKKFLQMLQ

SEQ ID NO: 27220 - protein, 289 aa, Bacillus cereus G9241
MLRDLFVKKKKYAAIPSEQVRKDVPDGVMTKCPKCKKIMYTKELLKNLKVCVNCGYHHPMNAWERLDSILDEGSFREYDKEMVSLNPLEFPGYEEKLESDRKKTELNEAVVTGEGTIDDMLVVVAVMDSRFRMGSMGSVVGEKIARAVEKAYDLQVPFIIFTASGGARMQEGILSLMQMAKTSVALKKHSNAGGLFISVMTHPTTGGVSASFASLGDYNLAEPGALIGFAGRRVIEQTVREKLPEDFQTAEFLLEHGQLDAVVHRDDMRESLRKILEVHQGGEMAVWQS

SEQ ID NO: 27221 - protein, 307 aa, Bacillus cereus G9241
MEIKNSITELIGKTPVVKLNHIVKGNVADIYLKLEFMNPGSSVKDRIALAMIEDAEKKGVLKKGDTIIEATSGNTGISLAMIAAAKNYKSILVMPDTMSVERRNLLSAYGAKLILTPGHEGMSGAIQKANELAKINGYFIPQQFKNQTNPEIHRLTTGPEIVEQMGNQLDVFIAGVGTGGTITGAGSFLKEVYKDIKICAVEPADSPVLSGGKPKKHQLQGIGAGFVPETLDVRVYDEVIQVRADQAFEYARKVACKEGILLGISAGAAIYASVKIAKKIGRGKKILTIIPSNGERYLSTMLYRFEQ

SEQ ID NO: 27222 - protein, 469 aa, Bacillus cereus G9241
MEKLQIGVVGVGVMGKSLALNFESKGYSVALYDISKEKVDEIIEENRGKKLVGTHIVEEFVKSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 27223 - protein, 330 aa, Bacillus cereus G9241
MDIKISGLEKAFGKTQALKPLQIVMKQGEFTTLLGPSGCGKTTLLRMIAGLEEPDKGEIYFGDTCMYSGAKKIKTSPHERNIGMVFQDFALWPHMTVFENVAFGLRATKQTNHLREKVEDAIKRVRLQGMEKRYPHELSGGQQQRVAFARAIVTKPHFILFDEPLSALDAILREEMRLELMDIVHSISLTALYVTHDQTEAMSMSDQIIVMKQGEVLQKGTPEDIYVKPCHEFVAKFVGKANWLVEGKQMVRPEHVSWTKNEVCEMYTGEVQHVTYVGERYEVKVNMGTLGIWTAYHNSKPSIGKPVALYVPKKYIHHIGGESYEEIQFA

SEQ ID NO: 27224 - protein, 469 aa, Bacillus cereus G9241
MKPPTDNNKEGAESQKLESESKPIWKSMSMFLVPLLLSNVLQSVGQLFGMVVVGRWLGVNDLAAISAFFPLFFLLVSFVIGIGSGSSILIGQAFGAKNEDRLKAIVGTTLTFTFIIGVVLAIVGSIFAMDIMRLMGTPENIIEISVHYARILFISMPVLFLYFAYTTFMRGTGDSKTPFYFLIVSTALNMILLPILIFGWLGAPKLDVYGAAYASVISTVITFIVMLVYLKKKNHPLQLDSTVRKYLRMDGELLKLLLRLGIPASINMILVSLSEIAVIAFVNRYGSDATAAYGVVNQVASYVQMPAVSLGITVSIFAAQSIGANQFDRLQKVVKAGIIMNYVIGGVLISLIYLFSRDILSLFLTSQTTIEIAHSLVMITLWSYLIFGHAQIISATMRASGTVLWPTVIGVVSIWLVEVPVAYYLSYHTSLGIEGIWIGYPAAFIVSLLLQYAYYKLSWQKKRIKRLVS

SEQ ID NO: 27225 - protein, 305 aa, Bacillus cereus G9241
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYVAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 27226 - protein, 345 aa, Bacillus cereus G9241
MKAVVVNKNSKANIEVIEKELRPLHSGEALVDVEYCGVCHTDLHVANHDFGNTDGRILGHEGIGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSNIKPGQPIVIYGCGGLGNLAIQYAKNVFGAKVIAVDINDDKLALAKEVGADMTINPISQGPADKIVQDEFGGAYAAVVTAVSKVAFNSAVDAVRACGKVVAVGLPVETMDLNIPRLVLDGIEVVGSLVGTRKDLEEAFMFGAEGKVVPVVQTCSLDRVQNVFEEMEQGRIQGRMVIDFKQHNCDCK

SEQ ID NO: 27227 - protein, 474 aa, Bacillus cereus G9241
MKKHLYINGDWKSVNTYKPLYAPYSEETLAEIAQGTEEDVKEAVTAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPKGALNIISGPGSTVGEAIVTNDDVASITFTGSPKVGIGIKAKAGLKRVTLELGSNAAVIIDKDVELTDELIERVKWGAFVNNGQVCISVQRVFVHEERMDEFLSKLQKAMETLVVGDPLIEETDVSALISKKDVDRIDNWVQEAVKEGANVLYGGNKRDERIFEPTVLTNVPKHVSVQCQEVFGPLMTVNTFKEFDEAIEQANHSRYGLQAGVFTNNLFKAMRAIDELEVGGVMINDIPTFRVDHMPYGGVKESGTGREGIKYAIEEMTEMKLVCIKK

SEQ ID NO: 27228 - protein, 436 aa, Bacillus cereus G9241
MRDYLIKPLVGQPYPMISHGKGVYLYDQNGNKYFDGSSGAITAGIGHGVKEIADVIKKQAEEIAFVYRSQFTSEPAEKLAKKLSDLSVGDLNWSFFVNSGTEANETAMKIAIQHFQERGIQGKHKILSRWMSYHGITMGALSMSGHPLRRQRFVSILEDYPTIPAPYCFRCPVQKVYPTCQLACATELERSIERIGAEHIAAFIAEPIIGAAGGAVVPPKEYYKVIKDICSHYDILFIADEVMTGLGRTGAWFAMEHWGVEPDIMTLGKGLGAGYTPMAATVVSDRVMEPILRGSRSVMSGHTLSANPLSAATALAVIEYMEKHNLPEKTAEKGEYLIKGLQKVQQQSTIIADVRGKGLLIGVELQPFTKASELISVAAKNGLLLYQAVSGQAGKEDSALLVAPPMTTTYSELDELLSIFAKSVEEMMQKGGHSIA

SEQ ID NO: 27229 - protein, 232 aa, Bacillus cereus G9241
MTTITNTFSKLKEIEEVISLFHDDMTLMFGGFGGIGSPPSLIQAILEKGVTNLNLIGNDTGFPDVGIGRLVTNERVKSLITSHIGSNPNAGRQLNEGRLQIEFSPQGTLAERIRAGGVGLGGVLVDVGVDTIVEEGKRTVEMNGKTYLVETALTAEVAIVYAKKADPFGNLVFDKSARNMNPHVAMAGEITIVEAEEIVPLGSLDPEEIVVPGVFVNYIVPSEGVNWKWVWA

SEQ ID NO: 27230 - protein, 296 aa, Bacillus cereus G9241
MKKIGFIGLGNMGLPMSKNLVKSSYTVYGVDLNKDAEASFEKEGGIIGLSISKLAETCDVIFTSLPSPRAVEAVYFGQEGLFENSHSNVVLIDTSTVSPQLNKQLEEAAKEKKVDFLAAPVSGGVIGAENRTLTFMVGGSKEVYEKTESIMGVLGANIFHVSEQIDSGTTVKLINNLLIGFYTAGVSEALTLAKKNNMDLDKMFDILNVSYGQSRIYERNYKSFIASENYEPGFTVNLLKKDLGFAVDLAKESELHLPVSEMLLNVYEEASEAGYGENDMAALYKKVSEQLISNQK

SEQ ID NO: 27231 - protein, 392 aa, Bacillus cereus G9241
MKLFKPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPICFTNPGDTILVPDPGYPDYLSGVALAKAQFETMPLIAENKFLPDYTKIDDSIADRAKLMFLNYPNNPTGATASKDFFDETIQFANKHNILVVHDFAYGAIGFDGQKPVSFLQADGAKDTGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 27232 - protein, 292 aa, Bacillus cereus G9241
MEHKNVSIGFIGIGVMGKSMVRHLMQDGYKVYVYNRTKAKTDSLVQDGANWCDTPKELVKQVDVVMTMVGYPHDVEEVYFGIDGILENANEGTIAIDFTTSTPTLAKRINETGKSKNIYTLDAPVSGGDVGAKEARLAIMVGGEKEIYDKCLPLFEKLGTNIQLQGPAGSGQHTKMCNQIAIASNMIGVCEAVAYAKKAGLDPDKVLESISTGAAGSWSLSNLAPRMLKGDFAPGFYVKHFMKDMKIALDEAEKLRLPVPGLSLAKELYEELMKDGEENSGTQVLYKKYIRG

SEQ ID NO: 27233 - protein, 266 aa, Bacillus cereus G9241
MKEIKVIIAGPRGRMGHEAVLLMERTEHFNLVAAVDYKHGGEKISDLPGMPALEAPIYADLHTCLEEVEADVLLDLTTPEVGKQHVTLAVERGLRSVIGTTGFTEEELKQLTETAKEKAVGTIIAPNFAIGAVLMMKFSQMAAKYFQDVEVIELHHDQKLDAPSGTAVKTVELIRQNRESKQQGHPNEVEQLEGARGANVDGIHIHSVRLPGLIAHQEVMFGGDGQMLTVRHDSFNRASFMSGVKLSIETVMNLDHLVYGLENIID

SEQ ID NO: 27234 - protein, 449 aa, Bacillus cereus G9241
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEEFKGKGEYEFFRHINTFGGNPAACALALKNLEIMENENLIERSAQMGSLLLEQLKEEIGEHPLVGNIRGKGLLVGIELVNDKETKEPIDNDKIASVLNACKEKGLIIGRNGMTTAGYNNVLTLAPPLIISSEEIAFVVGTLKTAMERI

SEQ ID NO: 27235 - protein, 451 aa, Bacillus cereus G9241
MEATEKLREKPIKSLFISYLIPAVLGMVLMSVNIVIDAVMISRGVGANGLAGVNVAIPAFSIFFSISLWIGMGGATLYSIALGENKIERARSIFTQSMTVAVIIVGVLAAICLWRIEDLAYLFGANEVILPYALDYLHVLLTFGMIYVLENILSTFIRNDGNPNLAMAGLVVTAVLNIVFDYIFIFIFKWGVTGAASATILSAAIGFLVLLTHFLRKSSILKWTKFHFEWDTVKQIMIIGFPSFTAESTVAIVTIGFNIAFVQYAGEVGVASYAMVNSIHAMTLLLFFGVGAALQPIASFHYGANLAERLREGLQFAVKIAVVLGGVAIIVGLFFGKYIIGLFDVQSPELLELTLTGISLFFIQYVFLGYNIVYGEYFQSVRQTTKSVLIIMSRGLLFIIPLLWIMPKLFGINGIWLVMPVAEVLTAIIVFTMNRMKHPVPLNMAGEKEAI

SEQ ID NO: 27236 - protein, 455 aa, Bacillus cereus G9241
MNISSIVNKQKEYFHNGHTRSVEVRKNNLKKLYEGIQRFEQEIFQALKLDLNKSGHESFTTEVGYVLKEISFQLKHISSWSKPKRVRTALTHFGSKGKVVPEPYGVTLIIAPWNYPFQLAIAPLVGALAAGNTIVLKPSELTPNVSKVLTRMLEELFQEELVAVVEGGVEESTALLKEPFDYIFFTGSVSVGKVVMEAAAKQLTPLTLELGGKSPCIVHKDAKIDVTARRIVWGKFLNAGQTCVAPDYMYVHASVKEQLIEALRHEIAEQYGKEPLHNDNYVRIVSERHFERLCRFLQDGQVVIGGNYKKDTLHIEPTVVTNITWQDAVMEDEIFGPILPIVEYDNIEDVIDIIQQHPKPLALYVFSEDKEVQKKVTSNISYGGGCINDVVYHLATPYLPFGGVGSSGLGSYHGEESFRTFSHYKSILAQSTAFDMKIRYSSTKSALKFIRKLLK

SEQ ID NO: 27237 - protein, 454 aa, Bacillus cereus G9241
MKETNSLSQKLKQFVLLFFPIFVTQMSLFAMSFFDTTMSGHASPIDLAGVAIGTSIWIPVSTGLTGILMATTPIVAQLVGSKKKEDVPHVVIQAVYLAIFASLVVILIGFFTVTPILNGMRLEEPVERIAAQFLSIIAIGIIPLFTYTVLRGFIDALGKTRTTMIITLLSLPINVVLNYVLIFGNFGFPKLGGVGAAIASAATYWCILIITVIIIRTKEPFASFHIFKQLYRPSLSSWKEFLKLGVPIGFAIFFETSIFAAVTLMMSNFSTTTIAAHQAAMNFASLLYMTPLSLAMAMTISVGFEVGAKRYNNAKQYGFIGIGLALAFALLYSILLYFFDDEIASIYTTDIQVHHLAKEFLIFAILFQISDAIATPVQGALRGYKDVNVALIMTLIAYWVIGLPLGYILATYTDWAAKGYWIGLIISLAFGATFLLVRLFQVQKKYTTEDRRSR

SEQ ID NO: 27238 - protein, 101 aa, Bacillus cereus G9241
MKPNFSKGLLPAVVIEEGTKEVLMLAYMNEDAYKKTLETKRTWFYSRSRRALWNKGETSGNVQHVQSLYLDCDQDAIVVVVKQVGPACHTGEKTCFHYKII

SEQ ID NO: 27239 - protein, 323 aa, Bacillus cereus G9241
MAKILVAGKIPEIGLELLKDHDVEMYDKEGLISLDELTERVKDKDALLSLLSTKVTKEVIDAASNLKIVANYGAGYDNIDYLYAGEKGIAVTNTPKVSTEATAELTFALLLAAARRIPEGDTLCRTTGFNGWAPLFFLGREVHGKTIGIIGLGEIGKAVAKRAKAFGMNVLYTGPNRKPDAESELEATYVTLEELLQTADFITINCAYNPKLHHMIDEEQFKMMKKTAYIINASRGPIMHEAALAHALKTNEIEGAALDVFEFEPKITEELKGLKNVVLAPHVGNATFETRDAMAETAVRNILAVLNGEEPVTPINQKVFVTK

SEQ ID NO: 27240 - protein, 307 aa, Bacillus cereus G9241
MNVYRGVHELIGHTPIVEITRFSLPEGVRLFAKLEFYNPGGSVKDRLGRELIEDALEKGLVTQGGTIIEPTAGNTGIGLALAALQHDLRVIVCVPEKFSIEKQELMKALGATVVHTPTEQGMTGAIAKAKELVNEIPNSYSPSQFANEANPRAYFKTLGPELWDALNGEIDIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 27241 - protein, 283 aa, Bacillus cereus G9241
MIRVGYLGPEATFTNMAVSRFFPEAEHVPYRTIPDCIDAAANGNVDYAVVPLENAIEGSVNITVDYLVHEQPLSIVGEITVPIQQHLLVHPQYAEVWEEVYAVHSHPHAIAQCHKFLNEELKGITARDMTSTSAAAQYVKEHPEEKIAAIANEAAAEKYGLTIVRRSIHTHKNNHTRFLVLHKKKKAILSNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 27242 - protein, 429 aa, Bacillus cereus G9241
MKKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 27243 - protein, 311 aa, Bacillus cereus G9241
MKYTKLQKAGLNISKLGLGTNAVGGHNLYADVNEEEGKRLIEEAMGQGITFIDTADSYGFGRSEELVGEVLKGKRHEIVLATKGGIQPLLNGEVYMNNEPSYLRNAVENSLRRLQTDYIDLYYLHFTNPETSYIDSIGELTRLKEEGKIRSIGISNVNVEQLKEANQHGHIDVVQSPYNMLDRTAGQELLPYCIESGISFIPYGPLAFGILGGKYTEDFKLNKRDWRQSVNLFEENTYKSNFKKVEKLKDIAKEKDLELSHLALAWLLKQKGIDTVIPGGKRAEQIRESVRAVEVSLNEDVMKEIESILED

SEQ ID NO: 27244 - protein, 300 aa, Bacillus cereus G9241
MERVQMAETLEFSRIIQGFWRLAEWNMTKQELLSFIEDCMDMGITTFDHADIYGGYTCEGLFGEALQLKPSLRENMQIITKCGIAPPSPKFPERYVAHYNTSAKHIIQSAEASLENLHTDYIDVLLIHRPDPFMDPNEVAEAFSRLKQEGKVRHFGVSNFLPSQFNMLSSYLDFPLITNQIEVSALQLEHFEKGTIDLCQEKRINPMIWSPLAGGEIFTGQSERTVRVRETVQKVATELGVTSIDTVMYAWLLAHPAKMLPIIGSGQLDRVKAATLATKVNLDRQQWFTIFESSNGHPVP

SEQ ID NO: 27245 - protein, 345 aa, Bacillus cereus G9241
MHSKLFSPYTIKDVTLKNRIVMSPMCMYSAENEDGQVTNFHLVHYGTRAAGQVGLVMIEATAVLPEGRISNKDLGIWDNSLIEGLHKTTTFIHDNGAKAAIQLAHAGRKAELETDALAPSAIPFNETMKMPIEMSKHQIKDTVLAFQQAAVRSKQAGFDVIEIHGAHGYLINEFLSPLSNKRTDEYGGSPENRYRFLREIIDSINEVWNGPLFVRISANDYHPDGLTVQDYVQYTKWMKEQGIDLIDCSSGAVVPARIDVYPGYQVQYAKHIKEHANIATGAVGLITTGAQAEQILNNNEADLIFIGRELLRNPYFPRIAANELGFELKEPYQYERAPGKISTNK

SEQ ID NO: 27246 - protein, 160 aa, Bacillus cereus G9241
MTVYDFSAKTITGEDKSLKDYEGKALLIVNVASKCGFTPQYKGLQEVYDKYKDQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 27247 - protein, 389 aa, Bacillus cereus G9241
MKSPNFQLSLQTSNLIIGFMVWVILSSLMPYIKVDIPLTAGQISMVTAVPVILGSVLRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLATFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 27248 - protein, 450 aa, Bacillus cereus G9241
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGREDFGTSELEENPAYQYAVVRNALYNKGKTIEMLVNYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 27249 - protein, 330 aa, Bacillus cereus G9241
MHDKAKGDGIVKPKVYIAEPVPTFVENYLSEHCDYEKWEQNEKVPRDVLLEKIQDKDGLLNFGSAINEELLEAAPNLKVVSNISVGYDNFDLQAMAKHNVIGTNTPYVLDDTVADLVFALMLSAGRRVCELDSYVKNGEWNAEIGKEHFGLDVHHRTIGIIGMGRIGEAVAKRAKFGFDMNVLYYNRRRKEEAEQKFDATYCDLQTLLKQSDFIVLLTPLTDETYHLIGEKEFLLMKETAIFINASRGKTVDEEALIHALAEKKIFAAGIDTFTQEPIQKDNPLLSLQNVVTLPHIGSATLKTRQQMAMTAAENLVAGLQGKTPPNIVRG

SEQ ID NO: 27250 - protein, 434 aa, Bacillus cereus G9241
MVVKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAEKHNIDITLNRLKGALTVYFTTNTIEDYDAAQDTDGEMFGKFFKLMLQEGVNLAPSKYEAWFLTTEHTKEDIEYTIEAVGRAFAALANNK

SEQ ID NO: 27251 - protein, 487 aa, Bacillus cereus G9241
MTYYKDDSYALHTDLYQINMAYTYWKDGIHNRRSVFDLYFRKLPFENGYAVFAGLEKIVEYIENFSFTESDIAYLAELQFEEEFLHYLQNMKFTGTVRSMQEGEVVFNNEPLLRVDAPLGEAQIIETALLNIVNYQTLIATKAARMKHAANNDELLEFGTRRAHEFDAALWGTRAAFIGGFSSTSNVRAGKRFGIPVAGTHAHSFVQAYRDEYVAFKKYAETHKKCVFLVDTYDTLKSGVPNAIRVAKEFGDRIDFYGIRLDSGDMAYLSKKARKLLDEAGFTNTKIIASSDLDEYTIMHLKSQGAKIDVWGVGTKLITSFEQPALGAVYKLVAIEDTDGKLNDTIKISSNPEKITTPGLKRIYRIINRVNDHAEGDYIALDCEEPGKEERLKMFHPVHTYISKFVTNFEARELHKDIFVNGERTYELPGILDIQKYNEQSLALFWEEYMRTLNPEEYPVDLSQECWDHKMNYIQTVREQVEKKIQK

SEQ ID NO: 27252 - protein, 339 aa, Bacillus cereus G9241
MTKIFILASTLSLSFFSGLNIGNAATENFSPVTNAIVQNNDYFAEGNSKDNNKPPGNGGSQDDSGSGGNGSGGNGSGGSGSGGSGSGGNDSGGNGSGGNDSGGNGSGGNGSGGNGSDGSGSGGNGSGGNGSGGNGSGGNGSDGSGSGGNGSGGNGSGGNGSSGNGSGGNGSSGNGSDGSGSGGNGSGGNGSGGNGSGGNGSGGNGSDGNGSGGNSSDGNGSGGNSSDGSGSGGNGSGGNGSGGNGSGGNSSGGNGSGGNRRKGDSSSQGGNDSHGGNRVKGNSSSQGGNGSQGGNVKDNAKKQGDKLPNTATHYPASILMGLSTFLIGMLLFIRRKNAK

SEQ ID NO: 27253 - protein, 473 aa, Bacillus cereus G9241
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 27254 - protein, 431 aa, Bacillus cereus G9241
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 27255 - protein, 240 aa, Bacillus cereus G9241
MNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 27256 - protein, 394 aa, Bacillus cereus G9241
MNKKSIRDVDLKGKRVFCRVDFNVPMKEGKITDETRIRAALPTIQYLVEQGAKVILASHLGRPKGQVVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 27257 - protein, 441 aa, Bacillus cereus G9241
MKRYFQFDELGTNYKTEFIAGLTTFLSMAYVLFVNPATLSLGNVKGLPAGTGMDPGAVFVATALAAAIGSLIMGIFAKYPIALAPGMGINAFFAYTAVLTMGIPWQTAIAGTLMSGIIFIILTASGIREKIINAIPSELKFAVAAGIGLFIAFLGFQNAGIIVKNDAVLVGLGDLTKGTTLLAIFGVVTTIIFMIKKVNGAVFYGMILTAILGVATGLIDTPKAVVGAIPSLEPTFGVALTHFGDIFTVQMVIVIITFFFIDFFDTAGTLVAVANQAGLMKNNKLPRAGKALFADAIATVIGAILGTSTTTSYIESSAGVAAGGRSGFTAVVTAGFFLLALFFSPLLSVVTPAVTAPALIIVGILMVSSLGEIDWKKFEIAVPAFFTIISMPLTYSIATGIAIGFIFYPITMVVSGRRKEIHPIMYVMGVLFVLYFIYVRK

SEQ ID NO: 27258 - protein, 319 aa, Bacillus cereus G9241
MKKIGIITIVVLILLAIVYMLVGNYFYNYALNAKQEKEFLEDNPHLVETVNASGDALATNEEKNANFVSKYKPNTLTIRSFDKLNLTGYEYMNEQSSHKWAIVVHGYNGRASEMTKYIRNFYEQGYNVIAPDLRGHGNSEGDYVGMGWHDRKDILIWIQQIVKKDPNAEIALFGVSMGAATVMMTSGEDLPSNVKVIIEDCGYSTVVDEFTYQLKDLFHLPKFPVMNAANTVTKLRAGYDLEEASAIKQVAKSKTPMLFIHGDADTFVPFEMLDEVYNAAKVEKEKLIVSGAGHGEAEKIDSNTYWNTVWKFVGRYIQA

SEQ ID NO: 27259 - protein, 488 aa, Bacillus cereus G9241
MDQSVSYDQLNKMVTRFSSNLAEMGIGKGDNVALVVGNSPHFLVGLYGTMKAGATVIPVNPIYTADEMHYILQNGDVKTIIVLDVLLPVIQSLTTRLPSLENIIICETSSDFNHTETEKMKTFTRMIGAGDLTYEGPELDEEDVAVILYTSGTTGKPKGAMLTHKNLYSNASDVASYLQYTADDRVVAALPMFHVFCLTVAVNAPIVNGATILMLPKFSPKEVFRICRTYEPTIFAGVPTMYNYLYLFEEASAEDVKTLRLCISGGASMPVALLQNFEQRFDVIVSEGYGLSEASPVTCFNPLDRPRKPGSIGTNIWHVENKIVNELGEEVPVGAVGELIVRGPNVMKGYYNAPEDTAATLKDGWLYTGDLAKMDEEGYFYIVDRKKDIVLVGGYNVYPREVEEVLYTHESVAEVVVIGVPDENLGEAVRAYVVLKQTNVTEEELMHYCTLHLAKYKVPKSIEFLTELPKNTTGKLLRRALREKAMQV

SEQ ID NO: 27260 - protein, 251 aa, Bacillus cereus G9241
  misc_feature (12)..(12): Xaa can be any naturally occurring amino acid
DFAGGNVVHITXGVAGLVLAIFLGKRKNINGSSPHHLPFTMLGAGLLWFGWFGFNVGSALSLNDVALTAFINTNIAAAASALTWMLSEWFFQSKPTAMGAACGVVSGLVAITPACGFVTPFSALLIGAIGGVLCFGAVFFLKTKFGYDDTLDAFGCHGIGGTWGGIATGLFATTTVNGDGANGLFYGNASLLLKQLVAIGATYAFTIIMTYAIIKAINFFLPVRVDEHEEHMGLDISMHGEKAYEYTERVN

SEQ ID NO: 27261 - protein, 494 aa, Bacillus cereus G9241
MLTKNIELKPKVKAFLNEEIKMFINGEFVPSISGKTFETYNPATEDVLAVVCEAQEEDIDVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPDGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATIAAGGERAFEKGYFVQPTVFIDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 27262 - protein, 399 aa, Bacillus cereus G9241
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKDNDFLPNLELIPEEIADQAKMMILNFPGNPVPAMAHEDFFKEVIAFAKKHNIIVVHDFAYAEFYFDGNKPISFLSVPGAKEVGVEINSLSKSYSLAGSRIGYMIGNEEIVGALTQFKSNTDYGVFLPIQKAASAALRNGAAFCEKNRAIYQERRDTLVDGFRTFGWNVDKPAGSMFVWAEIPKGWTSIDFAYALMDRANIVVTPGHAFGPHGEGFVRIALVQDKEVLQQVVENIRNSGIFALEKVDELVKN

SEQ ID NO: 27263 - protein, 375 aa, Bacillus cereus G9241
MTSSNNKAASIYEGTNINAWGSFENIEETKLFDPIQIGSWSLRNRIAMAPMTRCFANHETGVVGADVVEYYRKRAADGVGFIITEGIVISPRAKGNPGVPGIYTQEQIDSWKPVTEAVHKEGGTIIAQIWHVGRMSHHEIIGGKMPQAPSAIAAEGNVPRFRKPFDTPEAMTLEEIQEVISQYAQAAKNAIEAGFDGVEIHGAHGYLIDQFTYEFANKRTDKYGGDLKQRLTFMKEVTEAVIEAVGADKTLLRFSAFKGDNPTYMWENPELAIETFVNMFKEVGLTMIHPSTMNYTQVIADGKNFHQLVRKYWDATIVGVGNLNPKEAEEALQEGTIDVAAFGRPLIANPDFVHRIKHAESLVEYDAKEHLATLI

SEQ ID NO: 27264 - protein, 300 aa, Bacillus cereus G9241
MIKDWEEGVEIFGAALIGAPLSKPSISHSGASFAPKTIRAMLDAYSTYAITEEHDMKESVLYDCGDITMHVTDIQESHNRIAKTVSHVTKVNPNMIPIVLGGDHSISFPSITGFANSKGKIGIIQFDAHHDLRNLDDGGPSNGTPFRSLLENDIITGKQLVQIGIRNFSNARAYHEYAKEHGVTVYTMKDVREREIKDIMTESIEVLRKQGVTSIYISLDMDVLDQAFAPGCPAIGPGGMDSMTLLDAIEFLGKEPLVQGMDIVEIDPTLDFRDMTSRVAAQVIMSFLLARETVRKQVSI

SEQ ID NO: 27265 - protein, 243 aa, Bacillus cereus G9241
MLIEFRNVNKYYGNFQVLKDINVQVKKGEVVVVVGPSGSGKSTLLRCINQLESITDGELIVQNTEVHNAKTDMNELRRNIGMVFQHFYLYPHKTVLQNITLAPIKVNKISKEEAEKTAMFYLEKVGIPEKASVYPHQLSGGQQQRVAIARGLAMQPEIMLFDEPTSALDPEMIGEVLDVMKTLAKEGMTMVVVTHEMGFAREVADRILFMDDGKIIEDTTPAQFFASPEQERARLFLSRVLNH

SEQ ID NO: 27266 - protein, 475 aa, Bacillus cereus G9241
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 27267 - protein, 449 aa, Bacillus cereus G9241
MFFTQFFKPAPHAERLPADRIDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFADDWKSIFYFPGILSILVGIYVLITMKDTPQSCGLPSIEEHTGEYPPDEKVKDRERELSVKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSAKQKQA

SEQ ID NO: 27268 - protein, 429 aa, Bacillus cereus G9241
MKGILERTFKLGLHETSPKQEVLAGVTSFFTIVYIMIVNASILSDAGIPLEAGILATVFSSFVGCLLMAFWANAPAILVPGMGVNAFFTYTAVHTLGLTWQEALAAVFISGIIFAIAAFTPIARVLSVSIPKSLKEAITVGIGLFLAFIGLQKGGLVVSNPNTAVAMGKLSNPVVLATVLTLIVALVLFIRNVRGNFLWTIAIGTGIAWIFGLVDTSQIGNSSFSFANYGDVFGAMSFGKLSSLPFWIATFSLSMVLIFENMGLLHGLLEDDRKFPRAYQANAISAMTCGLFGTSPTVSTVESAAGITAGGKTGLTSIVTGLLFFASLFALPFVKLIPDSAIAPILIIIGGLMITSIQQIPLNDFSEGFPAFLIIVMIPLTYSIADGIAFGFIAYPILKVALGKRKEVAPSMYIITCLFLAMFVLHAIG

SEQ ID NO: 27269 - protein, 304 aa, Bacillus cereus G9241
MKKRQLGNSDLFVTEMGLGCMSLGTSETEAMRIIDEAIDLGINFFDTADLYDYGLNEEFVGKALKGKRDQIVLTTKVGNRWTEEKNGWSWDPSKNYIKAEVKESLRRLQTDYIDLYQLHGGTIEDPIDEVIEAFEELTKEGIIRHYGISSIRPNVIREYAKRSNIVSVLMEYSLLNRRPEEWFPLLNEQQISVIARGPLAKGILTDNNARKIDRVKEKDYLSYSYDELYKTLASVKELIGESSLTGTAIQYCLHNETVAAVIPGASSIGQLQENVQASKQTKLTTAEYIQLQQIAKCDTYALHR

SEQ ID NO: 27270 - protein, 307 aa, Bacillus cereus G9241
MKRFFAALFTILGAITALGIFFTNKVMYLKKKTEEEVLERETKKHFRIEDFDALHKEEIHIPSQFGYDLHGYYIPAGHSNKFMIFCHGVTVNKMNSVKYARLFLNRGYNVVIYDHRRHGKTGGKTTSYGYYEKHDLKSVVDWLKSRFGTNITLGIHGESMGAATLLQYAGLVEDGADFYIADCPFSDFYGQLQHRLKVEFHLPKWPLLPLANAFLKVRDGYTIREVSPIDCIKNINNPVLFIHSKDDDYILADMTKALYEAKENNKQLYIAEHGAHACSYNENKEEYEAAVDQFLNSYVKETKNRLA

SEQ ID NO: 27271 - protein, 465 aa, Bacillus cereus G9241
MTIVTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKAKKQRFVTLKEAYHGDTIGAVSVGAIDLFHQVYSSLLFEAIKMPYPYTYRSPYGNDKAEIVRKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVACKTEYVATQLEELFACKHVGDIRQCGLMVGIELVKNKETKEAFEWTERVGVQVCKRSRELGMILRPLGNTIVFMPPLASTIEEIDDMLRILYKAISDVTEGE

SEQ ID NO: 27272 - protein, 386 aa, Bacillus cereus G9241
MTIHLFQTYGRRKIEFVKGKGTKVIDNNSKQYLDFTSGIGVCNLGHCHPTVMKAVQEQLHEIWHISNLFTNSLQEEVASLLTENRALDYVFFCNSGAEANEAALKLARKHTEKSLVVTCEQSFHGRTFGTMSATGQNKVKEGFGPLLPSFLHTPFNDIKALEEVMNEEVAAVMIEVVQGEGGVIPADLSFLKAIEALCKKFGSLFIIDEVQTGIGRTGTLFAYEQMGITPHIVTTAKALGNGIPVGAMIGRKEFGISFPAGSHGSTFGGNYIAMAAAKEVLQITKKPSFLKEVKEKGEYVLQKLQEELQHVECIQNIRGKGLMVGIECTHEVASFIEQLEKEGLLVLQAGPNVIRLLPPLIVTNEELEQAVYMIKKVVCTKNVSII

SEQ ID NO: 27273 - protein, 469 aa, Bacillus cereus G9241
MKFSHDFLFGAASASYQVEGAWNEDGKGVTNWDEFSKIPGKTYNGTNGDVAVDHYHRYKEDVRLMAEMGLESYRFSISWARILPTGDGEVNEKGIEFYNNLIDECLKYGIVPFVTLYHWDLPLALEKDGGWTNKRTAEAFVKYAEICFKAFGDRVKHWITFNETVMFCGLGYLKGAHPPGIQNDVPKYFQATHYVFYAHAKTVAVYKQLKQYGEIGITHVFLPAYSVDGQKENILAAKHANEYETYWYYDPVLKGEYPSYVVQQLKKKGWTPNWTVEELEIIKQNAEKNDFIGLNYYQPIRVERYDMDINGGEHSRENSTLAPGNPSFDGFYRTVKMDDKTYTKWGWEISPEGFLDGLHMLKERYGDIKMYVTENGLGDEDPIIDGEIVDVPRIKFIEEHLKVIKRAIEEGINLKGYYAWSVIDLLSWLNGYKKQYGFIFVDHNDNLKRKKKLSFHWYKHVIETRGEEL

SEQ ID NO: 27274 - protein, 496 aa, Bacillus cereus G9241
MQGIAYWIEKRAYLHPDRIAIITDEEEMTYKQLHEYVNKVAAYLMYGLHVQKGERIAILSQNSLEYIVLLFAIAKVECIAVPLNIRLTENELIFQLKDSGTTLLFVEETFQNMALSMQKVSYVQSVISIKSLKEIEDRKIDNFEEINESASFIICYTSGTTGKPKGAVLTQDNMFWNALNNTFAIDLTIHDRSIVLLPLFHIGGIGLFAFPTLFAGGVIIVPRKFEPTTALSMIEKHKVTVVMGVPTIHQALVNCEKFETTNLQSVRWFYNGGAPCPEELMREFINRGFLFGQGFGMTETSPTVFMLSEEDARRKVGSIGKPVLFCDYVLIDENKNKVEIGEVGELLIRGPNVMKEYWNRPDATKETIQDGWLYTGDLARVDEEGFVYIVGRKKEMIISGGENIYPLEVEQVINKLSDVYEVAVVGRQHVKWGETPIAFIVKKSSSVLTEKEVIEHCRLFLAKYKIPKEIIFLKELPKNATGKIQKVQLANQLKSR

SEQ ID NO: 27275 - protein, 399 aa, Bacillus cereus G9241
MSKVKEISKRKLLGIAGLGWLFDAMDVGMLSFVMVALQKDWGLSTQEMGWIGSINSIGMAVGALVFGILSDKIGRKSVFIITLLLFSIGSGLTALTTTLAMFLILRFLIGMGLGGELPVASTLVSESVEAHERGKIVVLLESFWAGGWLIAALISYFVIPKYGWEVAMILSAVPALYALYLRWNLPDSPRFQKVEKRPSVIENIKSVWSGEYRKATIMLWILWFSVVFSYYGMFLWLPSVMVLKGFSLIKSFQYVLIMTLAQLPGYFTAAWFIERLGRKFVLVTYLIGTACSAYLFGVAESLTVLIVAGMLLSFFNLGAWGALYAYTPEQYPTVIRGTGAGMAAAFGRIGGILGPLLVGYLVASQASLSLIFTIFCGSILIGVLAVIILGQETKQRELA

SEQ ID NO: 27276 - protein, 432 aa, Bacillus cereus G9241
MNVTTDVQSTTEETKEKRYKTLFGSALGYAAEGLDMLLLSFVLVYILKEFHLSPVEGGNLTLATTIGMLIGSYLFGFIADLFGRIRTMAFTILLFSLATALIYFATDYWQLLILRFLVGMGVGGEFGIGMAIVTETWSKEMRAKATSVVALGWQFGVLVASLLPAFIVPHFGWRAVFLFGLIPALLAVYVRKSLSEPKIWEQKQRYKKELLQKEAEGSLTTTEAEQLKQMKKFPLRKLFANKKVTITTIGLIIMSFIQNFGYYGIFTWMPTILANKYNYTLAKASGWMFISTIGMLIGIAIFGILADKIGRRKTFTIYYVGGTIYCLIYFFLFTDSTLLLWGSALLGFFANGMMGGFGAILAENYPAEARSTAENFIFGTGRGLAGFGPVIIGLLAAGGNLMGALSLIFIIYPIGLVTMLLCVPETKDKVLE

SEQ ID NO: 27277 - protein, 453 aa, Bacillus cereus G9241
MIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGRLEDLKFKTPLYPLVPILGFGLYDIILISLIFIPEQRLGIYCTVPFIIFCYTYYHFKVKKRISTNTQSETKISETM

SEQ ID NO: 27278 - protein, 405 aa, Bacillus cereus G9241
MSDWFQLDKEYMMSTYCRTKLAIERGEGCKLYDVDGKEYIDLFSGVGVNVLGYNHPKIVQTTMDQVTKSLHLPFHFLNPVAIEYAKKLVDCSLKNGKVFFTNSGTEATETTLKLIDKYRDNTGEEREGIVVLKNSFHGRTLGALHFTRQESVYQNFPKTSIPVYEVERENIEQLEETIIHENPIAIMLEPVLGSGGIYPLSGEYLHGVQNLCEKYNVLLIVDEVQSGMGRTGKLFAYQNFNITPDIIQIGKGAGGGIPLGGIIVGERLCDVFAPGDHGTTFAHSSMGTALGLTVLNTLLDDGLMQEAYETSLYLNDKLQDIQKENSYYIQEVRHAGMMFGISVNDTNENVKKLQIELMNKGMLVDVTQGNIIRLLPPYIITKEEIDAFTYEFISCIHNIAATASI

SEQ ID NO: 27279 - protein, 488 aa, Bacillus cereus G9241
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 27280 - protein, 437 aa, Bacillus cereus G9241
MLSIKGQKWRNWTGNVEGTPHYTMYPESIQDVVEVIELARKKGKKIRVVGSGHSFTPLVQTEEILVSLDELKGIVNIDTEEMVAEVWAGTKLHELGKLLEEKGYAQENLGDIDSQSIAGAISTGTHGTGITFGSLSTQVIEITAVLSTGETIVCSETENVEYWRGFQLSLGMLGIIVRIKLKVIRAYSLVYESEKQSLSTVMNKLEEYKKNRHFEFFVFPYSDEVQVKVTNETTGKKSDLKWHKLKVELLENKMFSLLSKGCKWFPSISKGVSRLSAKAVPNTKIIGPSYEVFATSRAVPFYEMEYSVPSKYMQAVVEEISNLIEKKKYKVHFPIECRYVKRDDIWLSPAYGRDSAYIAVHMYKGMKYAAYFGEVEKIFLKYEGRPHWGKMHTLTYEKLQNIYPELHSFLKVRKLLDEAEMFSNPYTEKLFTIMKKS

SEQ ID NO: 27281 - protein, 463 aa, Bacillus cereus G9241
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPCWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIIATAIVLLVGVILNYLVPAKVFTWLTSISTFGAIWTWGIILVAQIKFRKSLPAQNKQKLSYKMPLYPISSYFSLAFLALVLCIMAYSEDTRIALIVGPIWLIGLAIVYYMKGFHKIDETPNSKIS

SEQ ID NO: 27282 - protein, 430 aa, Bacillus cereus G9241
MFQLQKYNTSVKQELLAGITTFFTFAYILVINPKILSDAGVPFDQAFTATIIATVVGTLCMSFLANYPIVIAPAMGMNAYFAYSVVQQAEGITYVIAFSAVFVTGIIFLLLSFTSFRQKLIVAIPDSLKHAIAGGIGLFIAFIGLRLSGIIVDHPSNLVTIGDFHSPAVILTLIGLILAAVLMTLRVSGALFISMIVTGIIAFFTGQLKFTDKIVAMPHLPEGIIVSNPINAFSDVIEYGLYGVVFSFLLVLLFDTTGALLGLIKQAGLITDNTEKRFGKAFIADAIGGTTGSIFGTSPTAATIESSAGIAAGGKTGLTGIVVVGLTIITAFFSPVIASLSNVAAITAPSLIIVGSLMAQSIRDINWNEFEDALPAFLIFVGIPLTSSIANGIAIGFLVYPVLKIVKGKGMEVHPLLYLFTILFGCHLFL

SEQ ID NO: 27283 - protein, 471 aa, Bacillus cereus G9241
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVVFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQQTIPQEIN

SEQ ID NO: 27284 - protein, 494 aa, Bacillus cereus G9241
MSQLAVNLHEKVEKFLQGTKKLYVNGFFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 27285 - protein, 459 aa, Bacillus cereus G9241
MSKLVVIGGGPAGYVAAITAAQNGKDVTLIDEADLGGTCLNVGCMPTKSLLESAEVHDIVRKANHYGITLNNGSISIDWKQIQARKSQIVTQLVQGIQYLMKKNKIQVIQGKAKFETDHRVRVTNGNKEDIVDGDQFIIAAGSEPTALPFAPFDGKWILNSSHAMSLENIPKSLLIVGGGVIGCEFASIYSRLGTKVTIVEMAPQLLPGEDEDIAHILRGKLENDGVEIFTGAALKGLNNYKKQASFEYEGSIQEVNPEFVLVSVGRKPRVQQLDLEKAGIQYSNKGISVNEHMQTNVSHIYAAGDVIGGIQLAHVAFHEGTTAALHASGEDVKVNYHAVPRCIYTAPEIASVGLTEKDAREQYGDIQIGEFPFTANGKALIIGEQTGKVKVIVEPKYQEIVGISIIGPHATELIGQGTVMIHTEVTADIMRDYIAAHPTLSEAIHEALLQAVGHAVHA

SEQ ID NO: 27286 - protein, 258 aa, Bacillus cereus G9241
MGVEKIKAAFENGKKAFIPYVMGGDGGLEKLKERIRCLDEAGASIVEIGIPFSDPVADGPTIQRAGKRALDSGVTLKGIFQALIEVRKEVQIPFVLMTYLNPVLAFGKERFIENCIEAGVDGIIVPDLPYEEQNIIAPLLREANIALIPLVTVTSPIERIEKITSESEGFVYAVTVAGVTGVRQNFKGEIHSYLEKVKSHTHLPVVAGFGISTKEHVEEMITICDGVVVGSKVIELLENEKREEICELIQATKQKEEA

SEQ ID NO: 27287 - protein, 432 aa, Bacillus cereus G9241
MSAAMQIVRNDENANVVTLEKGEIYSYAQCGLPYVISGAIASTEKLIARNVKTFRDKYGIDAKVRHEVTKVDTEKKIVYAEHTKTKDVFEFSYDRLLIATGVRPVMPEWEGRDLQGVHLLKTIPDAERILKTLETNKVEDVTIIGGGAIGLEMAETFVELGKKVRMIERNDHIGTIYDADMAEYIHKEADKHHIEILTNENVKAFKGNERVEAVETDKGTYKADFVLVSVGVQPNTDFLEGTNIRTNHKGAIEVNAYMQTNVQDVYAAGDCATHYHVIKEIHDHIPIGTTANKQGRLAGLNMLDKRRAFKGTLGTGIIKFMDLTLARTGLNEKEANGLHIPYKTVKVDSTNMAGYYPNAKPLYLKLLYRSDTKQLLGGQVIGEEGVDKRIDVIAMALFNKMSIHDLEDVDLSYAPPYNSVWDPIQQAARRAE

SEQ ID NO: 27288 - protein, 444 aa, Bacillus cereus G9241
MARYTREDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVVCGALGDHLLEHFIEAKEIEWDIFRTQVHQWERDQYMSLY

SEQ ID NO: 27289 - protein, 449 aa, Bacillus cereus G9241
MISIGGVIGAGLFVGSGAVVHSAGPGSIVSYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAIVVTLLPWNSANILKSPFVAVLEHIGIPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLNIRKKMGRVEQQNLKVKMWFFPYVTYVTIAAIIAVLIAMLAIESLRSQALLTMFVTVLIIISYFIFNRNKNSTVLNTKSKNEESIRF

SEQ ID NO: 27290 - protein, 105 aa, Bacillus cereus G9241
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGG

SEQ ID NO: 27291 - protein, 444 aa, Bacillus cereus G9241
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVISVLVWINAKDTPESEGLPPIDEYRNDYENLEKADNANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKSA

SEQ ID NO: 27292 - protein, 433 aa, Bacillus cereus G9241
MQPSAPPHLESTETIFSSSITKLVVFICWLAILADGYDLGIYGAVLPKLLEDKSWALSPAHAGTIASYALFGMFIGAILVGTITDLIGRKWTLICCLALFSITMGLAAIAPSPELFGIWRFIGGIGLGGVIPTASALTVEYSPKKRQSFIYALMFTGYPLGIVLGAILSMFMLEGFGWRTMFGIGMIPLLLIPFIIRYLPESIQFLLSRNRQEEVDQILNRFQIEFYAKNETHQTPSNIRKKNGFLSLFSKEYIKATLLFWITYIMGMFLIYGLNTWLPQMMRQAGYPLGSSLSFLLMLNITAAIGALFAGAIADRIGAKIVISISYLMAAICIGLLTIKPSVTIIYLLIGLAGIGSVGITQILNAYVTQYFPSHIRATSLGWGLGLGRVGAIAGPILVGIIMTMQYDLVWNFYLFSFAGLLAAISVFFIPTK

SEQ ID NO: 27293 - protein, 240 aa, Bacillus cereus G9241
MIQVRNLVKSFGSLDVLKGIDLEVQEKEVVVLIGASGSGKSTLLRCLNFLEIYDEGEIHLQGERIDPKHSNLNKVRENVGMVFQHFNLFPHMTSLENIIEAPIHVKKLEAANAKEIGNQLLQKVGLQDKADVTPHLLSGGQKQRIAIARALAMNPKIMLFDEPTSALDPELVGEVLQVMKELAEEGMTMVIVTHEMNFARDVADRVIFMDDGKIVEEAPPAQFFSAPSHERAKQFLRNVL

SEQ ID NO: 27294 - protein, 214 aa, Bacillus cereus G9241
MIKIAPSILSADFSKLGEEIKDVEKGGADYIHVDVMDGHFVPNITIGPLIVEAIRPITSLPLDVHLMIENPDNYIPTFAKAGADIITVHVEACPHLHRTIQLIKSHGIKAGVVLNPHTPVSMIEHVLEDIDMVLLMTVNPGFGGQKFIHSVLPKIKQVAEMVKERNLEVEIEVDGGVNPETARLCVEAGANVLVAGSAVYNQKDRGEAIRVIRG

SEQ ID NO: 27295 - protein, 339 aa, Bacillus cereus G9241
MISFNNVSKVYESGGQSVHAVEDVTLSVEKGEIFGIIGFSGAGKSTLLRLVNMLERPTTGTISIDDKDITLLSTKELRKLRQRIGMIFQSFNLFNSRTVFGNIAYPLKLAKVPKNEIKERVNELLKFVGLEDKANNYPEQLSGGQKQRVGIARALATSPDILICDEATSALDPETTTEILNLLKKVNREYNLTILLITHEMHVVKEICHRVAVMENGKVIEEGKLFDVFTQPKTKTTQNFVRSVINDHLPESVLAKIQNGGQIYRLTFTGEETGQPVLSYIAKNYNVDVNVLYGNIIELQNVLFGNLLVELQGEQREIQKALQHLRLQVQLKEVEAHAS

SEQ ID NO: 27296 - protein, 454 aa, Bacillus cereus G9241
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFMIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKAPDKTLTANLCAEANKRGLLLLSAGTYGNVIRVLMPLVITDEQIEEGLTIIEESLQVCYEKANIARV

SEQ ID NO: 27297 - protein, 469 aa, Bacillus cereus G9241
MYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADKWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFIQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 27298 - protein, 473 aa, Bacillus cereus G9241
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLVATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIVAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 27299 - protein, 511 aa, Bacillus cereus G9241
MKKRALVSVSDKTGVVEFVKGLLEQGIEVISTGGTKKLLEENGLQVIGISEVTGFPEIMDGRVKTLHPNIHGGLLAVRDNETHVAQMNELGMESIDFVVVNLYPFKETIAKPDVTFADAIENIDIGGPTMIRSAAKNHKFVSVIVDPVDYDVVLAELKENGEVAEETKRKLAAKVFRHTAAYDALISTYLTEQMGEESPETLTVTFEKKQDLRYGENPHQKATFYKAPFAATSSVAYAEQLHGKELSYNNINDADAALSIVKEFTEPAVVAVKHMNPCGVGVGTDIHEAYTRAYEADPVSIFGGIIAANREIDKATAEKLHEIFLEIIIAPSFSKEALEVLQGKKNLRLLTVNIEKATSASKKLTSVQGGLLVQEEDTLSLDESTISIPTKREPSEQEWKDLKLAWKVVKHVKSNAIVLAKDDMTIGVGAGQMNRVGSAKIAITQAGEKAQGSALASDAFFPMPDTLEEAAKAGITAIIQPGGSIRDEDSIKVADTYGIAMVFTGVRHFKH

SEQ ID NO: 27300 - protein, 265 aa, Bacillus cereus G9241
MHHTCNRNEVICVIEARDLYKSYKQNEVLKGISLTVGKGEVVVIIGPSGSGKSTLLRCLNLLEQPEDGSIRIEDLEIHAKKLYKKGIIKLRQKTAMVFQNYNLFKNKTALQNITTPLTVVQKKSEEEAKRIAREILKQVGLAEKENFYPTMLSGGQQQRIGIARAMALNPAVLLFDEPTSALDPELVNEVLQVIKDLARQHITMVIVTHEMNFAKEVADRIIFMADGIIVEQGTTEEIFWNPQNERTKKFLRQLNASEEGNHFVI

SEQ ID NO: 27301 - protein, 245 aa, Bacillus cereus G9241
MIKLVLIRHGQSLWNLENRFTGWTDVDLSENGLSEAREAGAILKKNGYTFDVAYTSVLKRAIRTLWIVLHEMDLAWVPVHKSWKLNERHYGALQGLNKDETAQKYGEEQVHIWRRSIDVRPPALTEDDPRYEMNDPRYKALKKGEFPLTECLVDTEKRVLAYWHSEIAPKLKNGNKVIISSHGNTIRSLVKYLDNLSSDGVVSLNIPTSIPLVYELDDDLRPIRHYYLSMDGEVPEGEIPKHISF

SEQ ID NO: 27302 - protein, 297 aa, Bacillus cereus G9241
MKKEISVIGVPMDLGQMRRGVDMGPSAIRYAGVIERIEEIGYDVKDMGDICIEREKEIDENTKLRNLTQVATVCNELASKVDHIIEEGRFPLVLGGDHSIAIGTLAGVAKHYKNLGVIWYDAHGDLNTEETSPSGNIHGMSLAASLGYGHPTLVDLYGAYPKVKKENVVIIGARALDEGEKDFIRNEGIKVFSMHEIDRMGMTAVMEETIAYLSHTDGVHLSLDLDGLDPHDAPGVGTPVIGGLSYRESHLAMEMLAEADIVTSAEFVEVNTILDERNRTATTAVALMGSLFGEKLK

SEQ ID NO: 27303 - protein, 307 aa, Bacillus cereus G9241
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSIERRNLLRAYGAELVLTPGPEGMGGAIRKATELAKENGYFIPQQFKNQSNPEIHRLTTGPEIVEQMGDQLDAFIAGIGTGGTITGAGEVLKEAYKDIKIYAVEPADSPVLSGGKPGPHKIQGIGAGFIPETLDVEVYDEIVQVKTEQAFEYARRVAKEEGILVGISSGAVIYAATEIAKKLGKGKKVLVIIPSNGERYLSTPLYQFES

SEQ ID NO: 27304 - protein, 232 aa, Bacillus cereus G9241
MLILDGMVMTTEKDEFVYHEMVAHVPLFTHPNPENVLVVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 27305 - protein, 467 aa, Bacillus cereus G9241
MYTVLLATSVHTYKKQLDHPIMSDVGKLLPTKIKRVESATDEHSLIKLVQDANVSGEKISIAGMQHSQGGQTYYPHGTMLDMKGYNKILEFDPEKKRITVQSGVTWNDIQKKINPYGLAVQVMQSQNIFTVGGSLSVNVHGRDIRHEALIDTVESFRLLMADGTVRNVSREENADLFPYVIGGYGLFGVILDVTLKLTNDELYETHTKMLDYKEYTSYFKEKVKKDENVRMHLARISVAPNSFLREMYVTDYTLAQNQNMREEYSELKEETIIAAPKFLLGLSRYSDWGKDTFWDIQRSYFERTDGKYETRNNVMRSDSAFMEYENPNRTEVLQEYFVPIDSFAEYIDDLRNVLNEEEFNLLNITIRYVEKNENAVLSYAKDDMFALVLLINQGRSEGEIKKTEDVIQKMVDVTLKHNGSYYLPYYSYPTKEQLKRAYPRIEEFLQKKKEADPKERFVNLFYREYTK

SEQ ID NO: 27306 - protein, 326 aa, Bacillus cereus G9241
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGNKEIYIAKYIVVATGYYDNPNYMNVPGEELQKVAHYFKEGHPYFDRDVVVIGGKNSSVDAALELVKAGARVTVLYRGSEYSPSIKPWILPEFEALVRNGTIHMHFGAHVKEITEHTLTYTVDGEAYTIQNDFVFAMTGYHPDHSFLTKMGVRIDEETGRPIYAEDTMETNAENIFIAGVIAAGNNANEIFIENGRFHGDALAQTIATREM

SEQ ID NO: 27307 - protein, 433 aa, Bacillus cereus G9241
MRVGKIHTRKLFICFCLAVVLFVPIHTFADEKREWRDEVIYSVMIDRFNNGEPKNDKQLEVGNLEGYQGGDIRGIIKRMDYIKEMGFTTVMLSPLFESVKYDGLDVRNFQKVNEHFGTENDVKELVQAAHAKGIKVVFQFPLAENEQQVIDSMKWWIKEVDLDASYVMHSEQKAPAFWDDVQKDMQVIKKDFRVMTKEDSEYNEKIVESFSKADVSVKSLYDVSKKDEEFVTFLDNQDTKRFARIAKENMYYPPSRLKLALTYLLTSPGIPNFYYGTEIALDGGDTPENRRLMDFKSDEKFMQHITKLGELRQTRPSLRRGTFELLYDKNGMSVLKRKYKDEVTLVAINNTKETQKVPLNANLIGEKKELRGLLEDEIIREENGKFYLVLKREESNVYKVNGETGVNWLFISLIVGVNVLFIVFLIAAKKRRK

SEQ ID NO: 27308 - protein, 454 aa, Streptomyces coelicolor A3(2)
MVQEIDVVVIGMGVGGEHVAERLAEEGLDVVGVEAELVGGECPYWVCIPSKMMIRGGNLLAEARRIPGMAGQAQVTPDFAPVASRIREEATDDWNDQVAVDRFTGKGGQFVRGRARLAGPKRVEIDGREFTARRGVVIATGSRPQIPPVPGLDAVPYWTNREAIAVKDSPRSLMVLGGGAVGVELAQAFARFGTAVTVVEAAERLLPAEEPETSALLADVLGAEGITVRTGAQANRARHDGDTFTLTLEGGEELTAERLLVATGRRAGLAGLGLGTVGLDPDARALHVDEQLRAAPGLWGVGDVTGRGAFTHVAMYQAEIAVRAILGQPGPGADYRALPRVTFTDPEVGSVGLTEARAREKGLRVRTGTAQVPSSARGWIHKAGNEGLIKLVEDVDRGVLVGATSAGPMGGEVLYGLVVAVQGEVPVDRLRHMMYAYPTFHRAVEDALRALRSS

SEQ ID NO: 27309 - protein, 460 aa, Escherichia coli
LWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRTAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 27310 - protein, 460 aa, Escherichia coli
LWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 27311 - protein, 286 aa, Rubrivivax gelatinosus PM1
MAWADQWIPVGAGEPLKARVYGSRPRGRSAPLVLHFHGGAFVAGGLDSGATVAGLLAEAGAVVVSLDYPLAPAHPFPAAIEAGHAALTWMHRHRSRLAGQSATVWVAGEEAGGNLAAAVALMARDRRSPPLAGQILMSPMLDPCVATASLRDADAGPVGCLWADGWHQYLPGAADADHPYAAPASAMRLTGVPRTLLITAQDDPLRDEARAYARRLRDAGVEVDEAFLDQPTGWPCACKQPAGAQAAWAPVVRGQFQAFLQRAHAPAAVPVSASSSIQNRRPGSLS

SEQ ID NO: 27312 - protein, 436 aa, Rubrivivax gelatinosus PM1
MAAVTTSPSPNVPSRSSSATTSSKAWSVLIVSTLAFTVCFMVWMMFGVIGIPLKKQLGLNATEFGLLTATPVLTGSLIRVPLGIWTDRYGGRIVMTVLMAITVPPIFLMSYATAYWHFLVIGLFVGLAGGSFSVGTPYVARWFPKEKKGMAMGVYGAGNSGSAVNKFVAPAIIAALGWAAVPQVYAAIMALTVVVFWFFSHHDPKHVVPSDTKLSDQLKLLKDPAVLKYCQYYSIVFGGYVALALWMVQYYVGEFGLSITTAALLAACFSLPGGVLRAVGGVLSDKYGAHKVTWWVMWVSWICLFLLSYPQTQFTVLTVNGPKTFEIGLNVVWFTVLMAVLGVAWAFGKASVFKYLGDEYPNNIGAVSGIVGLAGGLGGFVLPILFGVLMDLTGIRSSAFMLMYGVVWVSLIWMYWTEVRRTPVMGRDAPVFKLAD

SEQ ID NO: 27313 - protein, 489 aa, Rubrivivax gelatinosus PM1
MRLLGKALTFDDVLLVPAFSQVLPRDTSLATRLSRNITLNLPLASAAMDTVTEARLAIALAQEGGIGIVHKNLSPKQQAAEVSRVKRYESGLLRDPITISSGVRVQDVINLSRQHGISGFPVVDDGKVVGIVTGRDLRFETRLDAPVREIMTPRERLVSVNEGATLEEAKSLMHRHKLERVVVVNAANELRGLFTVKDITKQTNFPNAARDAQGKLRVGAAVGVGEGTEERVEALVKAGVDAIVVDTAHGHSKGVIERVRWVKRNYPQVDVIGGNIATGEAALALAEAGADGVKVGIGPGSICTTRIVAGVGVPQITAIDNVATALKGSGVPLIADGGIRYSGDIAKALAAGANTVMMGGMFAGTEEAPGEIVLYQGRSYKSYRGMGSIGAMQQGSADRYFQDNTGANPNADKLVPEGIEGRVPYKGSVIAILFQMAGGLRASMGYCGCASVEEMRERAEFVEITSAGIRESHVHDVQITKEAPNYRAD

SEQ ID NO: 27314 - protein, 506 aa, Rubrivivax gelatinosus PM1
MGAPEAFTATAEIGHFIGGRAVPSTSGRRQAVYNPATGAVARQVALASADEVNAAVAAAQAAFPAWADTPPLRRARVLNKFLQLLNEQRDTLAAMITAEHGKVFTDAQGEVTRGIEIVEFACGAPQLLKTDFTDQVGTGIDNWVLRQPLGVVAGITPFNFPVMVPMWMFPMAIATGNSFVLKPSERDPSPSLFIAELLKQAGLPDGVFNVVQGDKLAVDTLLTHPDVKAVSFVGSTPIAQYIYETGAKHGKRVQALGGAKNHMVVMPDADLEQSVDALIGAAYGSAGERCMAISVAVLVGDVADQIVPKLAERAKALKVKNGMELDAEMGPIVTPQALERIEGYIAHGVDEGAKLVVDGRGLKVPGHEQGFFTGGTLFDHVTPEMKIYKEEIFGPVLACVRVPDFASAVALVNAHEFGNGVACFTRDGHVAREFSRRIQVGMVGINVPIPVPMAWHGFGGWKKSLFGDMHAYGEEGVRFYTKQKSVMQRWPESTPKGAEFVMPTSK

SEQ ID NO: 27315 - protein, 454 aa, Rubrivivax gelatinosus PM1
MAKDKTNYTCSECGGTSPKWLGKCPACGAWNTLEETVAEPAAATRHRFQSLARSQPVATLSEIDAADVARTPTGIEELDRVLGGGIVAGGVVLIGGDPGIGKSTLLLQAVDALSAQMRVLYVSGEESGAQLALRSRRLGLDGSRVRVLAEIHLEKIQATIDAEQPAFCVIDSIQTVYSDQLTSAPGSVAQVRECAAQLTRTAKSSGTSIVLVGHVTKEGALAGPRVLEHIVDTVLYFEGDTHSSFRLVRAIKNRYGAVNEIGVFAMTERGLKGVANPSAIFLSTHGEPVPGSCVMVTLEGTRPLLVEIQALVDSGGPSPRRLSVGLERDRLAMLLAVLHRHAGIACMDQDVFVNAVGGVRISEPAADLAVMLAIQSSLRGRPLPRGFIAFGEVGLAGEVRPAPRGQERLKEAAKLGFSVAVLPKANAPKKPIEGLRIHAVERVEQAIDVLRELS

SEQ ID NO: 27316 - protein, 338 aa, Rubrivivax gelatinosus PM1
MNLQRFPRHPLTFGPTPIQPLKRLSAHLGGQVELYAKREDCNSGLAFGGNKTRKLEYLIPEALAQGCDTLVSIGGIQSNQTRQVAAVAAHLGMKCVLVQENWVNYSDAVYDRVGNIEMSRILGADVRLDAAGFDIGIRPSWEQAMADVRAAGGKPFPIPAGCSEHRLGGLGFVGFAEEVRAQEAELGFKFDYIVVCSVTGSTQAGMVVGFAADGRAERVIGIDASAKPEQTHAQILRIAQNTAELVGLGREITAQDVVLDTRYGGPEYGLPSEGTLEAIRLCARQEGMLTDPVYEGKSMHGMIDKVKRGEFPAGSRVLYAHLGGVPALNAYSFLFRNG

SEQ ID NO: 27317 - protein, 488 aa, Rubrivivax gelatinosus PM1
MGKVTGFLEYERLEEGYAPVEQRLKHYKEFVIGLKDEEAKVQSARCMDCGTPFCNSGCPVNNIIPDFNDLVYRGDWANAIAVLHSTNNFPEFTGRICPAPCEAACTLNVNDDAVGIKSIEHAIIDRAWAEGWVQAQPARHKTGKTVAVVGSGPAGMAAAQQLARAGHAVTLFEKNDRIGGLLRYGIPDFKMEKTHIDRRVEQMKAEGVVFRTGVLVGHLPEGSKVTNWAKEIVSPEQLKAEFDAVVLTGGAEQSRDLPVPGRDLDGVHFAMEFLPQQNKINAGDKLKGQIRADGKHVIVIGGGDTGSDCVGTSNRHGAKSVTQFELMPMPPEQENKELTWPYWPYKLRTSSSHDEGCEREFAIATKEFIGDKGKVTALKTVRVEWQGGKMVEVPGSEQVLKADLVLLAMGFVSPVSTVLDAFGIDKDSRGNAKATTDFTGGYQTNVPKVFAAGDVRRGQSLVVWAIREGRQAARAVDEFLMGYSDLPR

SEQ ID NO: 27318 - protein, 249 aa, Rubrivivax gelatinosus PM1
MILRDVDLVVPRGSVLALMGTSGGGKTTVLRLIGRQLEPMSGKVLFDGTDLATLGRDGLYAARRRMGMLFQFGALFTDLSVFDNVAFPLREHSGLGEAIIRDLVLMKLNAVGLRGARDLMPSEVSGGMARRVALARAIALDPELMLYDEPFAGLDPISMGVAARLIRELNRALGITSIVVSHDVDETFSIADQVVFIANGGVVAQGTPAEMRASEDPLVRQFVDAQADGPVRFHYPAASANEDFQVGSS

SEQ ID NO: 27319 - protein, 400 aa, Rubrivivax gelatinosus PM1
MVWMMAAGALVFFMQAGFALLESGMSRAKNAINVIMKNYCDTCFGAVAYWAVGFGLMFGANASGWIGTDRFLPHAMPEADYGLLFFQMMFAATAATIVSGAIAERARFWAYIVSSVLITGLIYPVFGSWAWGSLFSGQGWLREMGFIDFAGSTVVHSVGGWSALAAILVIGPRLGRFGPNGEARPMLGHNLTSVALGGFILWLGWFGFNGGSTAAATVGIGKIVLNTHLAGAAGAIGALAVLALGRQPVLMTAAVNGSIAGLVGITAGCHVMEPAYALLTGFVAGGLSVLAGWLLEAGRIDDVVGAVSVHAVGGVWGTLAAGLFKHDAMFDLRQLGVQAIGCGVAFAWSFGTALLMYWLLARGVGLRASTLDEQRGLDFTEHYEIGYPEFQQDAVHRGKR

SEQ ID NO: 27320 - protein, 395 aa, Rubrivivax gelatinosus PM1
MNTYGRLPFALSHGQGCRVWDTEGREYLDALGGIAVNTLGHAHPKLVPALTDQIGKLIHCSNYYQAPMQEQLAARLCELSGLTNAFFCSTGLEANEAALKIARKFGHDKGIDRPEIIVYEKAFHGRSIATLSATGNPKVQAGFGPLVEGFVRVPLNDVAAIEEVAQTRPNVVAVFLEVIQGEGGINPATVPYLQALRRLCDEHDWLLMLDEVQCGIGRTGKWFAHQWAGIHPDVMPLAKGLGSGVPVGAVVCGPRAAGVLGPGNHGTTFGGNPLAMRAGIETLAVMEQDRLLENAATVGERLRAGLARELADLSGPNGVTEIRGQGLMIGIELARPCGELLGRAAEAGLLLSVTADRVIRLVPPLILSAAEADRVVAILCPLIRRFLAEPPKPAA

SEQ ID NO: 27321 - protein, 492 aa, Rubrivivax gelatinosus PM1
MDMKNSPLATLADPTLLKTAALIDGAWVDRGEHFAVTDPATGQVLAQVANLGAADAEAALAAAARAWPAWRAKTAKERASVLMKWYQLLLQHADDLARIMTAEQGKPLAEAKGEVGYGASFIEWFAEEAKRVYGETVPTTDNNKRYLVLKQAMGVCAAITPWNFPIAMITRKVAPALAAGCPVVIKPAEQTPLSALAVAELAQRAGMPAGVLNVLTADAERSIQIGNVLCASDTVRHLSFTGSTEVGRILMKQCAPTIKKLSLELGGNAPFIVFDDADLDSAVEGAMISKYRNAGQTCVCANRLYVQAGVYDAFVEKLAAKVKAIKVGNGFEAGVTQGPLIDEAALAKVESHVADALAKGAKLLTGGQRIGERFYSPTVLAQATGEMLCAREETFGPVAPVFRFETEAEVVALANDTEFGLASYFYSRDVGRIFRVGEALEYGMVGINTGLISTAEVPFGGVKQSGLGREGSHHGIDDYVEIKYLCLGDIQK

SEQ ID NO: 27322 - protein, 484 aa, Rubrivivax gelatinosus PM1
MKQFLNFIDGEFVATDKTFANRAPVDNRVLGLVHEAGRAEVDAAVAAARGALKGEWGRMPVAKRVELLYAVADEINRRFDDFLAAEIADTGKPLSLASHIDIPRGAANFKVFADIIKNVPAETFEMATPDGGQALNYAVRTPVGVVGVVCPWNLPLLLMTWKVGPALACGNTVVVKPSEETPATATLLGEVMQKVGMPKGVYNVVHGFGPDSAGAFLTQHPDVDAITFTGETRTGEAIMAAAAKGVRPVSFELGGKNAGIVFADADFDKAVAGITRSAFENCGQVCLGTERVYVQRPIFEKFVQALKAKAEALKIGPSEEPGVGLGPLISAEHRDKVLSYYRKAVEQGATVVTGGGVPKMSGALAEGHWVQPTIWTGLPESAAVIREEIFGPCCHIAPFDTEEEAIALANATDYGLATTVWTQNLGTAHRVARQVEVGICWINSWFLRDLRTAFGGAKASGIGREGGVHSLEFYTELRNVCVKL

SEQ ID NO: 27323 - protein, 477 aa, Rubrivivax gelatinosus PM1
MRDYLKFYIDGHWVDPVKAKSLDVVNPATEASAGRISMGTAADVDRAVKAARKAFASYSQTSVAERASLLERIIVEYKKRYADMAAAITEEMGAPVALSKDAQAAMGIAHLQIALDVLKNYKFQELRDTTLMVKEPIGVCGFITPWNWPVNQIACKVAPALAVGCTMVLKPSEIAPFSAYLWTEILHAAGVPAGVFNLVNGDGPTVGAALSSHPDVDMVSFTGSTRAGVEVARNAAPTVKRVHQELGGKSPNIILPDADFKHAITAGVQGVMLNSGQSCNAPTRMLVPNARLDEALAIAKEAAEATTVGDPASGAALGPVISATQWDKIQTLIHKGIEEGATVVAGGPGKPKGLETGYYVKPTVLGHVNNQMTVAREEIFGPVLTILGYDTVDQAVEIGNDTPYGLAAYVSGTDPEATRKVASRLRAGQVNINSVPLDFKAPFGGFKQSGNGREWGDHAFGEFLEVKAVLGYAPKAA

SEQ ID NO: 27324 - protein, 340 aa, Rubrivivax gelatinosus PM1
MIAVVCPWNAPFLLMTWKVGPALACGNTVVVKPSEETPLSATLLGEVMNTVGVPPGVYNVVHGFGPGAAGEFLTRHDGVDAITFTGETRTGTAIMKAAAVGIRDVSFELGGKNAGIVFADADFDAAVDGIFRSAFMNTGQVCLGTERVYVERPLFDRFVQALKLRCEAVKFGRPSDPGANYGPLISQEHRRKVLSYYERAVAEGATVVTGGGVPPMPAELADGAWVQPTLWTGLPETASVVREEIFGPCCHVRPFDSEDEVVVLANANRYGLSTTLWTRDLARAHRVAAAIEVGITWVNSWFLRDLRTAFGGSKQSGIGREGGVHSLEFYTDLRNVCIKL

SEQ ID NO: 27325 - protein, 292 aa, Rubrivivax gelatinosus PM1
MPVDAHAQGLLDALKAQGLKSFEQMTIAEARGAIETFVGLQAPPEEVKQVHDLTVKGPAGELQYRIFVPAGPTPMPVLVYFHGGGWVGGSLAVVDEPCRAIANRCGAVVIAASYRLSPEARFPAATDDAYAAVQWASANAATYGGDASRLGVMGDSAGANLAAVVSMMARDRKGPAIKAQILTYPVIQRDGDFASRKANEEGYLLTSAGVAWFWKQYLASDADAVNPYASPIMAKDLTGLPPALVMTAEFDPARDEGEAYGKALAKAGVPVTVRRFEGLIHGVFGSADQPAS

SEQ ID NO: 27326 - protein, 301 aa, Rubrivivax gelatinosus PM1
MPSYLTVEDTIGRTPLVRLVRLPGAENERRGNVILGKLEGNNPAGSVKDRPAISMIRRAEERGEIKPGDTLIEATSGNTGIALAMAAAIRGYRMLLIMPEDLSIERAQSMRAFGAELVLTPKAGGMEYARDLAERLQREGKGRVLDQFANADNPRIHVETTGPEIWDDTEGQITHFVSAMGTTGTITGVSTYLKSRNPGVRIIGAQPSEGSRIPGIRKWPEAYLPKIYEPSRVDETINVSQSDAEDMARRLAREEGLFAGISAAGALWAALEVARTVENATIVFIVCDRGDRYLSTGVFPA

SEQ ID NO: 27327 - protein, 511 aa, Rubrivivax gelatinosus PM1
MKNDNLFVALRAGFPADLDGVAIEADGGLVYRWRDIERATAMIANLLVSLELPTGARIAVHTDKSVEALLLYLATLRAGFVYLPLNNGYQQAELDYFIENAEPDVVVCATRNFPWISKLAFRRGVGHVFTLNDDRSGTLLERAAQQDDRHEPARVGTDEVAAILYTSGTTGRSKGAMLSHGNLLSNARTLQRYWDWRPDDVLVHALPIFHVHGLFVACHGALLNGSRMLWLNRFDPAAVIERLPRATVFMGVPTLYVRLLQDPALTRAACARMRLCISGSAPLLIETFRDWQSRTGLTILERYGMSETAMLTSNPCRPEDGDRIGGTVGRPLPGVALRVVDDAGKDCPAGEVGGVEVRGPNVFKGYWRMPDKTAEEFTADGWFRTGDVGRLDERGYLTIVGRSKDLIISGGYNVYPAEVEGYLNELPGVAESAVIGVPHPDFGEAVVAVVVARSDAGVDGAQLVTQLKSRIAAFKLPKRVFVMAELPRNAMGKVQKNLLRQQHAGVFVSAA

SEQ ID NO: 27328 - protein, 510 aa, Rubrivivax gelatinosus PM1
MHDIIEELKRRRERARLGGGEKRIEAQHGKGKLTARERLELLLDAGTFEEWDMFVEHRCADFGMADNKIPGDGVVTGYGMINGRLVFVFSQDFTVFGGALSEAHAEKICKVMDQAMKVGAPVIGLNDSGGARIQEGVASLGGYAEVFQRNVMASGVVPQISLIMGPSAGGAVYSPAMTDFIFMVKDSSYMFVTGPEVVKTVTHEEVTAEELGGAITHTTKSGVADMAFENDVEAILMLRRFYNYLPLNNREKAPVRLGGDPAERLDYSLDTLVPDNANKPYDMRELILKVADDGDFFELQPEYAKNILIGFARMEGQTVGIVANQPLVLAGCLDIKSSIKAARFVRFCDAFNIPVVTFVDVPGFMPGTSQEYGGIIKHGAKLLYAYAECTVPKVTVITRKAYGGAYDVMASKHLRGDVNFAWPNAEIAVMGAKGAVEIIFREDKGDPAKLAAREAEYKQRFANPFVAGARGYIDDVIQPHETRKRICRSLVMLRDKKLENPWRKHGNIPL

SEQ ID NO: 27329 - protein, 299 aa, Rubrivivax gelatinosus PM1
MKIGFIGLGIMGTPMALHLAAAGHALFVHTRGKLPEAIAASGAQACANAAEVARNAEVVFTMLPDTPDVETVLFGANGIAAGLESGAGSVRKVVVDMSSISPMATKAYAQRINALGADYLDAPVSGGEVGAKAASLTIMCGGDEAVFARVRPLLETMGKNITLVGGNGDGQTTKVANQIIVALNIAAVGEALLFASKAGADPAKVRQALMGGFAASRILEVHGERMIKRSFAPGFRIKLHQKDLGLALQGARELGVSLPQTAGAAQLMQACAANGMADLDHSALVRALELMAGHDVAAA

SEQ ID NO: 27330 - protein, 347 aa, Rubrivivax gelatinosus PM1
MKAAVLHQYNESLSGDSFVRYGDVPDPKIESPTDVIVRIGGAGVCRTDLHVVEGLWRGKVDVELPYIMGHENAGWIEAVGSAVSGMKVGDPVICHPLVTSGHCLACRRGDDMHADGSRFPGINADGGYAEYLRTNQRSLIKLPSTLAPKDVAPYTDAGLTAYRAAKKASRHLLPGEYAVVIGAGGLGHIGIQVLAALCAAEIIVVDRADAALQLAKSCGAHHLVKADEQALERVLELTEGKGAQAVIDFVGEGEAISRGLAMTRNAGTYYVVGYGGRIELPSIDMITSEKSIVGNLVGTYAELVELMALADRGRVHLATREYALKDANQALLDLHHGRIQGRAVLVP

SEQ ID NO: 27331 - protein, 301 aa, Rubrivivax gelatinosus PM1
MLDAFKAQGLKSFEQMTVPESRETAMAFVGLEGDEEAVADVSNHRVPVKGGDIAVRIYRPAGNAPHPMLVYFHGGGFVFGNLDLVDKVARSLCNASNAAVVSVDYRKAPEHPYPTAPEDAYAGLVWARENAAKLGLDPARIAVAGDSAGGNLAAVVSQMARDRKGPKIAHQVLVYPVTDAAGDYPSRKENAEGYLLTQGAMNWFFGHYLTSPGLASDAYVSPIKGDLKGLPAATVITAGYDPLRDEGDAYAKALAKAGVAVDHVPNPTMIHGFFWMKGVIGHTQSIYDRVGRNLKAAFGTA

SEQ ID NO: 27332 - protein, 391 aa, Rubrivivax gelatinosus PM1
MAASFHWDDPLLLDSQLSEDERAVRDAAQAYCRDRLAPRVLEAFRHEKTDPAIFREMGELGLLGATLPEAYGGAGLNHVCYGLVAREVERVDSGYRSMMSVQSSLVMVPIHAFGTEAQKQKYLPKLARGEWIGCFGLTEPNHGSDPGSLATRARAVQGGYVLSGAKMWITNSPIADVFVVWAKDDGGQIRGFILDKGMKGLEAPAVHGKVGLRASLTGEIVMDEVFCPEENAFPEVRGLKGPFTCLNSARYGIAWGALGAAEDCFHRARQYVLDRPQFGRPLAANQLIQKKLADMQTEITLGLQGCLRLGRMKDEGTAAVEITSIMKRNSCGKSLEIARMARDMMGGNGISDEFGVARHLVNLEVVNTYEGTHDVHALILGRAITGIQAFC

SEQ ID NO: 27333 - protein, 436 aa, Rubrivivax gelatinosus PM1
MADSRNASLFERARRSIPGGVNSPVRAFRAVGGTPRFIARADGAYLWDADGKRYIDYIGSWGPMILGHGHPAVLEAVQKAATEGFSFGAPTEREVELAEEILKLVPSAEQVRLVSSGTEAAMSALRLARGATGRSKIVKFEGCYHGHADALLVKAGSGLATFGHPTSAGVPTEVVQHTLVLTYNDVTGLEAAFSAHGAEIACVMIEPIAGNMNFVRAGLPFMKRLRELCTQHGALLVFDEVMTGFRVALGGAQSLYAKAIPGFKPDLSVFGKVIGGGMPLAAFAGPRAIMEQLAPLGPVYQAGTLSGNPVATACGLATLREIQKPGFFESLAAGTRDLLDGLLHAATAAGVPMVGDCEGGMFGFFFPKTAQAALPQNYVEVMATDGERFNRYFHGMLDRGVYLAPALYEAGFVSAAHTPADIEATLAAARATLAAA

SEQ ID NO: 27334 - protein, 383 aa, Rubrivivax gelatinosus PM1
MSPIVVIGSGLAGYTVAKELRKLDRGVAVTLVTEDDGAFYSKPMLSNAFALKKAPAALATAAAAQLAGDYGIEILAGHPVKRIDRAARTIEVAGRDLAYDRLVLAVGGRPIRLRLAGDAADRVLSVNHLADYQHFRRHLESHPRVVILGAGLVGCEFANDLAAAGHAVDVIDIAPRALPRFWPDPMALEFQARLAAAGVRWHLSEAVERIDAIPGGLRITMESGRTLEADTVLSAIGLAANSELAVQAGLAVNRGIVVDRHLQTSDDHIYALGDCAEVDGLLLPFIMPIMHAARALARTLNGERTAVVYPAMPVVLKTPAWPAVFFPPLQPGGGKWHIEREDTGMRGHYRAADGRLLGAALGGSCTREKDAVAKQLPALTGSA

SEQ ID NO: 27335 - protein, 163 aa, Rubrivivax gelatinosus PM1
MITTTIYDFEARSIDGRTVSLADYRGKVLLIVNTASACGFTPQFAGLQSLWQAYGERGLAVLGFPSNEFGGQDPGSNDEIASFCQLNYGVSFPMMAKVEVNGAGAHPLYRWLTGEVKGLLGTRAIKWNFTKFLVGRDGRVLGRYAPTDKPESLTRDIEAALAA

SEQ ID NO: 27336 - protein, 360 aa, Rubrivivax gelatinosus PM1
MTSLFDPIRLGDIELRNRIAMAPLTRNRAVAGRVPSPLAVEYYRQRADAGLIVTEATQISPLGQGYLDTPGIYSREQVEGWKAVTRAVHERGGKIVVQLWHVGRISHVSLLPEGEVPVAPSAITAKSKTFTRNGFEDVSAPRALALAELPGIVEQYRVAARNAIEAGFDGVEVHGANGYLLEQFLRDSTNHRTDAYGGSIENRARLLLEVMRAVTAEIGAGRTGLRLSPVTPANDAALDSDPQALFNHVAEQLAPLKLAFLHVIEGATGGPRDVAPFDYAALRARVKAPWIVNNGYDRDMAIEAVADGRADVVAFGRPFISNPDLVQRLRVGAPFAALDRDTLYGGGAKGYTDYPALQAP

SEQ ID NO: 27337 - protein, 466 aa, Rubrivivax gelatinosus PM1
MTPLSDDALRALAAGGTVLSYVALCAGTWRAHRAREARVARAAAALAPAAEGAQPVLVAHASQTGNAEQIAWQTAQALHTAGVPARIASLAELQAGDLAAAERALFIVSTYGEGDPPDAAAPFVRRLMAQAAETPLALESLHCAVLALGDREYQHYCGFGRALDTWLRRQGAQAMFERIDVDGGDALALQQWQHQVARLAGTSDLPDWQLAAAFEPWRLAHRRLLNPGSAGGPCFHLELEAPAGAAPSPDWQAGDLVQVLPPGDGERPREYSIASLPADGRVHLLVRQERHADGTPGLASGWLTERAAIGDEIALRLRAHGNFRLGDNAGRPLILVGNGTGLAGLRAHLKARAAAGHGANWLVFGERHAAHDAYYRDEIAAWQASGVLERTDLVFSRDQPGKRYVQDRLREQADVLRDWVTRGAALYVCGSRVGMAAGVEAALVDVLGRDAVDRLIETGRLRRDVY

SEQ ID NO: 27338 - protein, 297 aa, Rubrivivax gelatinosus PM1
MTSKTYDPVPSQRVAFLGLGVMGHPMAGHLARAGHSVCVYNRTAAKAQAWVNEYGGRSAPTPCAAAQDADIVFACVGNDADLRSVTTGADGAFQAMKAGAVFVDHTTASADIARELAAAARARGLGFVDAPVSGGNLGAINGALTVMCGGDAADFAKIQPVAMAFSKAVTLLGEAGAGQLAKMVNQIAIAGLVQGLSEAIAFGQKAGLDMKAVLGVIGKGAAQSWQMDNRGPTMVDGKFDFGFAVDWMRKDLGLCLDEAKRNGARLPVTALVDQFYADVQADDGGRRDTSSLIQRLK

SEQ ID NO: 27339 - protein, 162 aa, Rubrivivax gelatinosus PM1
MGNKLYVGNLAYSVRDDDLQQAFGEFGAVTSAKVMMDRDTGRSKGFGFVEMGSDAEAQAAIEGMNGQSLSGRAIVVNEARPREERPGGFRGPYGGGGAGGGGGYGGGGGGRSGGGGGYGGGGGGYGGGGGGRSGGGGGYGGGGGRSGGGGGYGGGGGGRGGY

SEQ ID NO: 27340 - protein, 129 aa, Rubrivivax gelatinosus PM1
MTWLDDIRWDRDGLLPVIAQEAATGDVLMFAWMNREALARTAELGEAVYWSRSRGRLWHKGEESGHIQKVRDMRLDCDNDVLLLKVEQLGHEPSIACHTGRHSCFYQRYESGAWHAVELVLKDPEHIYR

SEQ ID NO: 27341 - protein, 289 aa, Rubrivivax gelatinosus PM1
MKLALLGTGLMGAPMTRRLCAAGLDVTVWNRTRAKAEALASAGARVADTPDAAVRTAELVITMLEHGDIVEELLFAHGLADALPRGALLVDMSSIRPAQARAHAAALAERGVAHLDAPVSGGTVGAEAGTLAIMAGGEAADFERARPAFAPLGRATHVGPHGAGQLAKLANQMIVGITIGAVAEALLLAERGGADPAKVREALRGGFADSRILEVHGQRMVERDFAKRAAITVQIKDLRNALTTGAELGFDAPITQLFEQLYRSAADHGWADADHAGLWLELARRNGMK

SEQ ID NO: 27342 - protein, 503 aa, Rubrivivax gelatinosus PM1
MNLARWLVRAALAHPDRPAVLLGDTVVLDYRTLADRAARLAGHLRGTLGLQPGERVALCMHNHVGYLELLYAAWWAGLVVVPVNAKLHPGEVAFIVGDAEAAVLFVSEDLAPDLRAPLAALPALRQVLTPADAAYRTALEAAAIEPVHRAPDDLAWLFYTSGTTGRPKGVMQSHRNLAAMTACYFMDVDEVTAADAIVYAAPMSHGAGMYNFAFVAKAARHVVPVSGGFDPAELLTLSRGIGRLCLFAAPTMVKRLVSHLRDTGAPAHGFKTIVYGGGPMYVEDIQDALGVMGPCFVQIYGQGESPMTITALSRQHLADRAHPKWLDRIGSVGMAHSLVEVCVVDSRGDPVAAGEMGEVVVRGETVMTGYWRNPEATAQTLRDGWLRTGDLGAMNEDGFLTLKDRSKDVVISGGSNIYPREVEEVLLRHPGVREAAVIGQPDAEWGEIVVAFIVGDGVEPEALDALCLQHIARFKRPRRYRFVEALPKNSYGKVLKTALRQLA

SEQ ID NO: 27343 - protein, 408 aa, Rubrivivax gelatinosus PM1
MQDQVIAASLGAPTLLLEPVGRNTAAALTLAALQAGSDGSDPVLVVSPADQTVTDPGAFASALRRAVEWAARGVIVVIGVKPQRPETGFGYIRLDTSDAHSRVAEFVEKPDAETATRYVDSGDYFWNAGLFVVRASDWLRAIESFRPDIAAATHAAWAARRVDGPFIRPDRALFEVIPAESVDYAVMEKCPKSDIDIRMVGLDAGWSDLGAWDAVWQLGHKDGAGNVSDGDAIIEDCRDTLVHATSRLVSVVGVDNVVVVETPDAILVADRGRSQDVRKIVSRLEGGGRSEHILHRRVHRPWGWYDSVDAGPRFQVKRILVKPGATLSLQMHHHRAEHWIVVSGTAEVTCGDSKRLLTENQSTYIPLGETHRLANPGSIPLEIIEVQSGSYLGEDDIVRFEDSYGRAK

SEQ ID NO: 27344 - protein, 234 aa, Rubrivivax gelatinosus PM1
MSAIRIAPSLLSADFARLGDEVRSVIEAGADLIHFDVMDNHYVPNLTIGPLVCQAIKPHATVPIDVHLMVKPVDALIPMFAQAGADIISFHPEASEHVDRTIQLIRSHGIKAGLVLNPATPLNVLDHVLDQLDLVLLMSVNPGFGGQSFIEGTLPKIEAVRRLIDRSGRDVWLEVDGGVKVDNAQRVGAAGADTLVAGSAVFNSASYAHAIAGIRDNARLGQRASNRMAGDGAT

SEQ ID NO: 27345 - protein, 393 aa, Rubrivivax gelatinosus PM1
MAFMTLDQINLRGQRVFIRCDFNVPLDAAGRITDDTRIRASIPGIRHALTQGARVMLASHLGRPGEGALTPADSLAPVARRVGELLDREVPLVGDWLARPFDVTPGQAVMLENCRANVGEKANSRELALRMAELCDVYVNDAFGTAHRAEATTEALARVAPVACAGPLMASELNALGRALARPARPLAAIVGGSKVSTKLSVLKSLADQVELLVVGGGMANTFLLAAGQKVGKSLCEPDMVETAAQVASTLAARGAELFMPIDVVTATEFSEDAIPAIKALSEVGPDDLILDFGPRSMQALVERLAPCKTIVWNGPLGVFEIEQFSYGTRTLATAIAASQAFSIAGGGDTVAAINRFDVAKDIDYVSTAGGAFLEFLEGRTLPAVKALQDRAA

SEQ ID NO: 27346 - protein, 330 aa, Rubrivivax gelatinosus PM1
MDKVLVARAAFPDIVDRLRAHFEVEDNPSDTVLDKAQLIARLQGKAGAFTTGSERIDAEVLAACPQLRAVCNMAVGYNNIDVAACTARGVIVTNTPDVLTETTADFGFALMMAAARRIAESEHYLRRGEWTKWHYDQLVGSDVHGATLGILGMGRIGQAIARRGALGFGMPVIYHNRSRLAPEIESALNARYVDKATLLRESDHLVLVLPYSAASHHAIGAVELTHMKPTATLTNIARGGVVDDAALAEALKARRIAAAGLDVFEGEPKLNPALLELPNVVLTPHIASASVATRRAMASLAVDNLIAALGCGPQAGRPPTPVNPEVLAPR

SEQ ID NO: 27347 - protein, 168 aa, Rubrivivax gelatinosus PM1
MSRPALEFAVCDLCDEHKNDTDGAFRVLPPVFHSYGGVAKFAGPVSTVKCFEDNSLVKLALDEPGQGRVLVVDGGGSLRRALVGGNIGAAAAKNGWAGVLVNGCVRDAAELAASAVGIRALALMPLPTEKRNEGQRDVAVQVQGVWVRVGDWLYADEDGVVVMPSPAG

SEQ ID NO: 27348 - protein, 478 aa, Rubrivivax gelatinosus PM1
MTMHRATKIVATLGPASSTPDVLERMITAGVDVVRLNFSHGSAQDHIARAALVREVAQRAGKEVAIMADLQGPKIRVGKFAQGKVMLEPGAAFVLDAARSEPGDLQAVGLDYKSLPRDVKPGDTLLLNDGLIVLTVDKVIGEAVHTVVKIGGELSNNKGINKQGGGLTAPALTAKDMEDIKTAMSFQCEYLAVSFPKSATDMEMARQLANVAGEPWRHKPALIAKIERSEAIPVLEQILKASDGIMVARGDLAVEVGNAAVPALQKKMIKLARELDKVVITATQMMESMIVNPVPTRAEVSDVANAVLDGTDAVMLSAETAAGKYPVETIEQMAAIALAAERAEDVALDADFTNKRFGRIDQSIAMGALFTAHHLGCKAIVALTESGSTALWMSRHKIHVPIFALTSQQTSQRKMTLYRNVRPLLMPSYTDRDEALAKAEALLVDGGVLKPGDTYAITCGEPMGYPGGTNMLKVCRVA

SEQ ID NO: 27349 - protein, 397 aa, Rubrivivax gelatinosus PM1
MKVLRFSDLIQQGRVAGQRVFIRADLNVPQDDAGRITEDTRIRASIPCIEMALAAGAAVMVTSHLGRPTEGEFKAEDSLAPVARRLAELLGRKVPLLQDWTGGVEVAPGELVLLENCRVNKGEKKNDETLARKMAALCDIFVHDAFGTAHRAEASTYGIAQFAKVACAGPLLAAEIDAITKALKSPKRPLVAIVAGSKVSTKLSILKSLAANVDQLIVGGGIANTFMLAVGLSIGKSLAEPDLVDEARAIIDMMKARGAAVPIPIDVVVADEFSAIARANKVTATEVRPDDLILDIGPRTAAELAGIIARAGTVVWNGPMGVFEYDQFAGGTRTLAAAIAHSPAFSIAGGGDTLAAIAKYGIEKDIGYISTGGGAFLEVLEGKTLPAFEILEQRAAG

SEQ ID NO: 27350 - protein, 180 aa, Rubrivivax gelatinosus PM1
MRRLAIAALLCIVGSGAQAACPPLLDRSFPRLQDEKPQNLCQYAGKVVVVVNTASYCGFTSQYKGLEALHARYQSRGLVVLGFPSNDFGSQEPGSNQDIAAFCENTFGVRFPMFAKSSVKGSARNPLYADLAQRTGKTPAWNFHKYLIGRDGQVVLSFSSQTDPQDPVFVQEIEKLVDSQ

SEQ ID NO: 27351 - protein, 352 aa, Rubrivivax gelatinosus PM1
MSIEVRNLNKRFGPTVVCDDISIDIPSGELVALLGPSGSGKTTLLRIIAGLEVPDSGSVLFHGEDATRTDVRERQVGFVFQHYALFAHMTIFENVAFGLRVRPKATRPSEAEIRSKVTALLKLVQLDWIADRFPHQLSGGQRQRIALARALAVEPKVLLLDEPFGALDAKVRKELRRWLRRLHDEVHVTSVFVTHDQEEAMEVADRIVVMNQGRVEQDGPPDQVYDHPASPFVLQFLGDVNLFHGRFGAGRGDAKVSGEVSYVRPHELAILAAPAEGSLPVTLSQALTVGPNTRVEFKRVDDGSYIDVELPRSEFHALRERFPLDPGATVHLLPRRVTRFAQESEADPAAMI

SEQ ID NO: 27352 - protein, 229 aa, Rubrivivax gelatinosus PM1
MSPQRHFRIAPSLLSADFARLGEEVKDVIAAGADWIHFDVMDNHYVPNLTFGPMVCEALRKHAVTAAGVRVPIDVHLMVQPVDALAQAFAKAGADLVSFHPDASTHVDRTLQLIKDAGCQAGLVFNPAASLDVLEWVIDKVDLVLLMSVNPGFGGQSFIPSTLKKLARVRQLIDASGRDIRLEVDGGIKTDNIRAAADAGADTFVAGSAIFGQPDYKAVIDAMRARLAA

SEQ ID NO: 27353 - protein, 487 aa, Rubrivivax gelatinosus PM1
MREPNEADDAAVARARAADAAPLRSVAALPGPRGWPLIGNLLQFDLPRLHRQFEDWADRHGPTYRLRLGRREVLVISDAETIAALLRDRPDTWRRMRPIEAVIREAGGHGVFSAEGDDWRRQRRLVMSAFDPGHLKRFYPSLQRVTERLMASWREAARRGEAIDLQASLMRYTVDVTTGLAFGVDLNTIDAPHPLQEHLDKLFPMLFRRVNLPFPYWHYLRLPIDREYDRHLRRVHEAVRGFVQAARQRLQDEPTRRERPTDLLEAMLAARDADGSALTEEEVAGNVLTVLLAGEDTTANTLGWAIWLLHEHPDDWQALVAEVDAALGDARLPPSFDAARGLASIEASVGEAMRLKPVAPLLFMEANRETALAGFRLPPGAVVFCLMRRAALDARLAEDVADFRPGRWQDGADRAVQKASMPFGAGPRLCPGRYLALLEMKMVLGMLARNFELLEVGPEGGGAPGERMAFTMFPVGLKMRLAERARR

SEQ ID NO: 27354 - protein, 291 aa, Rubrivivax gelatinosus PM1
MISFAECSARERLARVFDAATFHEWLPPTERVISPHLEQLGVPSAFDDGVAIGRATLEGHTVFVAAQEGEFMGGGVGEVHGAKLVGLLRRALRDRPAAVLLLAESGGVRLHEANAGLIAVSEVMRAVLDVRAAGIPVVMLIGGANGCFGGMGIVARCADRVVMSDMGRLAMSGPEVIEASQGVEEFDSRDRALVWRTTGGKHRWLSGDCDVLVKDDVAAFRAAAIDALDASRPVSMETLEREHALLARRLRLLPDALDSDEAVALWGLLGVADAARVPDLDVDALRSLRTV

SEQ ID NO: 27355 - protein, 257 aa, Rubrivivax gelatinosus PM1
MSGDPKLQALGLYKRYGAHEVLKGVSLTARAGDVITVVGSSGSGKSTLLRCLNLLEQPSQGRLLLGSEELALVPDRDGSLRARDAKQLQRWRARLAMVFQSFNLWQHLTALQNVIEAPMQVLGLGKAEATERAQALLARVGVAHRASTFPAHLSGGEQQRVAIARALAMEPEVMLFDEPTSALDPELVGEVLKVMRDLAAEGRTMIVVTHEMGFAREVSNHTLFLHQGLIEEQGPPREVLAQPRSERLRAFLSGGLK

SEQ ID NO: 27356 - protein, 433 aa, Rubrivivax gelatinosus PM1
MSAIVDIVGREILDSRGNPTVECDVLLESGVMGRAAVPSGASTGSREAIELRDGDKGRYLGKGVLKAVEHLNTEVSEAVLGLDASEQAFLDKTLIDLDGTDNKARIGANATLAVSMAVARAAAEESGLPLYRYFGGMGGMQLPVPMMNVVNGGAHANNSLDLQELMIIPVGAPSFREAVRWGAETFHALKKILHDKGISTAVGDEGGFAPSVENHEAAIQMILEAIDKAGYTPGTQIALGLDCAASEFYKPGKNGSLVYQLDGEGGLSLSAQQWTDMLAGWVDKYPIISIEDGMAEGDWAGWAHLTEVLGKKVQLVGDDLFVTNTKILQEGIDKGIANSILIKINQIGTLTETFAAIEMAKRAGYTAVISHRSGETEDSTIADIAVGTNAGQIKTGSLSRSDRMAKYNQLLRIEEDLGDVAVYPGRAAFYNLR

SEQ ID NO: 27357 - protein, 479 aa, Rubrivivax gelatinosus PM1
MVTEYRNYIDGEFLANRSGALIDVHNPATHELLARVPDAPNDVVDLAVQAARTAQPGWAKLPAIQRAQHLRAIAARLRENVEELAHTITAEQGKVLGLARVEVNFTADYMDYMAEWARRLEGEVLTSDRVGESIFLMRKPIGVAAGILPWNFPFFLIARKLAPALITGNTIVIKPSEITPINAFEFARLASQTDLPRGVFNLVGGTGAGAGAQLTSHRDVGIVSFTGSVETGTRIMTAASKNLTRVNLELGGKAPAIVLADADLDLAVKAIYDSRVINTGQVCNCAERVYVQRKVADEFTSKIAARMAGTLYGDPLAQPDVAMGPLVSQAGLDKVAGMVDRARAAGASIVQGGRKANRDKGYHYEPTVIANCSADMEIMRKEIFGPVLPIQVVDELDEAIALANDSDYGLTSSIFTKDLNSAMRAVRDLQFGETYVNREHFEAMQGFHAGRKKSGIGGADGKHGLYEFTETHVVYIQHG

SEQ ID NO: 27358 - protein, 452 aa, Rubrivivax gelatinosus PM1
MGDSLNAALLQRDHRHLVHSLHNEAAHLAGNVWVKGEGTTLTDADGKRYVDAMSGLWNVTLGYGRRELVDAAAAQMGELAYASGYAGSTNLRAMELAEKLAADRVYPNMHRFFFTSGGGESTDSTIKTARYYWKAQGKPGKFKTLSVMGGYHGVTLAAMCATGMPAYWPSFEPRMPGFVHIPNHDAYRYTVPPGGDPATAAADELERAILAEGPDTVALFIAEPVMGGGAYVPPAGYFRRIREICDRYDVLFATDEVITGFGRTGKLFALGHWGSDVQPDLVQFAKGITSGYVPMGGVGLSDKVAAVFDRPGADTWMHCYTYSGHPVACAVALATLDVIEREGLLARAQVLGDRLLRGLRGALGGHPNVGDIRGLGLIAAVELVEDRFSKKSFDPARKMGPQVLAQVRQRGVITRGRGDTIYLGPALVSDEATIDRIVEAVAEGVGALLPAA

SEQ ID NO: 27359 - protein, 244 aa, Rubrivivax gelatinosus PM1
MIDIKNISKWYGSFQVLTDCTTNVKKGEVVVVCGPSGSGKSTLIKTVNALEPFQKGDIVVDGISIADPKTDLPKLRSRVGMVFQHFELFPHLSVTENLTLAQIKVLKRNPDEAKKRGLKMLERVGLIAHKDKFPGQLSGGQQQRVAIARALSMDPIVMLFDEPTSALDPEMVGEVLDVMVQLANEGMTMMCVTHEMGFARKVSHRVIFMDQGKICEDCKKEDFFGDPSARSPRARDFLSKILQH

SEQ ID NO: 27360 - protein, 306 aa, Rubrivivax gelatinosus PM1
MKANTVLDTIGSTPHIRMQRLFGAGHEVWIKSERSNPGGSIKDRIALSMVEAAERDGRLRSGGTIIEPTSGNTGVGLAMVAAVKGYRLVLVMPDSMSVERRRLMLAYGASFVLTPREQGMKGAIAKAQELIAATPGSWMPQQFDNPANIDVHVRTTAQEILADFPQGLDALITGVGTGGHITGCAQVLKAQWPQLKVFAVEPSASPVISGGKPSPHPIQGIGAGFVPTNLHTALLDGVIQVEAEAAREMARRSARDEGLLVGISSGATLAAIAQKLPELPAGSRVLGFNYDTGERYLSIEGFLPAE

SEQ ID NO: 27361 - protein, 199 aa, Rubrivivax gelatinosus PM1
MLDREGFRPNVGIVLLNQRNQVFWGKRIRTHSWQFPQGGIKYGETPEQAMYRELHEEVGLQPEHVRILARTRDWLRYEVPDHYIRREARGHYRGQKQIWFLLQLTGRDNDMNLRACDHPEFDAWRWNEYWVPLEVVIDFKRDVYQMALTELARFLPRANHHNRYLRSGMRAHRREDEERSNGEAPMEAADGETTPEGPR

SEQ ID NO: 27362 - protein, 443 aa, Rubrivivax gelatinosus PM1
MTRGPDTLAERSRRAVWHPCTQMKRHEREPLLAIARAQGPWLFDPDGHRYLDAVSSWWVNLFGHGHPQLRDALAEQLATLDHVMLAGLTHEPVVELSERLAALTGLGHAFYASDGASATEIALKMSAHSWRNRGRPQKCEFVGLAGGYHGETVGALSVTDIALFREAYAPLVRLSAALPSPDTRHAAPGEDAAAHARRCAASLEAYLDQHHERTAALIVEPLVQCAAGFGMHDPEYLRLARALCDRYQVHLICDEIAVGFGRTGTLFAHQQAGIRPDFICLSKGLTGGTLPLSAVLTTDAVYESFYDDLASRGFLHSHSYTGNPLACRAALTVLDLFEQPIDGEPVLAHNRRTAARLTALCEPLNAHPRVRAVRQLGMLWAWDIDDDGVVGFSSAYHLAAREQGLLLRPIGNTLYFMPPYVLDDGALEQLAGGALRALEVALA

SEQ ID NO: 27363 - protein, 506 aa, Rubrivivax gelatinosus PM1
MRYAPPGSSDSKVAFKAQYDNFIGGKFVAPVKGQYFDVITPITGKTYTRAARSGPEDIELALDAAHAAADKWGRTSAAERANVLLKIADRIDANVELLAYAESVDNGKPMRETLNADIPLSADHFRYFAGCVRAQEGGVSEIDETTVAYHFHEPLGVVGQIIPWNFPILMAAWKLAPALGAGNCVVLKPAESTPVSILVLAELIADLLPPGVLNIVNGLGREAGMPLATSKRIAKIAFTGSTSTGRVIAQAAANSLIPATLELGGKSPNVFFADVMDKDDAFLDKAIEGLVLFAFNQGEVCTCPSRALIHESIYDKFMERALKRVAAIKQGSPLDTDTMIGAQASKEQLTKILSYLDLGKQEGAQVLIGGQQAQMSGDLDGGYYVQPTIFKGHNKMRIFQEEIFGPVLAVTTFKDEAEALAIANDTLYGLGAGVWSRNGNVAYRMGRAIKAGRVWTNCYHAYPAHAAFGGYKESGIGRENHKVMLDHYQQTKNLLVSYSENKLGFF

SEQ ID NO: 27364 - protein, 489 aa, Rubrivivax gelatinosus PM1
MHHITPVVLAGGSGTRLWPLSRALYPKQFLALSGTSTLFQQACLRLAALADPHTTIAAPLVVGNEEHRFMLLEQLREIGTSQSTLLLEPIGRNTAPALTLAALASRAAHGDDSILVVTPADQTVTDGPAFTRALRQAVAAAADGSLVTLGIVPDRPETGFGYIHSEGADAVRRVKAFVEKPDRATAERYLDDGGYAWNSGMFVLRASVWLAALAHFRPDIAQATEAAWAGRSTDASFVRPDKAAFAAIPGESIDYAVMEPCPADAASGFSVKMVPLDAGWSDLGAWDAVWQVSERDAQGNASHGDALIEDSRNTLVHATSRLVGAIGLDDVIIVETPDAVLVTDRSRSQQVKQIVASLQREGRSEGTLHRRVHRPWGWYDSVDAGARFQVKRILVKPGATLSLQMHHHRAEHWIVVSGTAEVTCGESKKLLTENQSTYIPLGEVHRLANPGSIPLEIIEVQSGSYLGEDDIVRFSDTYGRADGVGTDRK

SEQ ID NO: 27365 - protein, 247 aa, Rubrivivax gelatinosus PM1
MTQLVLIRHGESTWNLENRFTGWTDVELTPTGVAQAQQAGRLLKQAGIDFDTVYTSVLKRAIWTAWHCLDGMDRTWLPVIKDWRLNERHYGGLQGLNKADMAKQFGDEQVLLWRRSYDVPPPPLEANDPRSERSDVRYAKLAANQVPLTECLKDTVARVLPLWYGTLAPAIAAGQRLVIVAHGNSIRALVKHLNNISDADIVGVNIPNGIPLVYDLDANLKPTSKYYLGGADAAAQAASVSALQADG

SEQ ID NO: 27366 - protein, 217 aa, Rubrivivax gelatinosus PM1
MKLILLGAPGAGKGTQATFICQKFGIPQISTGDMLRAAVKAGTPLGLEAKKVMDSGGLVSDDIIIGLVKERITQPDCANGFLFDGFPRTIPQADAMKAAGVKLDLVLEIDVPDEAIIERMSGRRVHVASGRTYHVKFNPPKVAGVDDVTGEPLIQRDDDKEATVLKRLQVYQSQTRPLVDYYAAWAATGDAAAPKYRKIAGTGSVDEITTRALAALA

SEQ ID NO: 27367 - protein, 489 aa, Rubrivivax gelatinosus PM1
MIDLQGALMTPVRDVDVAILGAGSAGLSAYRAAREHTDRVLLIDPGPLGTTCARVGCMPSKLLIAAAEAAHAVDDATRFGIDVQGVRIDGARVMARVRAERDRFVGFVLDDIERIAPDHRLDGVARFLDPHHLQVDGPGGALTVRADRMVIATGSRPRLPPEWRSALGDRLIVNDDVFDWQDLPRSVAVVGTGAIGLELAQALHLLGVRVRLLGRGPTVGPLSDPALAALAASHFDATLPLQRDATVQRVERLGDEVAVHWRSASGTQSEHFDVLLAAIGRRPNTDALGFEHTGLDCDADGVPLRDPTTMRIGHSHIFIAGDAGDDRPLLHEASDEGLIAGHNAGRYPDVQAGRRRTPLAVVFCEPQIAMAGRSHRELTAAGTRFATGTVSFENQGRSRVIGRNVGALHVYGERGTRRLLGAEMLGPAAEHLGHLLAWSIGRGETVDEALAQPFYHPVIEEGVRTALRQLRQALDRPEPAPCEGCAPGD

SEQ ID NO: 27368 - protein, 235 aa, Rubrivivax gelatinosus PM1
MNKVYPSAKAALDGIVKDGQLLAVGGFGLCGIPEALIDALRDSGVKDLTVISNNAGVDGFGLGKLLDTRQIRKMISSYVGENKEFERQFLAGELELEFTPQGTLAEKLRAGGAGIPAFFTKTGVGTMVAEGKETREFDGAVYVMERSLLPEVSLVKAWKADKSGNLLFRRTARNFNPAVAMAGKLTVVEVEEIVETGHFDPDAVHLPGIYVHRIVLNATPEKRIEKRTITEKAGV

SEQ ID NO: 27369 - protein, 251 aa, Rubrivivax gelatinosus PM1
MSDIRRKLVVGNWKMHGTHATNEALLEGLKSAGPLPCEAAVCAPFPYLAQAAERLARSAIAWGAQDCSVHEQGAYTGEVSVAMLADFGCRYVIVGHSERRALHAESDQLVADKAQAALARGVTPIVCVGETLAQRDAGETEDVVKRQLSAVIHTLAHCVGEMVVAYEPVWAIGTGRTASPEQAQAVHALLRAQLAAATPRAAQMKLLYGGSVKPDNAATLFAQVDIDGGLIGGASLKAADFIAICRAASTR

SEQ ID NO: 27370 - protein, 328 aa, Rubrivivax gelatinosus PM1
MQAIEISQPGGPEVLRLVERPEPEPGPGELLIDVAAAGVNRPDVLQRAGAYPPPPGASDLPGLEVAGRIVGGDAGALAAAGFRLGDRVCALTHGGGYAQRCVAPVGQCLPVPAGWSDIEAASLPETLFTVWINVFERARLQPGETLLVQGGASGIGVTAIQLAKAFGCRVFVTVGDDARAQACRAIGADEAINYRTRDFVAEVERLTGGRGVDVILDMVAGSYVARELRCLADDGRLSIIAVQGGTKAEFDAGALLRRRLTITGSTLRPRTTEYKAAVGAALRARVWPLIEAGRFKPMIHKTFPAAQAAQAHELMESGQHVGKLVLTW

SEQ ID NO: 27371 - protein, 457 aa, Rubrivivax gelatinosus PM1
MSRTYFGTDGIRGAVGQAPITPDFVLRLGHAVGRVLKSQQTSPASRPTVLIGKDTRISGYMLESALEAGFASAGVDVLLTGPLPTPGVAYLTRALRLSLGVVISASHNPYGDNGIKFFSAKGEKLPDSWEQQVEATVEEAAQWVDSSGLGKARRLDDAQGRYIEFCKSTVAGELSLKGLKLVVDGAHGAAYQVAPAVFHELGAEVISIGCNPNGLNINDGFGATHPEALVSAVQAHQADYGIALDGDADRLQLVDATGRLYNGDELLYLMTLDRLAAEPSEDAAPSRVGVPGVVGTLMTNLAVEQALAARGVAFVRAKVGDRYVLEELLARGWQLGGEGSGHLIALDKHTTGDGLVSALQVLQAVVRSGRTLAQLLEGLTLFPQVLLNVRLQPGQDWKASAALAEAQRESLAELGERGRILIRPSGTEPLLRVMVEASDAALAQRCAQRMADAVRRA

SEQ ID NO: 27372 - protein, 370 aa, Rubrivivax gelatinosus PM1
MADSAASPLDPALLGLRQQIDAVDRELLALLNRRASLAQEVGGIKKREGSVVFRPEREAQVIDGLKASNPGPLQADSVAPIWREIMSACRALETPTRVAYLGPAGTFSELAALGYFGSSIVRVPCASIDEVFRTTTAAAADFGVVPVENSTEGVVARSLDLLLTTPLFLIGETSLFVRHNLLRQTNSLAGIQAVCAHPQALAQCHGWLSYHLPDVERRPVASNAEGARLASLDPGLAAVASERAGSEFGLHVVAPAIQDDPHNRTRFVIVTHPDRHPQPKASGHDCTSLVVSVNNRPGAVHDMLVPLKQHGVSMTRFESRPARSADQWEYYFYIDLQGHPDEPAVAAALAELRAACSFFKLLGTYPLDVH

SEQ ID NO: 27373 - protein, 507 aa, Rubrivivax gelatinosus PM1
MQTSLKDLLAHGADAAPAISAPGRTALSYRELRALVDATLASLNALGAGRNDRVAIVLNNGPEMATCYMACASGTTSAPLNPAYRADEFEFYLSDLNAKLLIVEQGSSSTAIEVAQKLGVRVVDLIVEPGAPAGSFRLAARDGGSAAAAGQGGYGEAGDVGMVLHTSGTTSRPKIVPLSVGNLCASAANIRKTLQFTAGDIGLNIMPLFHIHGLIAGVLAPLSAGSQVFCTPGFNALKFFAWMDEAKPTWYTAVPTMHQAIVQRAKGNADVIARNPLRFLRSSSSSMPPQVIKELEEIFKAPLIEAYGMTEATHQMASNPLPPLTRKPGAVGLPAGPEVEIMGEDGSLLAVGQIGEIVIRGPNVTAGYENNPKANAEGFLNGWFRTGDQGSKDADGYISLTGRLKEIINRGGEKVSPREVDEILMDHPAVGQCVCFGMPHPKLGEEVAAVVVLKEGASATEREIQDFVAKRAADYKVPKKILFMDEIPKGATGKLQRIGLAQKLGLG

SEQ ID NO: 27374 - protein, 272 aa, Rubrivivax gelatinosus PM1
MSRIAATFERLRGQRRTALIPYITAGDPYADATVDIMLAMAGAGADVIELGVPFSDPMADGPVIQKASERALAKGIGMGQVLAMVRSFREHNDTTPVVLMGYANPVERYGIDRFVADAKSAGVDGVLVVDYPPEECEAFAAQLQGADLDPIFLLAPTSTEQRMKDVGRIARGYVYYVSLKGVTGAGHLDTDAVATMLPRIREHVKVPVGVGFGIRDAATAKALAAVADAVVIGSRIVQLLEAEPRESVAAVGGTFIASIREALDSSTEGVRA

SEQ ID NO: 27375 - protein, 414 aa, Rubrivivax gelatinosus PM1
MAGTDDTKRLPRVDLPADVRLDTLAVREGLPPSQYGENSEALYLTSSFVHPDAATAAARFANEEEAFVYSRFSNPTVTMMERRLAAMEGTEACIASSSGMSAILLLCLGLLKAGDHVICSQSVFGSTIKLLGGELARFGVETSFVSQTDVAAWQAAVRPTTRLLFAETPSNPLTEVCDIAALADVAHRAGALLAVDNCFCSPALQQPVKLGADLIVHSGTKYLDGQGRVLAGAVCGPAHIVNDKLVPLMRSAGMSLSPFNAWVVLKGLETLAIRMAAQSERALGLARWLEAHPAVQRVFHPGLPSHPQHALAMAQQNGCGGAVVSFIVKGEGAELARRNAFHVIDSTRICSITANLGDTKTTITHPASTSHGRLTEAQRLAAGITQGMIRVAAGLDDLDDLKADLARGLDTLTA

SEQ ID NO: 27376 - protein, 459 aa, Rubrivivax gelatinosus PM1
MKSYDFDLFVIGAGSGGVRTARMASERGLRVAIAEVSRLGGTCVNVGCIPKKLFVYAAQFTEAFQQARGYGWRVPEAAFNWSTLRDNKDAEIERLNGVYRALLVDSGCQLIEGHATIKGAHTVAVDGRSWSTERMVIATGGWPFVPNVPGREHAITSNDFFLLEHFPKRAVIVGGGYIALELASIAAGLGAQTRLVYRGALFLRGFDEDIRRVAAEEMMRRGVFLNFGCEISAIEKQADGSLLVTFSNGRRESTDCVLYATGRLPNVAGLGLENTRIRQQAHGAIVVNEHLQTDEPSIYAIGDAVGRTQLTPVALAEGMQLVRHLLGDEGPQVDYEMVPSAVFSLPAIATVGLTEAQARLRYKDVVVYKSSFRALKQTLAEGNERTFAKLLVDHDSDRVVGVHMVGADAAEIIQGMAIALRAGATKQVFDTTLGVHPTSAEEFVALRKPSHEPFITTGP

SEQ ID NO: 27377 - protein, 411 aa, Rubrivivax gelatinosus PM1
MTIHPGFPLSASPIALEEHYGAANYAPLPVVLTRGEGVYLWGQDGRRYLDMMSAYSAVSFGHGHPRLVEALVAQARQLAVTSRAFHTDRLGPFLERLCRLTGMDRALPMNTGAEAVETALKAARKWGYTVKGIAEGHAQIIVAANNFAGRTTTIVGFSSEAQYRSGFGPFAPGFVTVPYGDAAALEAAITDDTCAFLVEPVQGEAGIVVPPVGYLKAVREICTRRGILMICDEVQTGLGRTGRVLACDHEGVRPDGLTLGKALGGGLLPVSAFLAREEVMAVFTPGDHGSTFGGNPLAAAVGDTALQVLVEEKLSERAAEQGAVLLERLHALRHPAIRDVRGKGLLVGVEIDPGFASARTVCEGLMQEGVLSKDTHGTVVRFAPPLVIGAREIGDAVAALGRALERLGKAP

SEQ ID NO: 27378 - protein, 294 aa, Rubrivivax gelatinosus PM1
MPAPPRSARRPGIAPALVALLLGLVLLTAGCASLDTQQRRWIFQPAASPWAGGVTAAEGMDDVWIDFDSTATGRPARLHGLWHPRPDGTQAGAPVLLYLHGARWDVTGSARRVRRMQELGFNVLAIDYRGFGRSAPGELPSEQMAYEDARAAWDWLAVQHPGAPRYIFGHSLGGAIAIDLAAQVPDEAGLIVEGSFTSVRDVFSQMRWGWLPLGPLITQRFDAQEKVARVGSPLLVVHGSEDRLIPPALGKALYERAASPKRWLLVEGGSHHNTNAVGQGAYREALRELFGLAS

SEQ ID NO: 27379 - protein, 475 aa, Rubrivivax gelatinosus PM1
MSKTFDVVVIGGGPGGYIAAIRAAQLGFNTACIDEWKNDKGGPAPGGTCTNVGCIPSKALLQSSEHFEHAGHAFADHGIGLKDLSIDVAKMLGRKDTVVKQNNDGILYLFKKNKVSFFHGRGSFVKAGDAGYEIKVSGATEDTLIGKDIIIATGSSARALPGAPFDEESILSNDGALRIPSVPAKLGVIGSGVIGLEMGSVWRRLGAEVTVLEALPTFLGAVDEQIAKEAQKAFMRQRLKIELGVKISEVKKDKKGVSVSYTSAKGDAKTLEVDKLIVSIGRVPNTTGLNAEAVGLKLDERGAIVVDDDCRTNLPKVWAIGDVVRGPMLAHKAEEEGVAVAERIAGQHGHVNFNTIPWVIYTSPEIAWVGQTEQQLKAAGRAYKAGTFPFLANGRARALGDTTGMVKFLADAATDEILGVHIVGPMASELIAEAVVAMEFKASAEDIARICHAHPSLSEATKEAALAVDKRTLNF

SEQ ID NO: 27380 - protein, 510 aa, Rubrivivax gelatinosus PM1
MFDVAMPWAVLGDGSRRDAERLPLFGVAATRALEIEAARALPPHTLMQRAGGSVARLALALAPHARRIWIAAGPGNNGGDGLEAAAWLQRTGKQVTVSLAPCVQTPVDAAAAGAEARAAGVALVESSAPPEPLGPDDLAIDALFGIGLTRAPAGWALAAMRSLNDGGTPVLSIDLPSGLDAEQGALLDETAVVQARWTLSLLTLKPGLFTAQGRDHAGQIWFHDLGVHAEASQASAGLLTGASSLWPARRHAQHKGSFGDVWVVGGAAGMAGAALLAARAALAAGAGRVHLVQLDPQSPTLDPMHPELMLRPLAALHDARTPLENATVVCGCGGGDAVREHLPGLIARAGRLLLDADALNAVAADPSLARLLEMRAGRGRAATLLTPHPLEAARLLGLQTDAIQSARLSAAERVAQRWHATVVLKGSGSVIAAPGETTLINASGNASLATAGTGDVLAGWIGGLWAQGLSARSAALLGTHTHGAAADVWCAHQARPGPLAASALIAQLRR

SEQ ID NO: 27381 - protein, 451 aa, Rubrivivax gelatinosus PM1
MADAPSSLAEFARSAGASLAAEGVHTLLVQFTDLHGVAKGKLVPLHQLETVLTDGAGFAGPSIWGTGLPRTGPRAEYYARGDAATLQALPWMPGVARLVGDGFVNGGAFDACPRQVLKRATARLAARGWTLQTGIEPEFFLLRREGVRYVPVDDADRLDKPSYDLKSLPRQQGFLQALRVALEGAGLQVLQIDHEDAHGQYELNFRHDEALRSADHVMLFKLAAHALAEQRGCVFSMMPKPFANQPGSGLHFHVSLWDAGRCLFDAADAAEPLSRLGRQFVAGVLAHSAALCALAAPTVNSYKRLVVGESLSGTSWAPAYVAHGPNNRTALVRTLAGRFEWRVPDASANPYLATAALIAAGLDGIDRELDPGPACTDDLFALSLAEIRTRRIAMLPQSLGEAVDAFEASELLHGALGDTLHREFVRLKRAEWIDYARHVSDWEHARYGATF

SEQ ID NO: 27382 - protein, 426 aa, Rubrivivax gelatinosus PM1
MKISRNEQLMARKAAATPRGVGVMAGFFADRAENALLWDVQGQRYIDFAGGIAVLNTGHRHPKVVAAIEAQLQRFTHSCYQVVPYESYVALAEKLNAMTPGKHAKKTAFFSTGAEAVENAVKIARAHTRRGGVIAFGGAFHGRSLFAVALTGKVQPYKAGFGPFPPEIYHAPFPCHGASLDAAKKAVEQLFKADIEPSRVAAIVFEPVQGEGGFNVIQAEAVKWLRKLCDEHGIVMIADEVQTGFGRTGKMFAMQHFNVVPDLLVSAKSLAAGLPLSAVTGSAEIMDAPAPGGLGGTYAGNPLAIAAAHAVIEVMAEEKLPERGQQLGNELKTLLNGLRAEVPQIADVRGLGAMVAVEFQHPKTQAPDADMTKRVQAEALRRHLILLSCGVDGNVLRFLFPLTIEHAVFGEALGILSDALKAASRG

SEQ ID NO: 27383 - protein, 499 aa, Rubrivivax gelatinosus PM1
MTTATIDWHARSAALTLDGRAVIGGERHPARAGESFDCISPIDGRVLGRVARGQSADIDDAVASARAAFDDGRWSRRPPAARKRVLQAFAEKILSAKEELALLETLDMGKPIQYSLSVDVPSTARCIAWYAEAIDKVYDEIAPTGPGALALIRREAMGVIGAIVPWNYPMIMAAWKLGPALAAGNSVVLKPSEKSPLTALRLAELALAAGLPPGVFNVVPGYGHEAGEALALHPQVDAIGFTGSTRVGRKMLEYAGRSNLKRVYNELGGKSAFLVFPDFDDLDRCAATVAGSMFFNQGESCNAPSRLLVHESIADDFARRVAAEAPQYRPADPLDAKTVMGALVDDGQLRTVMGYIDAGRSEGATVLAGGTQARTDSGGYYVEPTVFDGVRNDMKIAREEIFGPVLSIIRFKDEAEAIRLANDSPYGLQASVWSSHIDRAHRVAASLRAGTVHVNQYDEDDITVPFGGFKQSGNGRDKSLHAFDKYTELKTTWLRINAA

SEQ ID NO: 27384 - protein, 459 aa, Rubrivivax gelatinosus PM1
MSRTTQDWQAADAAHFLHPFTDFDALAKKGSRIIERAENIYLWDSEGHKILDAMSGLWCVNVGYGRQELIDAATAQLKQLPFYNAFFQTATPPAIELAELLSEVTPPQFRHVFFSGSGSEGNDTVVRMVRRYWDVLGQPERKVIISRNNAYHGSTMAGASLGGMSGMHAQGGLPIPDITHIEQPYWYELGRPQGLSRDDFGRLAASWLEKKILEVGPERVAAFIGEPVQGAGGVIIPPATYWPAIQAICDKYGILLVSDEVICGFGRTGRWWGCETMGTRPDLMTFAKGVTSGYIPLGGVMVGERVARVLIEQGGEFNHGYTYSGHPVACAVALANIRLIQRERLVDRVRDDLGPYLAQHFEALKAHPLVGDAETCGLMGAVVLARDKASGTPFASDLEVGMVCRGHCFGNGLIMRAVGDRMIIAPPLVMTRDQIDEMMVLIKRCLDLTWADVKARGWV

SEQ ID NO: 27385 - protein, 455 aa, Rubrivivax gelatinosus PM1
MVVRDNFTFSELEQWLNERRVTEIECLVPDLTGVARGKILPREKFTEDRGMRLPEAVVAMGVTGEFPEEGPYYDVISPTDQDMHLRPDPTTVRIVPWATDPTAQVIHDCFDRNGKLVPFAPRSVLRRVCELFESEGWNPVVAPELEFYLVARNTDPDVPLKAPVGRSGRSETSRQAYSIDAVNEFDPLFEDVYDYCEKMELNVDTLIHEVGAGQMEINFFHAHPLGLADEVFFFKRTVREAAMRHNMFATFMAKPIAGEPGSAMHIHQSIVSKATGRNIFSNADGTPSQEFYWYIGGLQKYVPAAMALFAPYVNSYRRLVRSNAAPINIQWGTDNRTVGIRSPVATAAARRIENRVIGADANPYAALAATLACGYLGIKNRIEPTPECKGDAYLGDFQLPRSLGEALELLRAEKDLAEVLGESFVTVYTEVKEIEYAEFMKVISPWEREHLLLHV

SEQ ID NO: 27386 - protein, 435 aa, Rubrivivax gelatinosus PM1
MTTDLDAYWMPFTANRQFKKAPRLLSKASGMHFWTPEGREVLDGIAGLWCVNAGHARPKIVEAIRAQALELDFAPPFNMAHPKAFELAERLVQLTPAGLNKVFYTNSGSESVETALKMAIAYHRARGEGSRTRLIGRERGYHGVNFGGISVGGMVANRKMFGSMLTGVDHIRHTHDPARNAFSIGQPQHGAELADDLERLVALHDASTIAAVIVEPVAGSTGVLLPPQGYLERLRAICDKHGILLIFDEVITGFGRTGAPFAAQRFGVTPDLMTVAKGLTNGCVPMGAVFAKQHIHDVFMNGPEHLIEFFHGYTYSGHPLACAAALGTLDTYAEEGLLTRASEMEAYFADALHSLKGLPHVIDIRNIGLVGGIELAPIDGSPGKRAFDIFLECWERGVLIRTTGDTVALSPPLIISKTHVDQIVGTLADALKRAG

SEQ ID NO: 27387 - protein, 315 aa, Rubrivivax gelatinosus PM1
MMAAMTSFAFLSGSSFLKLPSQADRPYAIAGLAWDGAVTNRPGARFGPRAIREASHMLCDGIHPHFNIDPAPYLTDLGDLPLPNTSLEAMRVAMAPSVNAMIRAHHMAWIGGDHSVTLPLLRAYKSWLGRPLAVIHFDAHCDTWEDHFGEPSGHGTWVYEALQEGLVLPECFTQIGIRSAGAREARDYVRTRGGQIFDARQLRGLESPAQLAPVTTAIRKRLAAHGNPPLYLSLDIDCLDPAFAPGTGTPEPGGMTTNQVLSLLEELADLDFVGMDCVEVAPPYDHAELTSYAAASFVWTYLCGQLARRGATRPA

SEQ ID NO: 27388 - protein, 400 aa, Rubrivivax gelatinosus PM1
MNPLLSRLQPYPFERLRELTRDVLPNPALRPISLGIGEPKHPTPPFIREALTAALDGLASYPATAGEPALREACAAWVHRRYGVTLDASTQLLPVNGSREALFALAQTVIDPTRPGATVVCPNPFYQIYEGAALLAGAQTVFANSDPARNFAVDWSAIDDATWARTQLLYVCSPGNPTGAVMPLDEWQRLFELSDRHGFVIASDECYSEIYFRDEPPLGSLQAALALGRSDFRRLIAFTSLSKRSNVPGLRSGFVAGDAAILKAFLLYRTYHGAAMGPAVQRASLAAWGDEAHVAANRALYRQKFEQVTPRLASVLDVALPDAGFYLWARLPAAVCGGSDIRFARELLAQYNVAVLPGSYLAREAQGTNPGQGRIRMALVAGIDECVEAAERIVSFIQSS

SEQ ID NO: 27389 - protein, 320 aa, Rubrivivax gelatinosus PM1
MPSAAFQPPQHGLTPTMRDVLDRMRRAGRPPLHTMSVDAAREAYRLGAEILDLPRVALARVEDLLVPARDGHLLPARLYAPSSARLPVLLYLHGGGFTIGSLDTHDSLCRQLALQGGAAVLSLDYRLAPEHRFPAAVDDAWDALQWVAREGGARLGLDDTRLAVGGDSAGGTLSAVCALMARDAALPLALQLLFYPGTAARQDSDSHRRFAEGVLLARPLIDWFFGHYIATEHREDWRFAPLLAPDHGGVAPAWIGLAECDPLVDEGVAYGDVLRAAGVPVQLELWRGVVHDFIKMGRAVPEARQAHAAAARALREAFSP

SEQ ID NO: 27390 - protein, 164 aa, Synechococcus sp.
MRRFLALLLVLTLWLGFTPLASADVAGLVPCKDSPAFQKRAAAAVNTTADPASGQKRFERYSQALCGEDGLPHLVVDGRLSRAGDFLIPSVLFLYIAGWIGWVGRAYLIAVRNSGEANEKEIIIDVPLAIKCMLTGFAWPLAALKELASGELTAKDNEITVSPR

SEQ ID NO: 27391 - protein, 245 aa, Pseudomonas brassicacearum
WGNKPRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTDELVELGREITEEAVVLDTRFAYPEYGLPNEGTLEAIRLCGSLEGVLTDP

SEQ ID NO: 27392 - protein, 249 aa, Variovorax paradoxus
GGNKPRKLEYLIPEALEGGYDTLVSIGGIQSNQTRQVAAVAAHLGLKCVLVQENWVNYSDAVYDRVGNIEMSRIMGADVRLDSAGFDIGIRKSWEEAMDDVRKAGGKPFPIPAGCSEHPRGGLGFVGFAEEVRQQEAELGFKFDYIVTCSVTGSTQAGMVVGFAADGRADRVIGIDASAKPEQTFDQIVRIAKGTAEPVELGRDITDKDVVLDRRFGGPEYGLPNEGTLESIRLCARLEGMLTDPVYPG

SEQ ID NO: 27393 - protein, 245 aa, Variovorax paradoxus
GGNKLRKLEYLIPEALEGGYDTLVSIGGVQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGFVGFAEEVRQQEAELGFKFDYIVVCSVTGSTQAGMVVGSAADGRADRVIGIDASAKPQQTFEQILRIAKNTAELVELGRDITEKDVVLDRRFGGPEYGLPNEGTLEAIRLSARFEGMLTDP

SEQ ID NO: 27394 - protein, 236 aa, Pseudomonas putida
SLIPIPQALEQGCDTLVTIGGIQSNHTRMVAAVAAKLGLACVLVQENWVDYSDAVYDRVGNIMMSRLMGADVRLVDQGFDIGFRRSWEEALEDVKRRGGKPYAIPAGASDHELGGLGYVGFAEEVRRQEAGLGFKFDYIVVCAVTGSTQAGMVVGFAADGRADRVIGIDASATPDQTRAQILRIARRTADMVGLGRAIGDEDVVLDTRYAYPAYGLPSAETNEAIRLCARLEGMMT

SEQ ID NO: 27395 - protein, 246 aa, Rhizobium sullae
GGNKTRKLEYIIPDAIASNADTLVSIGGVQSNHTRMIAAVAAKIGFKCRLVQESWVPHEDAVYDRVGNILLSRIMGADVQMVDEGFDIGIRQSWEEAIEDVKAKGGKPYPIPAGASVHKYGGLGYVGFAEEVRAQEAELGFKFDYIVVCTVTGSTHAGMTVGFAKDGRERNVIGIDASFTPTQTKAQVLEIAQRTAELVDLGRDLTLDDIILIEDYAYPVYGVPSDETKDAIRLCARLEGMITDQS

SEQ ID NO: 27396 - protein, 194 aa, Rhizobium leguminosarum
VPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYAG

SEQ ID NO: 27397 - protein, 225 aa, Rhodococcus sp. 4N4
GGNKLRKLEYIVPDALAQGADTLVSIGGVQSNHTRQVAAVAAKLGLKAVLVQEKWVDWPDSVNDKVGNILLSRIMGADVRLDPSGFGIEFKDSWQKAIEDVERAGGKPYAIPAGGSDHKLGGLGFANWAYEVQKQEEELGVFFDTIVVCSVTGSTHAGMIAGFAGQERPRRVIGIDASAKIAQTRDQVARIARNTAELIELGRELRDDEITVLESWAGDYYGISV

SEQ ID NO: 27398 - protein, 226 aa, Achromobacter xylosoxidans
GGNKLRKLEYLIPQALEQGCDTLVTIGGIQSNHTRMVAAVAAKLGLACVLVQENWVDYSDAVYDRVGNIMMSRLMGADVRLVDQGFDIGFRRSWEEALEEVKRRGGKPYAIPAGASDHELGGLGYVGFAEEVRRPEADLGFKFDYIVVCAVTGSTQAGMVVGFAADGRADRVIGIDASATPEQTRAQVLRIARRTADLVGLERPIEDKDVVLDTRYAYPAYGLPSA

SEQ ID NO: 27399 - protein, 246 aa, Achromobacter xylosoxidans
GGNKLSKLEFLLGDAVANGADTVITVGGLQSNHARLTAAAAAVLGLACELVLSRAVPIDDLEYERNGNMLLDPLFGARVHIAPAGMDSLASAQARAEELRAQGRRVVVLPTGGSTALGSLGYVSCAQEIAQQERELGVQFSTVAVANGSGGTQAGLVAGFHALGRDPGMVQAYGVLATEPQTLATTHALVGGACELLGLAPPAESAIRVDGSHRGERYGAPTSGMLGAVMAVARSEGWLLDPVYAG

SEQ ID NO: 27400 - protein, 245 aa, Achromobacter sp. CM1
WHKTRKLEYLGADALAQGADTLITAGALQSNHVRQTAALAARLGLGCVALLENPLGTDDSNYIGNGNRLLLDLFDTRVELVENLDNADEQLQALAARLRSTGKKPYLVPIGGSNALGALGYVRAGLELAEQIKDTGLAFAAVVLASGSAGTHSGLALALSEALPDLPVIGVTVSRSDEDQRPKVQGLAERTAALLEVNLPSAFKVELWDEYFAPRYGEPNAGTLAAVKLLASQEGLLLDPVYTGK

SEQ ID NO: 27401 - protein, 214 aa, Serratia proteamaculans
GGNKPRKLEYLAADALRQGADTLVTAGAIQSNHVRQTAAVAAKLGLHCVALLENPIDTKEENYLTNGNRLLLGLFNAEVVMCDALHDPQQQLADLAIRLEVQGFRPYVVPVGGSNALGALGYVQCALEIAEQSRRSNVEFSSIVVASGSAGTHAGLAVGLQQLLPEAELIGVTVSRKVIDQLPKVELIQKALACSLDIDELSPIQLWDDYFAPQ

SEQ ID NO: 27402 - protein, 244 aa, Enterobacter aerogenes
SIGGNKPRKLEFLAAGALREGADTLITAGAIQSNHVRQTAAVAAKLGLHCVALLENPIGTHAENYLTNGNRLLLDLFNVQVEMVDALTDPTAQLDELATRLEAQGFRPYVIPVGGSNALGALGYVESALEIAQQCEGAVNLSSVVVASGSAGTHAGLAVGLEQLLPDVELIGVTVSRSVADQKPKVVTLQQAVAEQLELKAKADILLWDDYFAPGYGTPNEEGMEAVKLLARLEGILLDPVYTG

SEQ ID NO: 27403 - protein, 197 aa, Pseudomonas syringae
GGNKPRKLEFLAADALREGADTLITAGAIQSNHVRQTAAVAAKLGLHCVALLENPIGTHAENYLTNGNRLLLDLFNVQVEMVEALTDPTAQLDELATRLEAQGFRPYVIPVGGSNALGALGYVESALEIAQQCEGAVSLSSVVVASGSAGTHAGLAVGLEQLLPDVELIGVTVSRSVADQKPKVVTLQQAVAEQLAL

SEQ ID NO: 27404 - protein, 197 aa, Medicago sativa
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELRKLIGAPVYIECSSKTQKNVKAVFDSAIKVVLQPPKQKKTKRKGQKACSIM

SEQ ID NO: 27405 - protein, 474 aa, Euglena gracilis
MFRQSFIQLAKHDLIVIGGGPGGYVAAIKAAQLGLNVACVEKRGTLGGTCLNVGCIPSKALLNASHHYHDAKHKFAGYGIDIPSVSMDIPKMQGTKAKSVTRLTGGIELLFKKNKVTYYKGFASLEGDKKVKVVGETTEVHEADKILIATGSEPIELPFLKFDEKVVCSSTGALDFQEVPAHLVVIGAGVIGLELGSVWSRLGSKVTVVEFMDRICPFMDADVGKEFHRILKKQGLQIKTSTKVVAGKVEGGQVILELESVDGAKKETLQANAVLVSVGRRPFTDGLGLDKVGVELNAKKFIVVDDHFKTNKDGIYAVGDVIHRGPMLAHKAEDEGICVAEMFAGKAGHINYDTIPNVIYTHPEVAWVGKTEEDLKKEGRKLKTSKFPFQANSRAVTNVDTEGFVKVVTDADTDRLLSMSIINSNAGEAIAEAVLAMEYSGSAEDIGRTCHAHPTLSEAIKEACMAAYDKPIHV

SEQ ID NO: 27406 - protein, 402 aa, Pectobacterium carotovorum
MEYQSGKRVLSLSLGLIGLFSASAFASDSRTVSEPKTPSSCTVLKADSSTATSTIQKALNNCGQGKAVKLSAGSSSVFLSGPLSLPSGVSLLIDKGVTLRAVNNAKSFENAPSSCGVVDTNGKGCDAFITATSTTNSGIYGPGTIDGQGGVKLQDKKVSWWDLAADAKVKKLKQNTPRLIQINKSKNFTLYNVSLINSPNFHVVFSDGDGFTAWKTTIKTPSTARNTDGIDPMSSKNITIAHSNISTGDDNVAIKAYKGRSETRNISILHNEFGTGHGMSIGSETMGVYNVTVDDLVMTGTTNGLRIKSDKSAAGVVNGVRYSNVVMKNVAKPIVIDTVYEKKEGSNVPDWSDITFKDITSQTKGVVVLNGENAKKPIEVTMKNVKLTSDSTWQINNVNVKK

SEQ ID NO: 27407 - protein, 367 aa, Penicillium digitatum
MRTSFVTMLALGAAAVSAAPAAPVTDLVERGSSCTFTTAEAAKAGKGSCSTIVLDNIKVPAGETLDLTKLKSGTQVVFKGETSFGYKEWTGPLVSFSGSNIHVSGAAGHVINGGGPSWWDGKGTNGGKKKPKFFYAHHLDDSTISGLNVKNTPVQGFSILADRLTLDHITIDNSEGDAKGGHNTDAFDVGSSTFITISNANIKNQDDCLAINSGSNIKFVGGTCSGGHGISIGSVGLRDNNIVKDVTISDSTVINSDNGVRVKTIYQATGAVSGVTFSNIKLSNIAKYGIVIEQDYENGSPTGKPTNGVPISELTIENVTGTLKSSATEVYILCGNGSCKNWKWAGNSLSGGKKSGKCGNVPAGASC

SEQ ID NO: 27408 - protein, 305 aa, Clostridium perfringens
MKNFLESLIENNRQYVEHGKLASYIPELEKANKEDLGIYIVTLDGKEVGAGEYDKKFTIQSISKVITLMLAILDNGKDRVFSRVGVEPTGDSFNSIVSLERKPSKKPFNPMVNSGAILTTSLIEGDSEEEKFERILEFTRKVTGNDDIQLNEDVYLSEKETGDRNRALAYFMKSNGVIEGNIDDILDLYFKQCSLEVNAKDLARFGAMLANDGVLPWNGERVISREICRIIKTIMVTCGMYDDSGKFAVHIGIPAKSGVGGGIMAAVPRRMGIGIFGPSLDDKGNSIAGTHVMKDLSEELDLSIF

SEQ ID NO: 27409 - protein, 307 aa, Clostridium perfringens
MDINLDALVEANRRYTKEGHVATYIPALAKVNPDQLGVCIYDLKENKEFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAKDLARLGAVLANEGVMPWNGERLFSVETATVVKSLMTTYGLYDESGAFSVHIGLPSKSGVGGGILSSVPNKCGIGLFSPALDVSGNSVASMKLLKEIADKLKLDIFR

SEQ ID NO: 27410 - protein, 334 aa, Nostoc sp. PCC 7120
MSDQANQGDLEIRPSPLLKVINDLHSKYKSLKEGIVANYIPELAKVNPDLFSISIVTVDGQVYQVGDYQQLFTIQSISKVFAYGLALEDHGRDYVLTRVGVEPTGEAFNAIILDEQSKRPYNPMVNAGAIATTSLIKGAGATERLNRVLEMFRRYIGHDVFVDISVFTSERSTGHRNRAMAHLMLNFGMIDRNIEEALDLYFQQCAVMVNCHDLAVMAATLANRGVNPITGEQAVNSRYIKDILSVMYTCGMYNFAGEWAYKVGIPAKSGVCGGIMAVVPNLMGIAVFSPPLDIRGNSVRGVKVCEELSQQLGLHLFECMKVGNGEWGVGNCEC

SEQ ID NO: 27411 - protein, 357 aa, Bacillus cereus ATCC 10987
MSIQIQGVSKQYGTFQALTDIHLDIPKGELVALLGPSGSGKTTLLRIIAGLEEADEGSISFEGEDLTDIHVKNRQVGFVFQHYALFKHMNVFENVAFGLKVRKKSLRPSAEAIEEKVTELLKLVKMDGFAKRYPAQLSGGQRQRIALARALAVEPKILLLDEPFGALDAKVRKELRRWLRKLHDEFQITSVFVTHDQEEALDVADRIVVMNEGRIEQMGTPEEVYENPASPFVYDFLGNVNLFHGRVHKGKLNVGSVELEAPEHKHISNVDGVAYVRPHHLSISRTKQSVDAIPAKVSYSHAVGPVVYVELKRDGTDEYLEAEISKEQFRQLSIQAGDVVYVQPKEVKVFIPEDFVI

SEQ ID NO: 27412 - protein, 269 aa, Pseudomonas syringae
MSRLQTRFDQLKEQNRAALVTFVTAGDPGYDTSLAILKGLPAAGADVIELGMPFTDPMADGPAIQLANIRALEAKQNLLKTLQMVREFRKGNNDTPLVLMGYFNPIHKYGVPKFIADAKEAGVDGLIVVDMPPEHNGELCDPAQAAGIDFIRLTTPTTDDVRLPTVLNGSSGFVYYVSVAGVTGAGAATLEHVEEAVARLRRHTDLPISIGFGIRTPEQAAAIARLADGVVVGSALIDHIANAKNDQQAIDGVLGLCAALSEGVRNASV

SEQ ID NO: 27413 - protein, 478 aa, Mycoplasma mycoides subsp. mycoides SC
MMLIFMELIFYIKRIYMFKFKKDFWWGAASSGCQTESDKDKPNLNIMDYWYKQTPTDFYDNKGPNITCDTYSNYKTDVKLMSEIGLNSFRTSIQWTRLIKNLYTGEVDLKQVEFYRNYFLEIKKNNIKLIVNLFHFDTPIELENIGGWTNKKTVELYFLYAKQCFKYFSDLVDYWTTFNEPVVLVDGCYLNKWYYPKISNLKLVVQAAYNTILAHCKVANYFHSYFKNDQNKKISIILNLTPTIPKNSELKHLKAAKIRDELLNKSFLNAVIKGQFSTFLIKFLNENNLMPEYDQLELNEIKKTRIDFLAVNYYQPARVQAPLNNLTSSTELKLENWFLPYTNKNIRINPYRGWEIHPQTLYDIAIDIKNNYDNIPWIVSENGIGVSDENRFLNKQGYIDDQYRIDFIKEHLIYLYKAIEQGSNCFGYQMWTLIDNWSWANGFKNRYGFISLDTKTLKRTIKKSGYWIKQVIKDQGFE

SEQ ID NO: 27414 - protein, 395 aa, Candida parapsilosis
MTTIAIFTKNVLLAIAFALFAQGAAIPDPAKRDDNPGFVALDFEVTRKPLDVNATSELSKRSSPSSPLYFEGPSYGIRVSVGSNKQEQQVVLDTGSSDFWVVDSSASCQKGNCKQYGTFDPHSSTSFKSLGSSFSIGYGDKSSSIGTWGQDTIYLGGTSITNQRFADVTSTSVNQGILGVGRVETESANPPYDNVPITLKKQGKIKTNAYSLYLNSPGAATGTIIFGGVDNAKYSGKLIEEPLVLDRYLAVNLKSLNYNGDNSNAGFGVVVDSGTTISYLPDSIVNDLANKVGAYLEPVGLGNELYFIDCNANPQGSASFTFDNGAKITVPLSEFVLQSTANACVWGLQSSDRQNVPPILGDNFLRHAYVVFNLDKETVSLAQVKYTSASSVSAI

SEQ ID NO: 27415 - protein, 276 aa, Auxenochlorella protothecoides
CFAYSFSSILVEIQDTLRQPPKAAKTMSKATNVSVTASFAFYFVVAIGGYASLGNDVPSYILGGLQGPEWVIFVANLCVLLHMWSAYQIYAHPMFDTLESHVKAFKLRQAKAKGDAELPAKVEELKRMSLAARQGSAAGTKTMDDTAPAAPPAANPLCRLSRVSAMAGEKLQRLSQNAAMYRVSTGFADTSVPSNDDHFVLPWWQRLITRRMYVVRTTLIAAIMPFFGAMAGLVGALAFFPLTSSSPSAAGAPCTSPLGGSITCCTSSSSAWRWCA

SEQ ID NO: 27416 - protein, 444 aa, Bacillus anthracis str. Ames 0581
MNYVIIGGDAAGMSAAMQIVRNDENANVVTLEKGEIYSYAQCGLPYVISGAIASTEKLIARNVKTFRDKYGIDAKVRHEVTKVDTEKKIVYAEHTKTKDVFEFSYDRLLIATGVRPVMPEWEGRDLQGVHLLKTIPDAERILKTLETNKVEDVTIIGGGAIGLEMAETFVELGKKVRMIERNDHIGTIYDGDMAEYIYKEADKHHIEILTNENVKAFKGNERVEAVETDKGTYKADLVLVSVGVKPNTDFLEGTNIRTNHKGAIEVNAYMQTNVQDVYAAGDCATHYHVIKEIHDHIPIGTTANKQGRLAGLNMLDKRRAFKGTLGTGIIKFMNLTLARTGLNEKEAKGLHIPYKTVKVDSTNMAGYYPNAKPLYLKLLYRSDTKQLLGGQVIGEEGVDKRIDVIAMALFNKMSIHDLEDVDLSYAPPYNSVWDPIQQAARRAE

SEQ ID NO: 27417 - protein, 450 aa, Bacillus anthracis str. Ames 0581
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 27418 - protein, 474 aa, Bacillus anthracis str. Ames 0581
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 27419 - protein, 433 aa, Bacillus anthracis str. Ames 0581
MMNVTTDVQSTTEETKEKRYKTLFGSALGYAAEGLDMLLLSFVLVYILKEFHLSPVEGGNLTLATTIGMLIGSYLFGFIADLFGRIRTMAFTILLFSLATALIYFATDYWQLLILRFLVGMGVGGEFGIGMAIVTETWSKEMRAKATSVVALGWQFGVLIASLLPAFIVPHFGWRAVFLFGLIPALLAVYVRKSLSEPKIWEQKQRYKKELLQKEAEGNLTTTEAAQLKQMKKFPLRKLFANKKVTITTIGLIIMSFIQNFGYYGIFTWMPTILANKYNYTLAKASGWMFISTIGMLIGIATFGILADKIGRRKTFTIYYVGGTIYCLIYFFLFTDSTLLLWGSALLGFFANGMMGGFGAVLAENYPAEARSTAENFIFGTGRGLAGFGPVIIGLLAAGGNLMGALSLIFIIYPIGLVTMLLCVPETKDKVLE

SEQ ID NO: 27420 - protein, 336 aa, uncultured gamma proteobacterium eBACHOT4E07
MIRNFLINILFSIPVWLIELVYKFNKDVKRGFIFDSQSRMLFALMPKLDLHKIEDDDIPKIRNLINEKRKNLRLSNKTKKNVITKDHFIDQENNLKLREYIPYKTDNDNVILYFHGGGYVLNSIDTHNLTVSYFSEKLRTRIFSLAYGLSPENKYPHAMNQALSAIDWLVKNGHHIKNISLCGDSAGAHLAASVAHSLSNDQKENVHSQFLIYPMCDPSCASESIELFKDNYLLTKESMKWFWQKFKNNDEDNLKDTFNLLLFNPNKDFPKTIIVTAGFDPLSDEAEKYAFLIHQSGNYVKQLHYPSLFHGFAAMTRLKSANKAVNDFLLEYKKIL

SEQ ID NO: 27421 - protein, 471 aa, Solanum demissum
MAMVKLEATKSTSSNLLDPSFSSYMINGTEETIVLNLESSRDLSKKVDDGEIDIFSAEKYFNEGVDEENNVTQNKHKIHDDQPVADIVSLQQKIRPLTPSIHSESSWNSRSALLQKVSINHQYQHQHHQLPRPTKTNNKSYGKKFLARFGCNCYCKDKNSVEIDDQLREKSFKSKSKQNTIKTSTIGANHQNLHFKKIDELGVLGLKSDERFAVPVFDPKVGNPNPGVKIQLHKEEEEESRKSLEVFGFPITEKERSKMSLEKNIGMLTWDAIVPKAEEIDIINIGASSNGTYEEDYAESDASSDLFEIESFPSNNTANPSLVRQGSDSMSCYAPSEVSIDWSVVTASAADFSIMSDIEEVKIPSIRTTSNSNRSVSQNGRDKAKRRSGILLGCNSHKAVGVVGDAYKVSEKSSIEMHQRNFKTYEPIIPMTRFHAESRVNRFDGGNRKHEFTTRSFATTYSGRPADFLYI

SEQ ID NO: 27422 - protein, 465 aa, Solanum demissum
MAMVKLEATKSTSSNLHDPSFSSYMINNTEETIVLNLESSRDLNKKVDDGEIDIFSAEKYFNEGVDEKNNVTQNKHKIHDDQPVADIVSLQQKIRPLTPNIHSESSWNSRSAFLQKVSINHHYQHQHHQPPRPTKTNNKSYGKKFLARFGCNCYCKDKNSVEIDDQLREKSFKSKSKQNTIKTRTIEANHQNLHFKKIDELGVLGLKSDERFTVPVFDPKGGIQMQKETEEEESRKSLEVFGFPITEKERSKMSLEKNIGMLTWDAIVPKAEEIDIINVGASSNGTYEEDYAESDASSDLFEIESFPSNNTANPSLVRQGSDSMSCYAPSEVSIDWSVVTASAADFSIMSDIEEVKIPSIRTTSNSNRSVSQNGRDKAKRRSGILLGCNSHKAVGVVGDAYKVSEKSSIEMHQRSFKTYEPIIPMTRFHAESKVNRFDGGNRKHEFTTRSFATTYSGRPADFLYI

SEQ ID NO: 27423 - protein, 181 aa, Candida metapsilosis
DCGDNYVMGHEIAGTVAAVGEDVTGYKVGDRVACVGPNGCGGCKYCRGGVDNVCKRAFGHWFGLGYGGGYQQYLLVDKPRNLARIPDNVSSDVAAASTDAVLTPYHALKMAKVSPSSNLLLIGAGGLGGNAIQIAKAFGAKVTILDKKEEARDQAKKLGADEVYESLPGSIEPGSFSACFD

SEQ ID NO: 27424 - protein, 494 aa, Geobacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGASRRSARPL

SEQ ID NO: 27425 - protein, 466 aa, Treubia lacunosa
GVGFKAGVKDYRLTYFTPDYKTKDTDILAAFRMTPQPGVPPEEAGAAVAAESSTGTWTTVWTDGLTSLDRYKGRCYEIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFVAEALFKSQAETGEIKGHYLNATAGTCEEMMKRAAFARELGVPIVMHDYLTGGFTANTSLAHYCRDNGLLLHIHRAMHAVIDRQKNHGMHFRVLAKALRLSGGDQIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLARQGNEVIREACKWSPELAAACEVWKEIKFEFDTVDAL

SEQ ID NO: 27426 - protein, 388 aa, Oryza sativa (japonica cultivar-group)
MDAGGEEAKQERHLVLAHKLFLLSHPDLDDLAKVALRSDALDAVKSDGMAPLFESLAAAGVLEPDDALLAEMRARIDEEVRKLDEKIADAEENLGESEVREAHLAKSLYFMRVGEKEKALEQLKVTEGKTVAVGQKMDLVFYTLQIGLFHMDFDLISKSIDKAKNLFEEGGDWERKNRLKVYEGLYFMATRNFKKAASLFLDSISTFTTYELFPYDTFVFYTVITSIITLDRVSLKQKVVDAPEILAVIGKVPHLSEFLNSLYNCQYKSFFVAFSGMTEQIKLDRYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 27427 - protein, 324 aa, Solanum demissum
MANGEGEVVCVTGGSGFIGSWLVSSLLERGYTVHATVKDLNDEKETKHLLALDGAESRLRLYQIDLLDYDSIVSAITGAVGVFHLASPCIVDEVKDPENDLLSPAIKGTSNVLTASKELGVKRVVVTSSVSSITPNPNWPADRIMNEDCWTDIEYCKQNGVWYPLSKTLAEKDAWKFAKEKDLDIVVVNPGTVMGPIIPPSLNASMQMILRLLQGCTDTYQDFFMGLVHVKDVALAHILVYENKSAKGRHMCVEAITHYGDFAAKVAELYPEYNVPRLPKDTQPGLLRAKDGAKKLMDLGLEFIEMEQIIRDAVESLKIKGYIS

SEQ ID NO: 27428 - protein, 396 aa, Solanum demissum
MAATIVRSPKLSLSLPPPESTTSNLPSLNQSFFTPLPKRRRCISIYACTAGDQSNSAFGGEIKKGQAIELNKVNDENPYEFNAKDSPNPLPRPLTSADLSNMASEGSRLRVAYQGVRGAYSESAAEKAYPNCEAVPCEQFDTAFDAVERWLVDRAVLPIENSLGGSIHRNYDLLLRYRLHIVGEVKLAIRHCLLANNGVKIEDLKRVLSHPQALAQCENTLTKLGLVREAVDDTAGAAKYIAFSKLKDAGAVASLAASRIYGLNVLAQDIQDDSDNVTRFLMLAREPIIPRTDKPFKTSVVFSLDEGPGVLFKALAVFAMRSINLTKIESRPLQKQALRVLEDSVDGFPKYFPYLFYVDFEASMADQRAQNALGHLKEFATFLRVLGSYPSDSGIA

SEQ ID NO: 27429 - protein, 472 aa, Solanum demissum
MEKLYKGDLMEFYKREIGFSKPRNFSRRISASEAMVKRLDLYGKLTGHEGCVNTIDFNATGDVLVSGSDDRRVILWDWATSTSKFSYPSGHMDNIFQTKFMPFTDDRKIITASADGQVRLGLVLENGRVETKKVGKHQGRVHKLAVEPGSPYILYSCGEDGFVQHYDLRSNSSSKLFRCSSFTENNKQSGSIRLNGIVIDPRNPNYFAVGGSDEYARVYDIRMYQLDARTSSDRSIDTFCPHHLIKTHDVHITALAYSNTSELLVSYNDELIYLFQKNMGLGPVPLSLQGEDLNKLEKPQVYSGHRNSQTVKGVSFFGPTDEYVLTGSDCGHIFIWKKKDAKLVRVMVGDRHIVNQLKPHPCIPVLATCGIEKTIKLWAPTSKDVTPLPPDVQEIMEANRRGREDHSRVTLTPDMIMHVLRLHRRQALAYIERRENLGYVDSDDDDDDIGGGAYVLGFSDGEEGENSECSIS

SEQ ID NO: 27430 - protein, 496 aa, Mentha spicata
MELQISSAIIILVATFVASLLIKQWRKSESRQNLPPGPPKLPLVGHLHLLWGKLPQHAMADMAKKYGPVTHVQLGEVFSVVLSSREATKEAMKLLDPACADRFESIGTRIMWYDNDDIIFSPYSDHWRQMRKICVSELLSARNVRSFGFIRQDEMSRLLRHLQSSAGETVDMTERIATLTCSIICRAAFGAIINDHEELVELVKDSLSMASGFELADLFPSSKLLNLLCWNKSKLWRMRRRVDTILEAIVDEHKLKKSGEFGGEDIIDVLFRMQKDSQIKVPITTNAIKAFIFDTFSAGTETSSTTTLWVMAELMRNPAVMAKAQAEVRAALKGKTSVDVDDVQELKYMKSVVKETMRMHPPIPLIPRSCREECEVNGYKIPNKARIMINVWSMGRNPLYWEKPETFWPERFDQVSRDFMGSDFEFIPFGAGRRICPGLNFGLANVEVPLAQLLYHFDWKLAEGMKPSDMDMSEAEGLTGIRKNNLLLVPTLYKSP

SEQ ID NO: 27431 - protein, 385 aa, Vibrio harveyi
MSKRDFYEVLGVSRDASERDIKKAYKRLAMKYHPDRNQGDESAADKFKEVKESYEILTDPQKKAAYDQYGHAAFEQGGGGFGGGGFGGGGADFGDIFGDVFGDIFGGGRRGGGQQRAQRGADLRYNMELSLEEAVRGVSKEIEVPTLVHCDTCDGSGAKKGSSAETCGTCHGHGQVQMRQGFFAVQQTCPTCHGKGKIIRPCNECHGQGRKQKTKTLNVKIPAGVDTGDRIRLSGEGERGEMGAPAGDLYVQVHVKEHHIFEREGNNLYCEVPVSFLMACSMAALGGEVEVPTLDGRVNLKVPTETRAGRMFRMRGKGVKGVRGGGVGDLIVKLVVETPVNLSARQKELLKEFDESCGGDAQLSTNQNLKGFFNGVKKFFDDLTS

SEQ ID NO: 27432 - protein, 240 aa, Mycobacterium liflandii
EIGPDVYGFAVGDAVTGMTVSGAFAPSTVADHRMVMTIPARWSFPQAASIPVVFLTAYIALAEISGLSRGQRVLIHAGTGGVGMAAIQLAHHLGAEVFATASAAKWSTLEALGVPRDHIASSRTLDFSNAFLDATNGAGVDVVLNCLSGEFVEASLALLPRGGHFVEIGKTDIRDTEVIAATHPGVIYCALDLLSVSPDHIQRTLAQLSPLFATDTLKPLPTTNYSIYQAISALRDMSQA

SEQ ID NO: 27433 - protein, 195 aa, Azotobacter vinelandii
YRDNGIDLRLGCKVVDIDRENREVTRSDGSHAQYDRLLVATGSSPFILPIPGKDLQGVIGYRDIADTRAMMETARSHRHALVIGGGLLGLEAANGLRLRGMEVTVVHLGDWLLDRQLDRTAGKLLQNAGGTRASRFRLNTNTAPCSTMPGRVASAHFSDGEECPADLVVMRAGIRPNVELAERAGLECDRGIRVD

SEQ ID NO: 27434 - protein, 131 aa, Arabidopsis thaliana
MAYEERRSSILDSFSLSPLPYPVLLILAVASVFLLSSWYFSLEEAAESAEEQINFALLLIPLFLIVLVRWLSSMENPDALLGMFSSSRRTTYVSPGAGGDGGSSPWGVAALIVLLLVLLQYQSSFLEMWSG

SEQ ID NO: 27435 - protein, 476 aa, Solanum demissum
MAMVKLEATKSTSTNLLDPSFSSYLINGTEEAIVFNLESSRDLSKKVDDGEIDIFSAEKYFNEGVDEVNNVTQNKLKIHDDQPVAVADIVSLQQKIRPLTPSIHSESSWNSRSALLQKVSRNHHYHQQHHQPPWPTKTNNKSYGKKFLARFGCNCYCKDKNSVEIDDQLGEKSFNRVKYSKSKQNIIKTRSSESSTIGANHQDLHFKKIDELGVLGLKPDERFAVPVFDPKGGIQMKKESEEEESRKSLEVFGFPITEKERSKMSLEKNIGMLTWDAIVPKAEEIDIINIGASSNGTYEEDYAESDASSDLFEIESFPNNNTANPSLVRQGSDSMSCYAPSEVSIDWSVFTASAADFSIMSDIEEVKIPSIRTTSNSNRSVSQNGRDKAKRRSGILLGCNSHKAVGVVGDAYKVSEKSSIEMHQRNFKTYEPIMPMTRFHAESKVNRFDGGNRKHEFTTRSFATTYTRRPADFLYI

SEQ ID NO: 27436 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNAKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPLQAYQKSPRGR

SEQ ID NO: 27437 - protein, 187 aa, Streptomyces coelicolor A3(2)
MMRVDANDMGADLEKVLITKEEIDAKLAELAAKIDAEYAGKDLLIVGVLKGAVMVMADLARTLSTPVTMDWMAVSSYGAGTQSSGVVRILKDLDTDIKGRHVLIVEDIIDSGLTLSWLISNLGSREPASLKVCTLLRKPDAAKVAIDVEWVGFDIPNEFVVGYGLDYAEKYRNLPFVGTLAPHVYGG

SEQ ID NO: 27438 - protein, 486 aa, Streptomyces coelicolor A3(2)
MSSYFTDLAQQYIDGEWRPGTGSWDIIDFNPYDNEKLASITIATVDEVDAAYRAAERAQRQWAATNPYARRAVFEKALRLVEEREAEIGEAIVAELGGTRLKAAFELHLAKEFLREAVHLALAPEGRIIPSPVDGKENRVYRVPVGVVGVISPFNFPFLLSLKSVAPALALGNAVVLKPHQNTPIVGGTLVAKILEDAGLPGGLLNVVVTDIAEIGDAFIEHPVPKVISFTGSDKVGRHVATVCAANFKRSVLELGGNSALVVLDDADVDYAVDAAVFSRFVHQGQVCMAANRVLVDRAVADEFTEKFVAKVSGLKVGDPRDPSTVIGPVINSSQADALSGVVEQALAEGATALVRGSVTDNLVEPSVLTGLPADSALLRQEVFGPVAFLVPFDGEEEAVRLVNDTPYGLSGAVHTGDVERGVNFAKRIDTGMFHVNDGTVHDEPIVPFGGEKHSGLGRLNGDTMLDAFTTQKWISVQHGRSGFPF

SEQ ID NO: 27439 - protein, 199 aa, Streptomyces coelicolor A3(2)
MAGETVITVVGNLVDDPELRFTPSGAAVAKFRVASTPRTFDRQTNEWKDGESLFLTCSVWRQAAENVAESLQRGMRVIVQGRLKQRSYEDREGVKRTVYELDVDEVGASLRSATAKVTKTSGQGRGGQGGYGGGGGGQGGGGWGGGPGGGQQGGGAPADDPWATGGAPAGGQQGGGGQGGGGWGGGSGGGGGYSDEPPF

SEQ ID NO: 27440 - protein, 491 aa, Pseudomonas putida
MSQRLAAYENMSLQLIAGEWRVGKAGRDLDVLDPFTQEKLLQIPLANREDLDEAYRSARQAQVAWAACGPSERAQVMLNAVRIFDERRDEIIDWIIRESGSTRIKAQIEWGAARAITQESASLPSRVHGRILASDVPGKESRVYREPLGVIGIISPWNFPLHLTARSLAPALALGNACVIKPASDTPVTGGLLLAHIFEEAGLPKGVLSVVVGSGSEIGDAFVEHEVPGFISFTGSTQVGRNIGRIAAGGEHLKHVALELGGNSPFVVLADADLDQAVNAAVVGKFLHQGQICMAINRIIVEDSVYDEFVNRYAERVKSLPYGDPSKPETVVGPVINAKQLAGLQDKIATAKSEGARVMVEGEAQGNVLPPHVFADVTADMEIAREEIFGPLVGIQRARDEAHALELANSSEYGLSSAVFTSSLERGVKFARGIRAGMTHINDIPVNDEPNAPFGGEKNSGLGRFNGDWAIEEFTTDHWITVQHAPRRYPF

SEQ ID NO: 27441 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPAEHNWPGISQFPEYKATAPRYATQDLRQILPQIDATGIDLLQRLLQLRPELRISAHDALQHPWFHDILQYQHCQQAAG

SEQ ID NO: 27442 - protein, 380 aa, Nicotiana tabacum
MSSTVGQVIRCKAAVAWEAGKPLVMEEVEVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMIQDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFELAKKFGVTEFVNPKDHNKPIQEVIAEMTDGGVDRSVECTGHIDAMISAFECVHDGWGVAVLVGVPHKEAVFKTHPMKLLNERTLKGTFFGNYKPRSDLPSVVEKYMNKELELEKFITHKLPFAEINKAFDLMLKGEGLRCIINMED

SEQ ID NO: 27443 - protein, 456 aa, Rhodococcus opacus
MVVDVTELRARARRHLGPHFTRKDTWESDFPVFVRGEGSYLIDTEGDRFLDGLAGLFCVNIGHGRDDIAKAASEQIGTLAYASNWGSAHIPAIEASALIADLAPGDLGTTFFVNSGSEAVETAVKFARQYHRSQGNPQRTKIISREMAYHGTTLGALSVTQLPKIKDPFGPLLPGVRSVPNTLGYLGDCGPANELDCIAAIEAVIEEEGAETIAAVFAEPVQNGRGALVPPDGYWAALRALCDKHGILLVSDEVICSFGRLGHWFGHGLTGVVPDMITFAKGSTSGYAPLGGLIVREQLVRELYDSPKGGVFTHGATWGGHPVSTAVAVANITAMRDENVLGNVSARGPKLRSALDSLMSSHRCVKDVRGTGFFYAIELMADSDSGREFTEQESLTVLRKVLPEAFARTKVILRGDDRGATMLMISPPLVADDEVLSELLHGIDSMLTDIEKAIQP

SEQ ID NO: 27444 - protein, 262 aa, Phleum pratense
MASSSSVLLVVALFAVFLGSAHGIPKVPPGPNITATYGDKWLDAKSTWYGKPTAAGPKDNGGACGYKDVDKPPFSGMTGCGNTPIFKSGRGCGSCFEIKCTKPEACSGEPVVVHITDDNEEPIAAYHFDLSGIAFGSMAKKGDEQKLRSAGEVEIQFRRVKCKYPEGTKVTFHVEKGSNPNYLALLVKFSGDGDVVAVDIKEKGKDKWIALKESWGAIWRIDTPEVLKGPFTVRYTTEGGTKARAKDVIPEGWKADTAYESK

SEQ ID NO: 27445 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNTKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPFQAYQKSPRGR

SEQ ID NO: 27446 - protein, 384 aa, Solanum demissum
MAIDCMITRNNNMTSKEGQEYDIIKTNKSLSFDASLMKNESNIPSQFIWPDHEKPNCASVTRELQVPLIDLSGVLSNDPIEIKKATRLVNEACTKHGFFLVTNHGVDTNLIKKAHVYIDKFFELPLCEKQKAQRRVGEHCGYASSFIGRFSSKLPWKETLSFQYSDEKGSSHIVEQYFQRTLGEKFSHIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 27447 - protein, 189 aa, Solanum demissum
MESTISSSSSRSVSPSSSSSPNSPPSPSVTMVVVSPCAACKILRRRCAEKCVLAPYFPPNDPIKFTTAHRVFGASNIIKFLQELPESQRADAVSSMVYEANARLRDPVYGCAGSICQLQKQVSDLQAQLAKAQAEIVNMQCQQANLMALICMEMGQSTPQAISPPQQSLDNFPMNYLDDNIGSWETLWT

SEQ ID NO: 27448 - protein, 168 aa, Solanum demissum
MSGTVKKIADVTFKAGRTIDWEGMAKLLVTDEARKEFSNLRRAFDDVNSQLQTKFSQEPEPINWEYYRKGIGSRLVDMYKEAYESIEIPKFEDTVTPQYKPKFDALLVELKEAEKQSLKESERLEKEVAEVQELKKKLSTMTAEEYFAKHPELKKKFDDEIRNDYWGY

SEQ ID NO: 27449 - protein, 452 aa, Mycobacterium vanbaalenii
MTAVKEVPRVSGGEEEHGHLEEFRTDPIGLMKRVREECGDVGWFQLADKQVILLSGAEANEFFFRSSDSELNQAEAYPFMTPIFGEGVVFDADPERRAEMLHNTALRGEHMKGHATTIEAEVRKMIEGWGESGEIDLLEFFAELTIYTSTACLIGLKFRNQLDSRFANYYHLLERGTDPLCYVDPYLPIESFRIRDEARAGLVELVQDVMHGRIANPPKDKSDRDMLDVLVSIKDEDGNPRFTANEITGMFISLMFAGHHTSSGTSSWTLIELLRHPEFYAKVQQELDDLYADGQEVSFHALRQIPSLDNALKETLRLHPPLIILMRVAQDEFEVAGYPIHKGQMVAASPAISNRIPEDFPNPDDFDPDRYEKPRQEDLINRWTWIPFGAGKHRCVGAAFAQMQIKAIFSVLLREYEFEMAQPPESYQNDHSKMVVQLARPAKVRYRRRVRD

SEQ ID NO: 27450 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLGSSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 27451 - protein, 157 aa, Candida albicans
LLSLDGTPNKSKLGANAILGVSLAAANAAAAAQGIPLYKHIANISNAKKGKFVLPVPFQNVLNGGSHAGGALAFQEFMIAPTGVSTFSEALRIGSEVYHNLKSLTKKKYGQSAGKLGDEGGVAPDIKTPKEALDLIMDAIDKAGYKGKVGIAMDVAL

SEQ ID NO: 27452 - protein, 395 aa, Nicotiana paniculata
MASASLLKTSPAIGKTDFIKGQALRQPSVSVRCHPAPPSGLTVRASSYADELVKTAKTVASPGRGILAMDESNATCGKRLASIGLENTEANRQAYRTLLVSAPGLGQYISGAILFEETLYQSTVDGKKIVDVLHEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFFYLAENNVMFEGILLKPSMVTPGAECKERATPDQVADYTLKLLQRRIPPAVPGIMFLSGGQSEVEATLNLNAMNQSPNPWHVSFSYARALQNTCLKTWGGRPENVQAAQEALLIRANANSLAQLGKYTGEGESEEAKKGMFVKGYVY

SEQ ID NO: 27453 - protein, 398 aa, Nicotiana paniculata
MASASLLKSSPTVLDKSEFVKGQSLRQTSVSVVRCHPTNAPSLTVRAASPYADELVKTAKTVASPGRGILAMDESNATCGKRLASIGLENTEANRQAYRTLLVTAPGLGQYISGAILFEETLYQSTVDGRKIVDVLVEQNIVPGIKVDKGLVPLAGSNDESWCQGLDGLASRTAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLQRRIPPAVPGIMFLSGGQSEVEATLNLNAMNQAPNPWHVSFSYARALQNTCLKTWGGQPENVKAAQDALLTRAKANSLAQLGKYTGEGESDEAKQGMFVKGYVY

SEQ ID NO: 27454 - protein, 178 aa, Streptococcus suis
ALAILTNKKKNLRILELAFDAQDASEVEKEFTGVVGGLLVQDQDVVVESPVDWQVVTERQPSEQEWAAMEFAWKSSKYVKSNGIIITNDKMTLGVGPGQTNRVASVRIAIEQAKDRLEGAVLASDAFFPFADNVEKIAAAGIKAIIQPGGSVRDQDSIDMANKYGLTMVFTGVRHFRH

SEQ ID NO: 27455 - protein, 178 aa, Streptococcus suis
ALAILTNKKKNLRILELAFDAQDASEVEKEFTGVVGGLLVQDQDVVVESPVDWQVVTERQPSEQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 27456 - protein, 152 aa, Arabidopsis thaliana
MGACASRESRRTETAKLILPDGTLQEFSTPVKVWQILQKNPTSFVCNSDDMDFDDAVLAVPGSEDLRPGELYFVLPLTWLNHPLRADEMAALAVKASSALAKSGGGGLSYNDEDVGECRVRRVKRNGCGGRGCGGGGKGRRKFTAELSSIAE

SEQ ID NO: 27457 - protein, 509 aa, Arabidopsis thaliana
MDAQSVSEKLRSSGLLRTQGLIGGKWLDSYDNKTIKVNNPATGEIIADVACMGTKETNDAIASSYEAFTSWSRLTAGERSKVLRRWYNLLSRSEPLHFTKHRYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 27458 - protein, 344 aa, Streptomyces clavuligerus
MSRSPPESPAGSVSAAVPRPPVRALRDLPVSAQGLGCLPTTDFYGRPDRARATATIRAAVDAGVTLLDTADVQGLGAGEELLGRAVAGRRDEVLIATKFGMVRSSDGASQGLCGEPSYVRAACERSLRRLGTDRIDLYYQHWTDPAVPIEETVGAVAELVREGKVRRLGLSEPSAATLRRADAVHPVTAVQSEWSLWSRGIEDEVVPVCRELGIGIVAYAPLGRGFLTGTIRTTDDLGDEDFRRGQPRFSAPALARNRSLLHRLRPVADGLGLTLAQLALAWLHHRGEDVVPIPGTANPAHLADNLAAASIRLDDRSLAEVTAAISHPVSGERYTPALLAMIGN

SEQ ID NO: 27459 - protein, 220 aa, Streptomyces clavuligerus
MPGSGLEALDRATLIHPTLSGNTAERIVLTSGSGSRVRDTDGREYLDASAVLGVTQVGHGRAELARVAAEQMARLEYFHTWGTISNDRAVELAARLVGLSPEPLTRVYFTSGGAEGNEIALRMARLYHHRRGESARTWILSRRSAYHGVGYGSGGVTGFPAYHQGFGPSLPDVDFLTPPQPYRRELFAGSDVTDFCLAELRETIDRIGPERIAAMIGEPI

SEQ ID NO: 27460 - protein, 280 aa, Vigna radiata
GEGTYGVVYKARDRVTNEAIALKKIRLEQEDEGVPSTAIREISLLKEMQHRNIVRLQDVVHSGKRLYLVFEYLDLDLKKHMDSSPEFAKDLRQVKMFLYQILCGIAYCHSHRVLHRDLKPQNLLIDRSTNSLKLADFGLARAFGIPVRTFTHEVVTLWYRAPEILLGSPRYSTPVDIWSVGCIFAEMVNQRPLFPGDSEIDELFKIFRILGTPNEDTWPGVTSLPDFKSAFPKWQPKDLKTVVPNLDPAGLDLLSRMLHLDPSKRITGRSALEHEYSERH

SEQ ID NO: 27461 - protein, 210 aa, Sporobolus stapfianus
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYVVPNSSGGAAGSSSQGGGCCS

SEQ ID NO: 27462 - protein, 289 aa, Thermus thermophilus
  misc_feature (1)..(1): Xaa can be any naturally occurring amino acid
  misc_feature (12)..(12): Xaa can be any naturally occurring amino acid
  misc_feature (16)..(16): Xaa can be any naturally occurring amino acid
  misc_feature (131)..(131): Xaa can be any naturally occurring amino acid
  misc_feature (240)..(240): Xaa can be any naturally occurring amino acid
  misc_feature (262)..(262): Xaa can be any naturally occurring amino acid
XEKVAFIGLGAXGYPXAGHLARRFPTLVWNRTFEKALRHQEEFGSEAVPLERVAEARVIFTCLPTTREVYEVAEALYPYLREGTYWVDATSGEPEASRRLAERLREKGVTYLDAPVSGGTSGAEAGTLTVXLGGPEEAVERVRPFLAYAKKVVHVGPVGAGHAVKAINNALLAVNLWAAGEGLLALVKQGVSAEKALEVINASSGRSNATENLIPQRVLTRAFPKTFALGLLVKDLGIAXGVLDGEKAPSPLLRLAREVYEXAKRELGPDADHVEALRLLERWGGVEIR

SEQ ID NO: 27463 - protein, 217 aa, Sporosarcina globispora
MNIVLMGLPGAGKGTQADRIVEKYGTPHISTGDMFRAAIQEGTELGVKAKSFMDQGALVPDEVTIGIVRERLSKSDCDNGFLLDGFPRTVPQAEALDQLLADMGRKIEHVLNIQVEKEELIARLTGRRICKVCGTSYHLLFNPPQVEGKCDKDGGELYQRADDNPDTVTNRLEVNMNQTAPLLAFYDSKEVLVNINGQKDIKDVFKDLDVILQGNGQ

SEQ ID NO: 27464 - protein, 173 aa, Escherichia coli B
EVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVA

SEQ ID NO: 27465 - protein, 165 aa, Escherichia coli B
TANEIAALAFVNTVVATAAAILGWIFGEWALRGKPSLLGACSGAIAGLVGVTPACGYIGVGGALIVGVVAGLAGLWGVTMLKRLLRVDDPCDVFGVHGVCGIVGCIMTGIFAASSLGGVGFAEGVTMGHQLLVQLESIAITIVWSGVVAFIGYKLTDLTVGLRVP

SEQ ID NO: 27466 - protein, 168 aa, Escherichia coli B
VIVQHAVSGEVLMLGYMNPEALDKTLESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQG

SEQ ID NO: 27467 - protein, 171 aa, Escherichia coli B
IGISIVGLIFDPNVHFSGVFAMPSLSDENGNSLIGSLDIMGALNPVVLPSVLALVMTAVFDATGTIRAVAGQANLLDKDGQIIDGGKALTTDSMSSVFSGLVGAAPAAVYIESAAGTAAGGKTGLTAITVGVLFLLILFLSPLSYLVPGYATAPALMYVGLLMLSNVAKID

SEQ ID NO: 27468 - protein, 174 aa, Populus nigra
MSRDRDPLSVGRVIGDVLDPFTKSISLRVTYSSREVNNGCELKPSQVANQPRVDIGGEDLRTFYTLVMVDPDAPSPSDPSLREYLHWLVTDIPATTGASFGHETVCYENPRPTMGIHRFVFVLFRQLGRQTVYAPGWRQNFNTRDFAEVYNLGSPVAAVYFNCQRESGSGGRRR

SEQ ID NO: 27469 - protein, 306 aa, Proteus mirabilis
MKNCTLGNETDNSLISNAFGFLRFPLNFQPYSSDADWVITGVPFDMATSGRAGTRHGPGAIRQISTNLAWEGHRWPWHFDMRERLKVVDCGDLVFNFGDAQDMSDKLQAHTEKLLAAGKRCLTFGGDHFVTLPLLRAHAKHFGKMALVHFDAHTDTYANGSKFDHGTMFYHAPNEGLIDPQHSVQIGIRTEHDTNNGFTVLDAAQVNDRGVDDLVAQIKEIVGSLPVYLTFDIDCLDPAFAPGTGTPVVGGLTTDKALKMLRALQPLNIVGMDLVEVSPAYDQSDITALAGATIALDMLYLQAAKK

SEQ ID NO: 27470 - protein, 183 aa, Adiantum capillus-veneris
MPRSQRNDNFIDKTFTILADILIRILPTTKREREAFIYYRDGMSAQSEGEYAEALGSYYKAMRLEIDSYDRSYILYNIGLIHTSNGNHAKALEYYFQALERNSFLPQAFNNMAVICHYRGEQAIYQGDLEISEAWFDQAAEYWRRAIALSPDNYAEAQNWLKITGRFSPSHRWESWNNSTRVA

SEQ ID NO: 27471 - protein, 310 aa, Adiantum capillus-veneris
MVMSVINWFEDRQKFGGLIGAFLEEATRSSMTNERDRRISVNANKGLWARCDNCGNMLYVKFLKQNRSVCEECGYHLSMSSMERIELLIDPNTWIPLDEDMSARDILSFSDEDSYETRILLSQEKTGLTDAVQTGIGYLNGTLIALGVMDFHFMGGSMGSVVGEKITRLIEYATQRLLPLVLICASGGARMQEGTLSLMQMAKISSVLQLYQVQNKLLYISVLTYPTTGGVTASFGMLGDIIIAEPKAYIAFAGKRVIEQTLRQKIPDGFQAAESLFDNGLLDLIVPRNLLKGVLSEISGLYLSVPYNKN

SEQ ID NO: 27472 - protein, 313 aa, Picrophilus torridus DSM 9790
MYKLEDEIKIQYKTMPESYKRTVSKCIDVKNLMGSEKNIFIIGSGSSHNSSIFLSMLLDLAGIITKPLQASLFNEMIDKSNYRDGLIIAFSQSGESRDVINAAVSARKKDFKIISITNGINNSLSRISDINISYSAGAELAVTATKSFTGSMMAAFGIYSCIIDDIINIDGISGDIINITDKAFKTNYDYDFKRAVFLGSGLFTVDALEGALKLRETAGIDSEGFPAMEYEHGYMETIDNDTLIVSIGIKPPEKIKKYTSRFIVIDPGLMTGLNDEIMRAITCIIPLQVLALKAALARGIDPDHPQKLSKVVK

SEQ ID NO: 27473 - protein, 298 aa, Picrophilus torridus DSM 9790
MSFNDPRVLKFSEVNKNSENPDIVITGVPYDGGIISHRRGARYGPERIREIMNSYSSYCTDHNVDLNSLKILDAGNIDVNFIDYNIEKIKDDYYNIIKKYNSRFIAMGGDHSITEGLFKSVCKLNKKTGMILFDAHHDIRDPWRVNSGSWGNNILKDNGGCLDGRNFVQIGVHGFKYSKYYYNKINDLKISYFTALNVLDYGIDAIIKKALEIIDADIIYLSLDIDVIDQAYAPGVSAASPGGLTPREIFKAMYLLGLNKKVRFMDLTEYSPPLDHDDITGRVAAEALLHFMCGASKS

SEQ ID NO: 27474 - protein, 316 aa, Picrophilus torridus DSM 9790
MSDIKENVLNAIGNTPLVKLNKINVKNIEIYVKLEYYSPGMSIKDRIALGMIEDAERKGLIEPGDTIIGKTSGNTGIGLAIACAVKGYRFVAVMSAGNSAERQKILRALGAEVVLVPQQPGEEPGRISRKDNDAVEKKTQELTEKLNAYRPNQYINSMNWKVHQHTTGQEIIRQTSGRLDAFVAYIGTGGTFVGIARALKSFNNDIKCYPVEPDVAAFLAGKKVITTQHLIQGGGHAVKPPFWDESIVDGYIQVSEDEAIKTARALAKNEGILTGFSGGANVAAAAKLDDSLRPGSIVVTVLPDTGLKYLSTVLYE

SEQ ID NO: 27475 - protein, 420 aa, Picrophilus torridus DSM 9790
MKGDDLFSEALKLFPSGVNSPVRFYRPVPVMFERGRGSRIYDVNGKEYIDYSLGFGPMILGHADPDVASAIKRQADNGILFGSITENEVRLGNIIKNHVKSIEKMRFTNSGTEATMHAIRLARGYTKRKYILKMEGGFHGAHDYALIKSGSGTMTFGVPSSNGVPEEITKTVLVGKYNDENSIESLFNEYGNDIAAVITEPILGNIGVINPEPGFLEFLREITNKYNSLLIFDEVITGFRFAFSGYQDIINIKPDITTMGKIIGGGAPIGLFGSSSEIMDLISPSGNVYESGTFSGNPLSMAAGIAAMEKLQGMDYSRINNYTADLVKSLYDIFNDKNIDVNINHYGSMFQIFFNKNEVKTYDDAIKSDKDRFFKFFKKMLDHNVYLPPSQFETNFVSFAHGRDDLNKTIEAAKEAVSCI

SEQ ID NO: 27476 - protein, 446 aa, Picrophilus torridus DSM 9790
MNDYDLGIIGWGAAGFAAAIRASELTYNGMRIALIGNGDLGGTCVNVGCVPSKYLIEASKEYNHALKPRYPGISSSAGVNFHELMSSLRSFVLKSRENKYTNVIKNFHNIDLYRGKASFISKNEVMVNNIKIRATNFIIATGSRPYIPENIKNYITSDDLWSLDEIPKRLAIIGSGAVAMEMAYAFSNFGSDVYVFNRSNHVLKNFDSDINKMLIDHMKGLGVKFIFGDIKEADHDYVISDRKYSGFDKILAATSRVPNIDINLEAASVDYKNGIIVDDHLRTSNKMIYAAGDCVDQRFQLETLAGREGVIAVENILGLDRSIDLINVPWAVFTEPNVASTGYTERELKKYKKRVLYLKNVVKSNILMEDGLVKMLTDDEDHVLGVQIFAPYAAEFIPEAYNIIKNHGTYKDFIEAMHVFPTVSESLKITAQSFIRDVSMMSCCME

SEQ ID NO: 27477 - protein, 493 aa, Picrophilus torridus DSM 9790
MKIYIDGEWRDSSSGETIKKYNPSTGEVLDTFPAATRNDVDAAIDSAEDAFKRWSDMTSMERSKILYKALELISKDKDQLTDLLIKENGKVKREAMDETEGVIDQLQYYTEFERKLTGDIVEGTSNKRKIFQYKVPYGIVIAITPWNFPAAMVIRKLAPALLTGNTVILKPSSDTPLTAEWLVKKFVDAGIPKGVLNLITGKGSEIGDYIVEHKKVSLITMTGSTSTGQRIMEKASKNMAKLILELGGKAPFMVWKDANIERALKSLVWAKYLNVGQSCIAAERLYIHEDIYDEFMKKFIEVSKRIKLGDPESSDMGPLINKSAVETTEKYVDIARSSGYKILLGGKKPELSGKYKNGYFYEPTIIENVPQDSPLFQEEIFGPVIGAESVSSVDELYEKANDSKYGLASYLFTEDPELIFEASEKIRFGELYVNMPGPEASQGYHTGFRLTGQAGEGSKYGISEYLKLKNVYVDYSRGNLSISTVNDDLFKNL

SEQ ID NO: 27478 - protein, 449 aa, Picrophilus torridus DSM 9790
MLKSNSIGLSGLIFQGMGQLSPLFTFDGIISVAAFALGASPLAFIIGMIASLLTGNTLYQFSKRTASARGYYGYAMYGGRPLSFYVAFLYIIYQMANMLFVISFLIMIFSPALSYLTGINVPGYYGLLTIIIIIPAFYAVYSGIRASFKTQLIINLIEIAFIIIVSFSVILTSKDNSYIVFTPVSGYKDLFLGFITGSFLAYTGYGSIVSLGEEAREPRKNIGLAVMLMILIIGLIDVLISYSLVIGFGIGKMYDFSNTIIPAFIVIRNHLGIYASVLFFALNFVIIYTLFNTVLTSLTRNIYAMARDNIINKMFLKLNKNGTPVNALYLSILIFAVSLIISLMVFYKYYGYNGFLDAFIFFATLSTMATLIIHIIVNTSLSVNKRSFVYDVLMPGISSIIILIAMYYALIDAAFPFNYSIIAIVLYSLMVMILYPFKMHKHNLNYSIK

SEQ ID NO: 27479 - protein, 245 aa, Picrophilus torridus DSM 9790
MRNLIPYFTLGYPDNETLKRFLMAMPINMINYIEFGFPSNDPRYDGPTIRKTHRIGNENYDESFYIDIFNYFNDHNIKMYSLSYYSDIKDIERFAAVLSNLGFSGSIIPDLLIDYYDEAFDVINKLNEMHFEYIPFFTPSTPDNVIKKVSEKTYSWIYYGLQPSTGIDIPYDLDYTCNRIFSLVKSREINFGFGIKTIEDVSGLIRRGASGVAIGSYLVNMLDGNDLNGFLDYLKRIRGALDVES

SEQ ID NO: 27480 - protein, 483 aa, Picrophilus torridus DSM 9790
MFKEKFERIMEGYTFDDVLLLPLKSGVEPRDADVSSMFSKHIKIKVPIVSSPMDTVTESEMAIAMARYGALGVLHRNISINEQLEMVKRVKKEETIIIRDVITVDENTPVNVARTIMMTRNIAGLPVVTSGKLSGILTKRDLEFSDNKGLVKDIMTKDVVYADEDISIDEAKYILYKNRIEKLPLVDKKGRLTGLITAKDIKTRERFPDASRDNDGKLMVGAAVGPFDINRALALQDAGVDFIVIDTAHAHNMNVVNSIREMRKKINIDIIAGNIATGDAANDLIDAGVDGLRVGIGPGSICTTRIVAGIGVPQLTAISNVADVAEKNDIPVIADGGIRYSGDIVKALAAGASTVMLGSLLAGTDESPGMEMIINGRKYKSYRGMGSIGAIKAGKSDRYGKLENNSFIAEGVEGAVPYRGRVSEILFQLVGGIKTGMGYVGAANIRELHEKSIFIRISENGLRESHPHDIRIISEPPNYQNYQ

SEQ ID NO: 27481 - protein, 364 aa, Picrophilus torridus DSM 9790
MIETDINDIYGRPLVFPIYQTGSYEIPGGEKFRYSREYNPTVENLNNVIKRLEHGDLANSFSSGMGAITTTLLSILRPGDEAVTHIDTFARSYHFFSEFLRSFGIKTRISRPGTENILEEINKRTKLVFIETLSNPVLRVYDIDEISKACSENGALLICDSTFATPYNLKTLDHGADVVIHSASKFLSGHNDVIAGVAAGSYDLIKRIDDTRRSLGTSMDPNTAFLVERGIKTLDLRMERINENAMKIARFLNESPRVSDVIYPGLESHPDHGIASRLLRGYSGVILFKLKKDFNDFIDKLSNIKAANTLGGLNTIVSNPYTMSHRSLNNDELKILGIDKDYVRLSAGIENPENIIEELNTAIS

SEQ ID NO: 27482 - protein, 440 aa, Picrophilus torridus DSM 9790
MQEDEGFYLERLKADKIDFLQIQFTDITGHLKSLTVPKNRFEDVLYDGITFDGSSIPGFKPIENSDMKAMPDLSTYTIISQNSLGKTARFISKIFNPDGTRFDGDPRYVLERQIDRLKKENKHFYIGPEIEYFIFKRDDKNRPTVIPSDQGVYFDKNTDSSILLKEEIVKRLEDIDYYPEASHHEVAPGQHEIDVKYADAITMADRLIVIKSIVKDVAAKHGYYATFMPKPIKGINGSGMHVHQSIFNGDNNAFYDENNRYGLSKYALSYIAGILKNIKGASPILAPLVNSYKRLVPGYEAPVYICWANRNRSALVRVPAPSGKAKRIELRFPDSTGNHYLQFAVMLGMGLDGIENKAEIPDPVERNVFEMPLNERAELGIETMPGSLGEAIKEMERSETIKEILGEHIFENYIKLKRMEWEDYTTYVTDWEINRYLEVY

SEQ ID NO: 27483 - protein, 426 aa, Picrophilus torridus DSM 9790
MDYDVIILGAGAGGYKAAVHLLKNKKRVLMIEKEKFGGECLNYGCIPSKALIEMSESIYYLKNMPGISMEYKIDMKAWQDWKNSMVARITGNAERQCKSLGADILYGFGTLKDKNTVNVNGKDYTAENIIIDTGSSPARIPGIDNVYYNREILGIDHIPESIAIIGGGYIGVEIGTAMAKLGSDVYIIEAKERILPEVSSELSNAVDKKLRSIGVKIMTSSKVISVSKDKYYTVKTENDEIKSEMVLMSVGRIPNTKNIGLENLKIEMDGRFIKTDEHRRTNVKNIYAIGDVTTGPMLAHKAFYDAYIASENILGNDVIIDYKAMPYVIYTDPEISFTGSVSNNSKKIMTSAVPRALTMNEGDGFFRIYYNDDGTVTGAAIAAPRSSEIITEISLAVESYLNINDLLLTIHPHPTIAEGIHDDFEN

SEQ ID NO: 27484 - protein, 450 aa, Picrophilus torridus DSM 9790
MDYLDVKRDDINYRNVYGSTYPLMKNAGMAVANVFKNNFGKNRKVLVIAGPGNNGGDAICAASYLMTDNDVYLLMIKDPKTPEARRAYNEYNGISYKYDEIDDLIKKTEIIVDGILGIGISGNPREPELSIIRMINSSGKKVISIDVPSGFPYESVKPDITVTFTDLKENMNESNSGKILIADIGIGKNIREYAGPGDLVYLKKPAFDSHKGMNGVLSIIGGSAYYGSAVISGLGAYSCGIDLVKIFTENVDIISSYYPGLIVRNIKNVDEMLKSNAFLIGPGLGTDFDDYDLLIRIISSGKPVVLDADALKIIKKEDVKGRNVIITPHKMEFKIFTSMEPSEESAVNFSEKYKITVLLKGTTDIVTDENRIMRVPGGNARMSMGGTGDLLSGMVSAFASRGVSNFRSAVMASYINKRVGEQCFKEKGYFYSITDMMDKIPSFINKNTFY

SEQ ID NO: 27485 - protein, 275 aa, Picrophilus torridus DSM 9790
MRLIENWFSERYSDNLQLSFRVQDQLLSVKTDYQRIDLFNTYDFGKLLSIDGTVQLTEKDEYIYHEMITMVPYYCTAKSDSALIIGGGDGGAAKRLIDLGIKRIVNVEIDQNVVEISRKYFPELADSFNNKNVELIIGDGIKYVKDTDESFDLIIIDSTDPVGPAEGLFNKSFYENARARLSDDGIIVTQSGSPYYQPEALKMATKGMLDVFSNVRTYIAFIPTYPSGLWSFTMASKSEIMQRKDNIIPGRYFNEDVLKGSFYLPEFVKNIIKSI

SEQ ID NO: 27486 - protein, 265 aa, Picrophilus torridus DSM 9790
MEKILWYGKIIDGKIYLFKNLRENYMAIFRDLRNGRIPETEEIPSGEVPDLRDFLLDFERERLKDEFSGDQYLIKLYSIKKEINEIINLYLEKLIPFFQMLDVKYSKDPCTFFKSISGNEIENSLGSFGSSLCDFRTYLDDYIKKKMQDYMPNTMSLLGYDLTMEYLVRSGGLKNLVKYPASTLQILGAEKSFFRFYGTGKTPKHGIIFNYPGLASLPAKSRGKLARIICNKLAITLKMDYYKTGNNLNYKDLIDKKMAELKKLR

SEQ ID NO: 27487 - protein, 284 aa, Picrophilus torridus DSM 9790
MQHFSYLKLPDALSDYKNARYVLFGVPFDNTSSYRRGSRLSPNYIRYAYNNLESFEINYKYNIPDAGICDLGDLPVYEDVEYVLSEVETVTRTIFNDKKVPIMLGGEHSITIGAVRNLRNVKMLIIDAHSDFRDSYMDNIYNHACVTRRCLDILGRDSIVSVGTRSTSLEEYESPEYRNVRFVSSEYVLENGIKSVLDELDEFIGDSRIYFSIDMDGIDPAYAPGVGTPEPYGLRDTDVRSIIRRFSKKSIGFDIVEMTPLYDNGNTSMLAAKMIQDFIASREK

SEQ ID NO: 27488 - protein, 494 aa, Picrophilus torridus DSM 9790
MNILVSVSDTSGLTDLLRHLNGDVYATPGTFKFLSDSGIKAKRISDITGFDDLLNGRVKTLHPAVFSGILSRRDEQSEADLKRYNYFDFDIVICNLYNFESYIDKSIEDMIENIDIGGLSLIRAAAKNYQHVTVASSPEDYNIIIKDLRDGEISLRTRETLALRAFARAAYYDMIIYKSLYKRLNNDEPEELFIHGYDRTKLRYGENPDQAGFLYRTDDEYGIPNAVQLNGKELSYNNIIDADSALETVLEFDEPTAVIVKHRTPSGVSSADNIRDAFINAYSSDEESAYGFVLALNRKVDEETAMELSKHYIEVLIAPDYDEPALNILKKKKNLRILKAVFRRNNSYVFQSIPGGLLMQSPLRSDFTEMKCMTIEADERTKKDLLFAWRVSAHCKSNAIVLAKNLTTTGIGAGQTSRIESLRIAVQRSNGNAKGSVMASDGFIPFNDSIIEANKNGIKAIIEPGGSIRDNDVIQKAIEYKIPLYFTGKRVFLH

SEQ ID NO: 27489 - protein, 336 aa, Picrophilus torridus DSM 9790
MKAALLYKNEKKLRIEDVPVPEINDDEVLIKVKAAGICHTELHFIDNVLNAGKYPIIPGHEVAGIVYKKGKNVKDLDLNDKVLLYYYRGCGKCDFCINGQENLCTNPEMEYGFINDGGFSEYIKARETDLVKLNDDIDIYSIAPIACSISTGIHALNMAKPELNDRVLVYGVGGVGFGLIQLNKLRGCRVFSASRNDKKLDIAKKLGSDYNINTCNENIVNKVKSMGGVDIIYDLVGSNETIKNDIEMLNKAGKLVLIGYDGSNVNINPLDLIINEIKIISCVGNTRYELEEAVRLFNENRIKIVIDRFDELKNINNDLEIIRNGEAMGRIVIKFD

SEQ ID NO: 27490 - protein, 448 aa, Picrophilus torridus DSM 9790
MEALKGINIKVEPPGPIAKKIIEMDEKYLARSTKSLPIVAKRGYNSYIEDVDGNVFLDFTTGISTTNIGYMNKNVLDAVEEQLHQLWHFAGTDFYYEAQVNAAKALGEVAPGNFNKKVFFANSGAESNEASLKVAKNYTKKRQFIGFIGAFHGRTMGALAFTASKPVQHSMYFPEMPGVVHVPYPNPYRNPFNIDGYENPDELVNRTIDFIEKYTLETYLPADDVAAIMVEPIQGEGGYIVPPENFHRELIKLAHENNILLIMDEVQTGFGRTGYFFASEYFKVEPDIISVAKSIASGIPMGASIFNEKFDFDKEGLHSNTFGGNLLASVACTATINEIKEKKMLENSRKMGKYLNKRLNELKDKYEEIGDVRGLGLMQAIDFVNDRSRRDFNVGLRDRVIERSFKNGLLLLGAGESAIRLIPPLIITEEEIDNAIEIIDESINRELK

SEQ ID NO: 27491 - protein, 214 aa, Picrophilus torridus DSM 9790
MVEVSPSIISSDLSHLYDEIKRCEDAGAGSFHLDVMDGHFVNNITMGPDLIKAIRKSTGLRLDAHLMIERPDKYYKSFLDAGADVLLIHYESPVNTMELLKKFHRENIRYGIVINPETNFERVKPLIENAEILLIMSVNPGFSGQKFIDDSLIKVSQAKEFIRANNLKTRIEIDGGINDETGRLAANAGADILVSASFIFKNGVINPIKTLKNF

SEQ ID NO: 27492 - protein, 446 aa, Picrophilus torridus DSM 9790
MKEYDVVTIGAGGAAYPAAFKLKRSGYNVIMIDKKGVMSGNCLSEGCVPSKAIIESVHKYNTLKGIFDFKVDYKKIVDHKDSVQRLRYSDHDRELGEADLKIIKGTGRLVDENTVEVDTGTGIERYHADNIIIATGADTFIPNIKGSELAVTSRDFYSMDPKIKSVPESITIIGGGYIGVETGSFLSILGSRVTIIEMLDRILESMETDIIDKLIPLLPRMDVKTSSEVKSIEKFNDKLKVLLNDGEVVSDMVMMAAGRHPVLPEGLDDLGIKYTKHGINVNMSMQTNIKNIYATGDVNGITPLFHAAKRQSIIAANNIMSGNVPVDYFDPISVPFTLYTIPQLAYVGILPAQAERLGIEHYEATYDMKKDSLAEINNEVYGEITLVFDKRMKIIGGYVIGNDAGNIINEIALCVSRGLSLRDLAEMSHQHPMSFEGLDSAARKFY

SEQ ID NO: 27493 - protein, 254 aa, Picrophilus torridus DSM 9790
MYSISGSMYSYGIGNTPLLNLDGIYAKAEYKNKFGSIKDRAAFFMISSVMDKIGNKIIVEASSGNTGIAVAGISRELGIKSIIVIPEGASDGTKAMLSRIGVDYITTPGNSTEQSIKYVENLIKSDPQKYLRLNQHSNDMNYLSHYMTTAPEIEHDMGKPDTIVIGIGTGGTISGISKYFKEKYHDVKVIGIIPDENSRIFGLRNPFLSVNHGIIDKNINYIDDVFIISEDAALKGVSELLSKYNLFCRPLVGC

SEQ ID NO: 27494 - protein, 266 aa, Picrophilus torridus DSM 9790
MIIGYFGDPGSYTSMAAKLMLGGRYVSYRSILDIVNAIERNELDFGVVPIENSIEGQVGQTYDIIYYKDIYINSEYYMKIDHCLIGNSEINKIRFVHSHPQALAQCSNFINKNGFIPVPEYSTSYAIKTISEINNDEHAAIGSEEAANLYNLKIISKSIQNNINNYTRFISISKHMNDHGDKYSIGFSLENRPGSLSRILNIISAFNINMTKIESRPYAKNPFSYIFFIDFEDNGYGNVLIDIIKRETINFKLIGLYRKSGIETGY

SEQ ID NO: 27495 - protein, 385 aa, Picrophilus torridus DSM 9790
MLNGFNTRAVQAGDLKIREIGNVVTPIFENSTFIYPNSESEYMDSSSGMPYIYSRWGNPTVQSLEDKYRVLENTGHAVAFSSGMGAITAAVLSNIKKKRILSIMDLYGQTFQFFSRTLKTLGIHVDFIDVDKLNNLDFDAKNYDLVYAESITNPLLKVIDIKNVASFCHENDVLFIDDATFASPYNQNPVELGADIVVHSATKYISGHSDVIIGIAGTNNYYNNLIEMRKTLGASPDAFQAYLSYRGLKTLGLRMERHNKNAMELARFLRDSKKVLNVNYPGLDDNKYHGIAGKEMRGYGGMLSFTLNSMEDAHKLIKNLEIPAYAASLGGVESLITMPVETTHASLSPEERRSLGISDSLVRFSTGIEDIDDIIKDFENALSKL

SEQ ID NO: 27496 - protein, 344 aa, Picrophilus torridus DSM 9790
MTDEVPEKRNKHPYIMYDMIRDIPNGISKTIDVMESMDYSFLNAPLIMTGNGTAYHAGYLGMQFLKKTNYHFDFIQAYELLNYYIPDGTVIGISHTGKTKSTVDAIEFSKRYSYTVGITHYMDSPLYKISNKPVFIDSVDKSLCNTKAFFDNAFASLYIAMNYSGIYFDVKDIKNDIIDVINKKEKEISELTSKLSHINNVFVLGAGPNYIAAREAAQKIKEATHLHAEGIELEEFNHGCTSVIDENSLLIIINNKTVNKRTEDIVRACKVLGTKTIVIRGDGDFSIDLNESNDEYIEPFTNMAVLYYIAYYLALAKKVNPDLLRFDERKYREFDDIIFPPGAH

SEQ ID NO: 27497 - protein, 443 aa, Picrophilus torridus DSM 9790
MKYFGTNGIRGIPNEDLTTELSMTVGKAVSTYFNSKTIAVAKDTRISGDMIMNAVISGVMSTGTDVKYLGILPTPGLQYYCKKHNLPGIMITASHNPPEYNGIKCIASDGTEISEESEKEIEDLIDSKKFKKVSWESSGRLYPESNAIDEYINGIMSLVDVDKIRDRKFKVVIDTGNGAAYFTSPYLLSKYNCHIVSLNANPDGTFSSRNSEPKPENLGDLISLMRSGNFDIGIAHDGDADRCVFIDEHGNFIDGDKSLALIVKYTVKNGDTVVTPVSSSDALSDICAEKNAKLIKTRVGAPIVARTMIENRAVIGGEENGGIIYGKHQYCRDGAMTLSLMLNLLASEKKTLSQLLNDIPDYTIVKSSVERRRGWEEIRKDLIERIDKKIDETDGLKILEDEGWVLIRPSGTEKIIRIYAESKSRDKAAELSNKYRSLLNELL

SEQ ID NO: 27498 - protein, 372 aa, Picrophilus torridus DSM 9790
MDLDFIRENVKEFSEKEIMPLSKKIDEDDYFPVDLFKKLGRQGYLGVTIPEEYNGTNLGYMAQAIIEEEISYCSGSIGLSYGAHSNLCLDNLFRNGSNYIRENYVTKLASGDMIGSLGMTEPSAGTDALSMKTRADEMDGKYRINGSKTFITNAPFADVFLTYARTGDDISAFLILASDAGFSRGKSFKKLGMRGSPTGEIYFNDIIIGSDRIIGGINHGKNVMFSGLNMERAILAFNSIGISRRAFDLAMEYSMEREQFGKPIHEFELIQEKLAYMYTKLETSRLFAYHALENVQKDRMNSLDAAASILYASETSEYIAREALQIFGGYGYIKDFEIERLMRDSILLSIGAGTNEIRKKLIAEALVRRYKK

SEQ ID NO: 27499 - protein, 245 aa, Picrophilus torridus DSM 9790
MVVQAYNSTSEVMKEINKIIEYEPQIFLDYDGTLVPIVNDPIGCYFDSELNYIISEINKRFEMYIITGRSLDDTRRCLGNLNIIALHGALFYINNETLKYPGFDKFLDSCNKIFLNYKHLEDLYHGLRIYNKNGGVLFHLGNVDNRDEIIKIVDKIAFNNNLESYHGINIVEIRFPGINKGRAIKMMRNRKRPVIIFGDDLTDEDSFIENTDAITVKIGPGNTAARFRLKSYLDVRNILINIINI

SEQ ID NO: 27500 - protein, 212 aa, Picrophilus torridus DSM 9790
MQEIFNRIFRDNKSIYTLSENNKRVYGEKIIRKKNSYLREWDPRRSKLAAAILKGFKHANFDKKLNILYLGASTGTTVSHLSDICISGRLYAVELSYDSFVKLYSLSQARNNIFPILEDANLVERYKFFVEKCDFIYQDIAQRNQVQIFNQNADIFKPRSAILIIKIKAISSKEPEKKILKETISSIRKYNIKEIIDLRPYDIGNYLVYMER

SEQ ID NO: 27501 - protein, 400 aa, Picrophilus torridus DSM 9790
MNFEIKDTNIRKIFDSRGNFSAEVTVILENASGTASAPAGASTGKTEVIAYPDNNIDNGIDFFYRHVKKALKGFNSINQEGLDRMLHEIDGTDNFSNLGGNIATAISIANAKAVSNALGIPMYRYVGGINYSMPRPIGNVIGGGKHSKNGTTIQEFLVSAQGKTVLDSIYYNILIHRRIGEILSGMFKNQSIGLGDEKAWTCDISDEDAIEIIKNASKDISSEYKIKVLNGVDFAADSFYDGNYYIYKNRKLTRDQQIDYAISISRDHGFYYIEDPLNDQDFDGFSEITSKVGDKSLIVGDDLYTTNPERIKKGIEKRSTNGVLIKVNQIGTLSDTARSVRIATEHGLKTVVSHRSGETTDDFIAHLAVAFGSPLIKTGTIGGERLAKLNELIRIEEELI

SEQ ID NO: 27502 - protein, 336 aa, Picrophilus torridus DSM 9790
MKAMVLEKVGKVEENPLKYKDVDIKKPEGFEILIKNLACGVCHSNLHMIEGDWVQYGLPGKSNIIPGHEIIGRVEELGDNVTDLKKGDIVGLQPLYSACGKCEYCLSGREHLCPYGKWTGETVDGGYAEYMIADSRYVNKVPSNIDPVNAPLFCPGVTAYTAVKKAELSPDKTVYIVGIGGVGHIALQIAKLYGSRVVAVTTSKNHEDLAYKMGADDVVIMDRNYENADMLAKTADAAIIFAPADAAIKNSIKFVKDGGVVVQGVRGNQGEFDFTRELKIKGSKIGTRQDMNEVLKLAADGKIKVESKTYKLEEANEALKALKHGEVNGRAVLKMY

SEQ ID NO: 27503 - protein, 440 aa, Picrophilus torridus DSM 9790
MEYVSYHGNPVKFMRRITILSSMGIVMDGYTLTVFSYALLYLIPEMHLSSYEISIMGISSIMGVFVGSVIFGHLADKYGRKSIYLYDLIFVSIFIFITGFSVNYIEFSIFQFLAGIGIGADYPVSSSIQAEYSPQEKRGKYLVFNIFSFSIGSLIFLIVAIPLVLFTGPYAWRYMYIIGAVFPLIVLFSRNSLEETPYWLKEKFGDNALKNLDKKIESETGFHFMGIPELEKGKSKLSDIFSKKYILMTIFVSIAWFSYDVVSYGIWTYSPLIFSTQISSVYTNLYVVFSGMAESVPVFIGFIIAIYYVERIGRRPLLIIGFLGSLIVLISFFFINEFISITFLFTFSAFGLVHFFHNIGPSPMTYDYPVEIFPTRIRASAMGFSTSFSRLGSILAVFSFPFIDALFGLKAIVIYFAAFEFIGLIITILLAPETKNTPLK

SEQ ID NO: 27504 - protein, 330 aa, Picrophilus torridus DSM 9790
MITIGILGAYLIGMLVFFIAPGLAYAVDWRILLGVAAVPSLIGLAFRLYMPESPRWLILHEKFDKAVDALKKFGIDATMEQIKRTYSYLRATETRIKETAGIKRAFVIVALFMMFQQITGINVPFYYGPVIISKLHLFPSVSGIYSTVYAIGASAILAIINVLATYIGFRLIDTHGRRSLALMGYAGMAFFDFIGTILYLMHFSIGLLIGFAGFIIFFAFGVGGTGWIIQGEYFPTRYRGLFASLIAFVDWISNFAIIEIFPYMDKTIGIGYTMLIFGILSVMAFITFFMIMPVTRGKSVEDITEMFEDNPLLGVKEASKVTDVNKSETR

SEQ ID NO: 27505 - protein, 204 aa, Picrophilus torridus DSM 9790
MSDYNINFNDGIVPVVVQDFDTGDVLTLAYMDRNALEMTMKTGYAFYYSRSMKRIHMKGEVSGNTQKVMEIYQDCNDNSLLIKVKKDGPACHTGNNSCFYRKLGEPKVDGNIDYSLEILLRLEDLVRKRMKDPVNGSYTNYLIDSGDENIRKKVGEEAIETILASGRDRIVYETADLLYHLIVFLAFNNVSLFDVMNELNRRSK

SEQ ID NO: 27506 - protein, 301 aa, Picrophilus torridus DSM 9790
MIDPEIKEIIENAGPLNPADIKIDEFRALMDNLAIEMSREKIKVREVTDIKINNIKSRLYNDSDSDGIIIYMHGGGFVFGSIESYDNICRYIAKCSGLKVLSVDYRLAPENKFPAALDDSFEAFKYVYDHYSDLRIKMDRICLAGDSAGGNLAASLSLKIYDELGVKPGLDVLFYPSLAPDTFSRSFSEYNDGPVLTGDLIQWFGSQYYKNFYDVLNPYFSPMLGDLSKMPESIVVTAEYDPLRDQGESYLKMLRKANVRATGIRSLMMVHGFATDFEYVSAARNILFMVYSLAGNIINKL

SEQ ID NO: 27507 - protein, 377 aa, Picrophilus torridus DSM 9790
MLTETEVDILKYVREFAETKIKPRAREIDEKMYVPEDIIQGMRDMGLFASYIPKEYNGYGLGFKFLMNVIEEISKACPSTALVLDGALTLFAEPVIMFGSEDLKKRYLPRVASGEVGGLAITEPGAGSDAASIKTTAVRSGNKYVLNGTKVFISNGRLARFFVVDASTDPERRAKGITSFVVDADAPGLKISRDIHKLGIRGSSTVELVFDNVEVPEENIIGNVNEGFKVIMDTLDAGRIGIAAQALGIAKASFEEALKYIKERKQFNQRIIDFEGVQFMIADMETRIKASELLVYDAAEKWQNHENTIEISSIAKMYASDTAMYVAERSLQLFGGYGYTTDFDAERHLRDAKITQIYEGTNEIQKIIIAREIMKRL

SEQ ID NO: 27508 - protein, 495 aa, Picrophilus torridus DSM 9790
MLPKNFLLGFSLAGFQSEMGISDPDSNSDWWLWVHDPVNIRTGLVSGDLPENGIGYWDLYKKYNGLAVQTGMNAARLGVEWSRIFPKSTEEVKVMEDYKDDDLISVDVNEGSLEKLDRLANQKAINRYMEIFNNIKENNMTLIVNVYHWPIPIYLHDPIEARNSGLSNKRNGWLNHKTVVEFVKYAKYLAWKFSDVADMFSIMNEPNVVFGNGYFNVKSGFPPAFPSVHGGLLAKKHEIEAIARSYDAMKEITKKPVGLIMANSDVQPLTDEDKEAAEMATYNDRYSFIDPLRVGEMKWADEVTAGNPIGEKSNIDRSDLKNKLDWIGVNYYTRAVVKKSGNGYTTLKGYGHSATAGMPSRAGRDVSDFGWEFYPEGLVNVLSSYWKRYHIPMIVTENGVADSIDRLRPRYLVSHIKSVEKALSMGMDIRGYLHWSLIDNYEWASGFSMKFGLYGIDLNNKKIQHRPSALVFKEIANANGVPEEFEWMADQHQNS

SEQ ID NO: 27509 - protein, 432 aa, Picrophilus torridus DSM 9790
MSFDVSWLNTGNNAWMLTAATLVGLQSIPGLALYYAGMTKRKYMVNAMMMALYAFSAVLVVWVIAGYSFGFGTVPLLKIDGYYIFSMPVPVGSASFIAGQAIVGPERIALSIPNSTVIFFQFVFAAITPVLLMGGILERMNFKAWMVFVPVWSFLVYSPVAYWLFAGGWLNQLGAVDFSGGYVIHLDAGVGALAAALAIGPRIKEDMNLKANNLGLVMLGLGLIWLGWDGFNGGDPYGSGIDAAIAIINTNVATAVSMITWMLMDMKFFKKASLIGASVGAIAGLVGITPAAGYVNIYGAMVIGIATGIIPWIALYKIEPHFKIDDALGVFSSHAVAGIVGGILTGVLADPFITQYIDPGLRGAIYGDFYQLGIQALAAAVVFAYTFAMTIAILKIIGLFIPLREKEENLKLGDLAIHGEIGFEDSYQAVRK

SEQ ID NO: 27510 - protein, 390 aa, Picrophilus torridus DSM 9790
MNYEDDFIANTYQKLPVDIEYGEDSYLIGSDNKRYIDLMSGYGVAILGYSNKHVKDSITDQLNKIPILHASEYNKTRSDFVEKLHNILPGKFDKMYLGNTGAEAIEAAIKAVIRSTGRRKIIAMTGSYHGKTLGALSITHSLKYRKPFMDLLNKNVDFIKYNDVNDLDKIDDDTAAVFFEPVQGESGINIPDKSYVIELRKVTERHGTALVADEIQSGLGRTGTMWAFENFGIVPDIITIGKGIGGGIPLSVTAGKSEFMMLEKGDQSSTTGGNPIACAAGSAVIDELKPELIRSVRHKGELFRSMLNNDLNGLKVKEIRGLGLMNAVELRIRFLPVLLNMINNGVISLYSGISIIRMLPPYIIKDEDLEMASKIIASSIREAEENWQSQ

SEQ ID NO: 27511 - protein, 443 aa, Picrophilus torridus DSM 9790
MKRGHGSGVISVPVATAVGLGAIIGAGIFVLSGTAIALAGANALFSFILVGILAVIIAVQFGELGSIMPNAKGASFSYTYNAFGSELGFIIGILLYFSFATAISAIALGFGSYLSSVLLLHGNNYPIMFAILLIFILSIVNIIGIKKAARLDSFLVLIKLLILTVFIISAVLLAHFSGTLNLNNFHGSARQSGVLPVLSASIAVFFAYSGFQSISTITSNVRGGASGAARAIVLSVVISMIFYILVIFALMLMVPASKFVISADPLSFALKYVRAPYSIFILVDAGALMATASATLAMILTSSRVIYQISENKLLPGFFRKYDRKRDVPVNGVILSALIGVAMLFSGNIYIIAAISNFGLLISYLVSSLALIHFRRNNKTGSFKTPFYPYITVISIVMLLVFILGMPREVLDIGMILIIILLMLYYFLVEFKRDRVIHEELFK

SEQ ID NO: 27512 - protein, 445 aa, Picrophilus torridus DSM 9790
MELKRSITLTGAIMINLGAIIGAGIFVIIGIAAYRAGPGVIISIVLSGIIAILTGLSFSEIARHVAKEGGAYEYAKDTLSPSAGFVAGWMWTSGNIIAIAAVATSFGSYFDVLFNINVNPFFIAVICILAFMTLNILGIKNSTKTITGLVILNVLVLLVFIFSGITRFNSNNYVNFMPHGISGIITGTALIFFAFTGFSRVTTVSDEVINPEKTIPLAIIVSIIISSILYILIAVVLIGLKPYYAYQGSTSPLSLAVSSLHNRYIDIIVSIGGVTSTAGVTLTGILGTSRVLFAMGRDKELPEKLSYIDRFSTPVFAIILSSILGIIFLIFVSFGTIVEASNSSVLISYIIINVAAGFLYLKLRKRETKRLAGRPFFIIIPALGIATILLIISHINIGSLEITGVILLICIIYYIIRRIALNIEGRRVPRHSDVRLFGKSRSRTN

SEQ ID NO: 27513 - protein, 414 aa, Picrophilus torridus DSM 9790
MNGSFFTMDDFDLDGKRIYLRIDINSPVNPETGEILDDSRFRAYSKTINELKSSKVVIVSHQSRPGKNDFTSLMGHARYMSNIIKKEIKFIDSLFSHDAINAISNMSAGDIIMLENSRFYSEETLNADFETIKNTHIVRRLSPLFDYYVIDAFPAIHRAQTTLIGFKGSGPNIAGRLMEREITMLDKFKFFRGSPKIAILAGSKIEDSIKVSRAFLKDNIVDYILTGGVVANAFLYAGGFNIGRKNMEFIIKNNDNYESLINSATQLLQTFRGRILMPDDFLLSPSGRHVTISESINDDEIIADIGFNTVDKYSKIISRASAIFMNGPMGIYEIPEYSIGTREIFNIVAETPALKIAGGGHTLNALNSMHLTKKLDYTSTGGGALINYLSGDSIPVIDALIENKRLFGGKYNGR

SEQ ID NO: 27514 - protein, 268 aa, Vibrio parahaemolyticus
MSRYEKMFARLNEKNQGAFVPFVTVCDPNAEQSYKIMETLVESGADALELGIPFSDPLADGPTIQGANIRALDSGATPDICFEQIGKIRAKYPDLPIGLLMYANLVYSRGIESFYERCAKAGIDSVLIADVPTNESAEFVAAAEKFGIHPIFIAPPTASDETLKQVSELGGGYTYLLSRAGVTGAETKANMPVDHMLEKLNQFDAPPALLGFGISEPAQVKQAIEAGAAGAISGSAVVKIIEAHVEQPQIMLDKLGELVSAMKAATQK

SEQ ID NO: 27515 - protein, 110 aa, Xerophyta humilis
DGTPDMTAGKNNRFPNLRGDNSSKSLEEMVKATGKEAFQWGLAAGVYSGLTYGLKEARGTHDWKNSAIAGAITGAALALTTEKSNSDHVVQSAVTGAAISTVANLLRGIF

SEQ ID NO: 27516 - protein, 343 aa, Xerophyta humilis
ETKVIPGKHGFIAQLNEGRHLKKRPTEFRVDRVLQPFDQGKFNFTKVGQEEVLFRFEPSVHGKSNFSESASIDANDTPNVVAINVSPIEYGHVLLIPRVFDCIPQRIDRLSFELAVRMAAEAGSPYFRLGYNSLGAFATINHLHFQAYYLSVALPVEKALTRRIMVARSRDENSWSGVSGILDYPVRGLVFEGQSPSRGLADVVADACVYLQENTFPLMCLCSDLGRRIFLFPQCYAEKQALGQVSQELLDTQVNPAVWEISGHMVLKRRKDYKDASEEYAWRLLSEVSLSEERFEEVKASMFEAVGLTEYEDGGLERVEEAAALQPITPMAVHFPESCLVLQ

SEQ ID NO: 27517 - protein, 467 aa, Streptomyces tubercidicus
MTVPATVAELVRKFRANGRIVIVGASLAGLRAAEALRQEGFTGSLTIIGDEPYEPYDRPPLSKQVLKGWVPADHTKLPRLREVNAQWRLGVTATGLDRIAKQVRLADGEQIPYDRLLIATGTRARQWPNPEEAALDGVYSLRSRDDAAQLQEALATPPSRVVVIGAGFIGSEVTSVCRELDLPVTVVERGSAPLVGALGGVIGEIAAEIQRDHGVDLRCGLGVSSLEGDAGGHVRRAHLSDGTTIDADVVVASLGSIRNVEWLEGAGLASGFWGVGCDAGGRAFDINGVVTDSIYVAGDVARAPHVLYEYQFLAMEHWDNAVLGAEAAAHNMVNLEPHYRPHLLLPGFWSGQFGLNIKSVGVPPFGDEIVFTQGSVKERHFAAAYGRRGRIVAAVTFDHGKWLEYYGKLIEQSGPFPPPPPGWDQPPDMKPVPAEFPQPGVPTALPDVVLTGHDPGERGAEFRPRPR

SEQ ID NO: 27518 - protein, 421 aa, Streptomyces tubercidicus
MVDAHQTFVIVGGGLAGAKAAETLRAEGFTGRVILICDERDHPYERPPLSKGFLLGKEERDSVFVHEPAWYAQAQIELHLGQPAVRLDPEGRTVRLGDGTLIAYDKLLLATGAEPRRLDIPGTGLAGVHHLRRLAHAERLRGVLASLGRDNGHLVIAGAGWIGLEVAAAARSYGAEVTVVEAAPTPLHGILGPELGGLFTDLHREHGVRFHFGARFTEIVGEGGMVLAVRTDDGEEHPAHDVLAAIGAAPRTALAEQAGLDLADPETGGGVAVDAALRTSDPYIYAAGDVAAADHPLLDTRLRVEHWANALNGGPAAARAMLGQDISYDRIPYFFSDQYDVGMEYSGYAPPGSYAQVVCRGDVAKREFIAFWLAADGRLLAGMNVNVWDVAESIQQLIRSGAPLEPGALADPQVPLAALLP

SEQ ID NO: 27519 - protein, 437 aa, Streptomyces tubercidicus
MPAARRRLRPPHRSGDLPARPPGRAHPPRDRPGRHDLRPSRRGGGHRRMKSVAVIGASLAGLYAARSLRSQGFDGRLVIVGDECHGPYDRPPLSKDFLTGATDPGRLALADAEEIAELDAEWLLGTRATGLDTGGRTVLLDGGRSLTTDGVVLATGAAPRLLPGPVPAGVHTLRTLDDAQALRADLAPAPVRVVVIGGGFIGAEVASSCAALGHDVTVVEAAPLPLVPQLGHAMAEICAALHADHGVTLLTGTGVARLRSEGDGRRVTGVELTDGRLLPADVVVVGIGVRPRTAWLTDSGLPLDDGVLCDAGCVTPLPAVVAVGDVARVDGARAEHWTSATEQAAVAARNLLAGSTVATHRSLPYFWSDQYGVRIQFAGHRLPTDTPRVLEGSPDDRSFLACYERDGRTTAVLALNRPRPFMRLRRELARTALSATT

SEQ ID NO: 27520 - protein, 410 aa, Streptomyces tubercidicus
MAQNTAFIIAGAGLAGAKAAETLRAEGFGGPVLLLGDERERPYERPPLSKGYLLGTSEREKAYVHPPQWYAEHDVDLRLGNAVTALDPAGHEVTLADGSRLGYAKLLLATGSTPRRLPVPGADLDGVHTLRYLADSDRLKDLFRSASRIVVIGGGWIGLETTAAARAAGVEVTVLESAPLPLLGVLGREVAQVFADLHTEHGVALRCDTQVTEITGTNGAVDGVRLADGTRIAADAVIVGVGITPNSETAAAAGLKVDNGVVVDERLCSSHPDIYAAGDVANAYHPLLGKHLRVEHWANALHQPKTAARAMLGGEAGYDRLPYFFTDQYDLGMEYTGHVEPGGYDRVVFRGDTGAREFIAFWLSGGRVLAGMNVNVWDVTDPIRALVASGRAVDPERLADADVPLADLVP

SEQ ID NO: 27521 - protein, 421 aa, Streptomyces tubercidicus
MVDAHQTFVIVGGGLAGAKAAETLRAEGFTGRVILICDERDHPYERPPLSKGFLLGKEERDSVFVHEPAWYAQAQIELHLGQPAVRLDPEAKTVRLGDGTLIAYDKLLLATGAEPRRLDIPGTGLAGVHHLRRLAHAERLRGVLASLGRDNGHLVIAGAGWIGLEVAAAARSYGAEVTVVEAAPTPLHGILGPELGGLFTELHRAHGVRFHFGARFTEIVGQDGMVLAVRTDDGEEHPAHDVLAAIGAAPRTALAEQAGLDLADPEAGGGVAVDATLRTSDPYIYAAGDVAAADHPLLDTRLRVEHWANALNGGPAAARAMLGQDISYDRVPYFFSDQYDVGMEYSGYAPPGSYAQVVCRGDVAKREFIAFWLGEDGRLLAGMNVNVWDVAETIQQLIRGGVRLEPGELADPEVPLTSLLP

SEQ ID NO: 27522 - protein, 476 aa, Pectobacterium carotovorum subsp. carotovorum
MSASTFPNGFLWGGAIAANQAEGAYLEGGKGLTTVDMIPHGVNRAAGETGARTAFALREDEFYPSHQAIDFYHRYKEDIALMAEMGFTVFRTSIAWSRLYPNGDELTPNAEGIAFYRDMFAECKKYNIEPLVTLCHFDVPMHLVTEYGSWRNRKMVEFFARYARTCFEAFDGLVKYWLTFNEINILLHSPFSGAGLVFADGENQEQVKYQAAHHELVASALATKIAHEVNPENQVGCMLAGGNFYPWSCKPEDVWAALNKYRENLFFIDVQARGTYPAYTGRLFKEKGITIASEPGDDEILKNTVDFVSFSYYASRCASADMNEHNSSAANIVKSLKNPHIKASEWGWGIDPLGLRITMNMMYDRYQKPLFLVENGLGAKDEINAQGEIDDDYRISYLREHISAMADAIGDGIPVIGYTSWGCIDLVAASTGEMSKRYGFIYVDRDDRGEGTLARKKKKSFYWYKKVIASNGADLS

SEQ ID NO: 27523 - protein, 471 aa, Synechococcus sp. PCC 7002
MVQTKSAGFNAGVQDYRLTYYTPDYTPKDTDLLACFRMTPQPGVPPEECAAAVAAESSTGTWTTVWTDGLTDLDRYKGRCYNVEPVPGEDNQYFCFVAYPLDLFEEGSVTNVLTSLVGNVFGFKALRALRLEDIRFPVALIKTYQGPPHGITVERDLLNKYGRPLLGCTIKPKLGLSAKNYGRAVYECLRGGLDFTKDDENINSQPFMRWRDRFLFVQEAIEKSQAETNEVKGHYLNVTAGTCEEMLKRAEFAKEIGTPIIMHDFLTGGFTANTTLAKWCRDNGVLLHIHRAMHAVIDRQKNHGIHFRVLAKCLRLSGGDHLHSGTVVGKLEGDRAATLGFVDLMREDYVEEDRSRGVFFTQDYASLPGTMPVASGGIHVWHMPALVEIFGDDSCLQFGGGTLGHPWGNAPGATANRVALEACVQARNEGRSLAREGNDVLREAGKWSPELAAALDLWKEIKFEFDTVDTL

SEQ ID NO: 27524 - protein, 167 aa, Saccharomyces cerevisiae
MQEFYSFSPIDENGNPFPFNSLRNKVVLIVNVASHCAFTPQYKELEYLYEKYKSHGLVIVAFPCGQFGNQEFEKDKEINKFCQDKYGVTFPILHKIRCNGQKQDPVYKFLKNSVSGKSGIKMIKWNFEKFVVDRNGKVVKRFSCMTRPLELCPIIEELLNQPPEEQI

SEQ ID NO: 27525 - protein, 472 aa, Escherichia coli
MAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYMTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 27526 - protein, 458 aa, Escherichia coli
MAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 27527 - protein, 144 aa, Daucus carota
MGSKIFLLLGLSIAFAILISSEVAARELAETAAKTEGYNNGGGYHNGGGGYNNGGGYHNGGGGYNNGGGYHNGGGGYNNGGGYHNGGGGYNNGGGHHNGGGGYNNGGGHHGGGGSCYHYCHGRCCSAAEAKALEATTAQVKPQN

SEQ ID NO: 27528 - protein, 217 aa, Volvox carteri
MARIPGRPDYDALIKLLLVGDSGVGKSCLLLRFTDDMFTSSFITTIGIDFKIKKVDVDGKLVKLQIWDTAGQERFRTITSAYYRGAQGIILVYDITDEASFNNVRNWMRNIEQHASDNVNKILVGNKLDLAEDKRVVSIARGQALADEFGFRFYETSAKDNVHVEEAFIAVAKDVLARMEGEHANQQLLQQQQLSAAQPVRLTSGSPSPAQGKSCCR

SEQ ID NO: 27529 - protein, 203 aa, Volvox carteri
MAVDSHDYTFKVLLVGDSGVGKSCILTRFTSGIFEESTTSTIGVDFKVKYLTADGKRCKLTIWDTAGQERFRTLTSSYYRGAQGIIFVYDVTRRDTFESLEANWMREFDIYSTVESAIKMVVANKVDLSAQRQVSSEEGHDFARRHGCLFVETSARANLAVGQAFEELLLKILDTPLLLETTAVGGIKLGAVPTGQQAGVCSC

SEQ ID NO: 27530 - protein, 331 aa, Cicer arietinum
MSNKIWPPPPSNNPYEYLKIHHNPNDTLTRNLVDPHTSPSSNTTLPINVLTKDLTINQSHQTWLRLFLPKNSTNPNQNNKLPLIIFFHGGGFILLSAASTIFHDFCVELADTVEAVVASVEYRLAPEHRLPAAYDDAMEALTFIKSSEDEWLQNYVDFSTCYLMGNSAGATIAYNAGPMCNLKKVNDFEPLKIQGLILSQPFFGGTQRSESELRLENDPVLPLSVGDLMWELALPIGVDRDHKYGNLTAENDLDEKFDKIKDQGWRVLVSGNGGDPLVDRYKELVELMEKKGVEIVKDFEEEGFHGIEFFEPSKAKKLIGLVKGFISSFVV

SEQ ID NO: 27531 - protein, 273 aa, Cicer arietinum
MDRRTHSLVNATNDFQNHITQKQSLYPSGFPRKVLAEVIGTYLLVFVGSGSAAMNAIDENKVSKLGASMAGGFIVTVMIYAIGHISGAHMNPAVSLAFATVSHFPWKQVPFYIAAQLTGAISASYTLKVLLEPSKQLGATSPSGSNIQALIIEIVTTFTMVLISTAVSTDPKAIGELSGVAVGSSVCIASIVAGPISGGSMNPARTLGPAIATSSYKGIWVYMVGPITGALLGTWSYVVIQETNKQALTTSLKLHHEMKGIELVGDKDNQCSV

SEQ ID NO: 27532 - protein, 443 aa, Methylobacter alcaliphilus
MKIFEEIESEVRSYARAFPRVFDRAQGAKIYDHEGNEYLDFLAGAGSLNYGHNHPVFKEKLLEYIQNDGITQGLDLHTRAKGEFLESFNEHILKPRNLDYIVMFTGPTGTNAVEAALKIARKKTGRENIISFTNGWHGQTLGSLSVTGNSTHRGGAGIALHGSTRIPYDGYLGDDFDTTNLLDKMLSDSSSGVDKPAAVIVETVQGEGGINAASMTWLRSLSEICKRHDVLLIIDDIQAGCGRTGTFFSFEEAGIYPDIVTLSKSLSGYGLPLAIVLMKPEIDQWSPGEHNGTFRGNNHAFVTAKAAIDHFWKDDSFAKDVQRKGRYIADRVDVIVAKYGEGNFNSHGRGMFRGINCVSGDLAGQITRRCFQKGLIIETSGADDHVVKFLCPLIITDEELEKGIDILEQAIKEVCDKADTIPEGKDFFEGDYSVSKEVSKAGH

SEQ ID NO: 27533 - protein, 321 aa, Pseudomonas fluorescens PfO-1
MRALAALSRFVGNTFAYWVLIFAVIAFLQPAWFLGLKGAIVPLLGLVMFGMGLTLKLDDFAAVARHPWRVALGVVAHFVIMPGMAWLLCQIFHLPPEIAVGVILVGCCPSGTSSNVMTWLARGDLALSVAIAAVTTLLAPLLTPALIWLLASAWLPVSFMELFWSILQVVLLPIVLGVVAQRVLGDKVRHAVEVLPLVSVISIVIIVAAVVAASQAKIAESGLLIMAVVMLHNSFGYLLGYFTGRLFGLPLPQRKSLALEVGMQNSGLGAALASAHFSPLAAVPSALFSVWHNISGALLSTYFRRMSEKQDSETLAQQAAD

SEQ ID NO: 27534 - protein, 393 aa, Pseudomonas fluorescens PfO-1
MGGKASFNWIDPLLLDQQLTEEERMIRDTAEQFAQQSLAPRVLEAFRHEKTDPAIFREMGEVGLLGATIPEQYGGSGLNYVSYGLIAREVERVDSGYRSMMSVQSSLVMVPINEFGTEAQKQKYLPKLASGEWIGCFGLTEPNHGSDPGAMITRARKVDGGYSLTGAKMWITNSPIADVFVVWAKDDAGDIRGFVLEKGWKGLSAPAIHGKVGLRASITGEIVMDNVFVPEENIFPDVRGLKGPFTCLNSARYGISWGALGAAEFCWHTARQYTLDRQQFGRPLAATQLIQKKLADMQTEITLALQGCLRLGRMKDEGTAAVEITSIMKRNSCGKSLEIARMARDMLGGNGISDEFGVARHLVNLEVVNTYEGTHDVHALILGRAQTGLQAFY

SEQ ID NO: 27535 - protein, 270 aa, Pseudomonas fluorescens PfO-1
MSRLQTRFAELKEQNRAALVTFVTAGDPDYDTSLAILKGLPKAGADVIELGMPFTDPMADGPAIQLANIRALGAKQNLTKTLQMVREFREGNSDTPLVLMGYFNPIHKFGVERFIAEAKEAGVDGLIVVDMPPEHNSELCDPAQAAGIDFIRLTTPTTDDARLPKVLNGSSGFVYYVSVAGVTGAGAATLEHVEEAVARLRRHTDLPISIGFGIRTPEQAASIARLADGVVVGSALIDHIANATTPDQAIDGVLSLCSALSEGVRKARVS

SEQ ID NO: 27536 - protein, 224 aa, Pseudomonas fluorescens PfO-1
MQPFVIAPSILSADFARLGEEVDNVLAAGADFVHFDVMDNHYVPNLTIGPMVCAALRKYGVTAPIDAHLMVSPVDRIVGDFIEAGATYITFHPEATLHVDRSLQLIREGGCKSGLVFNPATPLDVLKYVIDKVDMVLLMSVNPGFGGQKFIPGTLDKLREARAIIDASGRDIRLEIDGGVNVNNIREIAAAGADTFVAGSAIFNAPNYQEVIDKMRSELALARP

SEQ ID NO: 27537 - protein, 374 aa, Pseudomonas fluorescens PfO-1
MSQVESNAGASDVLVSFRGVQKSYDGENLIVKDLNLDIRKGEFLTLLGPSGSGKTTSLMMLAGFETPTAGEILLAGRAINNVPPHKRDIGMVFQNYALFPHMTVAENLAFPLTVRGLNKSDVSDKVKKVLSMVQLDAFASRYPAQLSGGQQQRVALARALVFEPQLVLMDEPLGALDKQLREHMQMEIKHLHQRLGVTVVYVTHDQGEALTMSDRVAVFHQGEIQQIAPPRTLYEEPKNTFVANFIGENNRLNGRLLSQNGERCVVELGRGEKVEALAVNIGQTGEPVTLSIRPERVSLNGSSDQCVNRFSGRVAEFIYLGDHVRVRLEVCGKTDFFVKQPIAELDPALAVGDVVPLGWQVEHVRALDPLLEAH

SEQ ID NO: 27538 - protein, 470 aa, Pseudomonas fluorescens PfO-1
MSVATSLIEESSARIASAPAETLYQFNESPLLARQSRQESNARSYPRRIPLALKRAKGLYVEDVEGRSFIDCLAGAGTLALGHNHPVVIEAIQQVLSDELPLHTLDLTTPVKDQFVQDLFGLLPPALAKEAKIQFCGPTGTDAVEAALKLVRTATGRSTVLSFSGGYHGMSQGALSLMGSLGPKKPLGALLSSGVQFMPFPYDYRCPFGLGGAAGVKANLSYLENLLNDPEAGVQLPAAVIVEAVQGEGGVIPADIEWLRGLRRITEKAGVALIIDEIQSGFARTGKMFAFEHAGIIPDVVVLSKAIGGSLPLAVVVYREWLDSWQPGAHAGTFRGNQMAMAAGSAVMRYLVEHKVCEHAAAMGERLSEHLRILQRDFPQLGDIRGRGLMLGVELVDPSGTPDALGHPPAFARLAPLVQRECLKRGLILELGGRHGAVVRFLPPLVITAAEIDRVAEIFGRALSAATATL

SEQ ID NO: 27539 - protein, 161 aa, Pseudomonas fluorescens PfO-1
MSDNLLNIPCTTIKGEQKTLADFAGKAVLVVNTASKCGFTPQYKGLEELWQTYKDQGLVVLGFPCNQFGKQEPGNEGAISEFCELNYGVSFPLFKKIEVNGTGAHPLFVQLKKRAPGVLGSQGIKWNFTKFLIGKDGQLVKRFAPATKPQDLSREIEALLK

SEQ ID NO: 27540 - protein, 205 aa, Pseudomonas fluorescens PfO-1
MSEVNLSTDETRVSYGIGRQLGDQLRDNPPPGVSLDAILAGLTDAFAGKESRVSQEAMSASFKVIREIMQAEAAAKAEAAAGEGLAFLAENAKKEGITTLASGLQFEVLTQGEGAKPSREDTVRTHYHGTLIDGTVFDSSYERGQPAEFPVGGVIAGWTEALQLMNAGSKWRLYVPSELAYGAQGVGSIPPHSVLVFDVELLEVL

SEQ ID NO: 27541 - protein, 455 aa, Pseudomonas fluorescens PfO-1
MAKAKRMYGCTECGATFPKWAGQCGECGAWNTLTETMVESGGAAAPSGRTGWAGQQAQIKTLAEVSIEEIPRFSTASGELDRVLGGGLVDGSVVLIGGDPGIGKSTILLQTLCNLAKSMPALYVTGEESQQQVAMRARRLGLPQDQLRVMTETCIETIIATARQEKPKVMVIDSIQTIFTEQLQSAPGGVSQVRESAALLVRYAKQSGTAIFLVGHVTKEGALAGPRVLEHMVDTVLYFEGESDGRLRLLRAVKNRFGAVNELGVFGMTDKGLKEVSNPSAIFLTRAQEEVPGSVVMATWEGTRPMLVEVQALVDDSHLANPRRVTLGLDQNRLAMLLAVLHRHGGIPTHDQDVFLNVVGGVKVLETASDLALMAAVMSSLRNRPLPHDLLVFGEVGLSGEVRPVPSGQERLKEAAKHGFKRAIVPKGNAPKEAPPGLQIIAVTRLEQALDSLFE

SEQ ID NO: 27542 - protein, 431 aa, Pseudomonas fluorescens PfO-1
MLERLFQLKAHNTNVRTEILAGVTTFLAMAYILFVNPSILGETGMDKGAVFVATCLAAAIGSTVMGLIANYPIALAPGMGLNAFFTYTVVLHMGHTWQVALGAVFISAVCFFLLSIFRIREWIINSIPLPLRSAIAAGIGLFLALIALHNAGIVVSNPATMVGLGDLKQPAPILATLGFALIVALEALKVRGAVLIGILAVTIVSIVMGFTPFGGVTSMPPSLAPTFLQLDIKGALDIGLVSVIFAFLFVDLFDNSGTLIGVAKRAGLMGKDGHMPKMGRALIADSTAAMAGSLLGTSTTTSYIESAAGVSAGGRTGLTAIVVAILFLLALFFSPLASSVPAFATAPALLFVAVLMTSGLAEIDWEDITVAAPVVVTALAMPFTYSIANGIAFGFIAWTAIKLLSGRARELNPALVILSILFVIKLGWFNA

SEQ ID NO: 27543 - protein, 506 aa, Pseudomonas fluorescens PfO-1
MRYAHPGTEGAKVSFKSKYGNYIGGEFVAPVKGQYFTNTSPVNGQPIAEFPRSTAEDIEKALDAAHAAADAWGSTSAQARSLILLKIADRIEQNLETLAIIETWDNGKAIRETLNADIPLAADHFRYFAGCLRAQEGSAAEIDGNTVAYHIHEPLGVVGQIIPWNFPILMAAWKLAPALAAGNCVVLKPAEQTPLGISVLLELIGDLLPPGVLNVVQGFGKEAGEALATSKRIAKIAFTGSTPVGSHIMKCAAENIIPSTVELGGKSPNIFFEDIMQAEPSFIEKAAEGLVLAFFNQGEVCTCPSRALVQESIYPQFMEAVMKKVSQIKRGDPLDTDTMVGAQASEQQFDKILSYLEIAKGEGAELLTGGKVEKLEGSLATGYYIQPTLLKGTNKMRVFQEEIFGPVVSITTFKDEAEALAIANDTEFGLGAGLWTRDINRAYRMGRAIKAGRVWTNCYHLYPAHAAFGGYKKSGVGRETHKMMLDHYQQTKNLLVSYDINPLGFF

SEQ ID NO: 27544 - protein, 456 aa, Pseudomonas fluorescens PfO-1
MTTSRETRDYQAADAAHHIHAFVDQKALNDEGPRVMVRGDRLHLWDNDGRRYLDGMSGLWCTNLGYGRKDLNAAASRQLEQLPYYNMFFHTTHPQVIELSELLFSLLPGHYSHAIYTNSGSEANEVLIRTVRRYWQVLGKPEKKIMIGRWNGYHGSTLAATALGGMKFMHEMGGMIPDIAHIDEPYFFAHEGNLTPAEFGLRAAQQLEAKILELGADKVAGFIAEPFQGAGGMIFPPESYWPEIQRICRQYDVLLCADEVIGGFGRTGEWFAHEYFGFEPDTLSIAKGLTSGYIPMGGLILSKKMADVLVEQGGVFAHGLTYSGHPVAAAVAIANLKALRDEGVVTRVKDDIGPYLQQCLREVFGNHPLVGDIQGTGMVAALQLAEDKATRKRFANENDIAWRCRTIGFEEGVIIRSTLGRMIMAPALIASREEIDELVGKTLKALDRTAQEYGRL

SEQ ID NO: 27545 - protein, 509 aa, Pseudomonas fluorescens PfO-1
MTLHRVARFADVPEDRGLEVKIGDCKIVLLRVAGQLRAFQGQCPHAGAPLAEGALCHGRLICPWHKAAFRAEDGALCEPPALDSLKRYPLELRGDEVWVDDQPLPDPHTPPQDDPRTFVIVGAGAGGTACAAALREKGFGGRIVLIDREPDAGYDRTVLSKFVLSGEMPAAETPPLRDEDFYREQHINRVSGEVSGLDADTKTLHLSDGRTLNYSAAVLATGATPNALELPGVDLPQVFVLRSKAQAQYIMDAAQSGQRAVIIGDSFIALECASALRQHGLEVTVLARHAIPFAVQFGEAVGKAIRALHEENGVKFITDHEAREITGDGKVEAVLLDNGLRLSADLVLAGIGVHPATEAFGDLPREDDQSLLVDASLRVTESLWAIGDIATFPLNGKPQRIEHWRLAQQHARIAAANLLGGEEHYLDVPYFWTWHFGRNYDYLGHAEGWDAVEFIGKPEQPPFIGLFGSKGVVVAAVACEEERAMALLAERMKQPLPMDEAWRLIRAVR

SEQ ID NO: 27546 - protein, 480 aa, Pseudomonas fluorescens PfO-1
MQLKDTQLFRQQAFIDGAWVDADNGQTIKVNNPATGEILGTVPKMGAAETRRAIEAADKALPAWRALTAKERAGKLRRWFELMIENQDDLARLMTLEQGKPLAEAKGEIVYAASFIEWFAEEAKRIYGDVIPGHQPDKRLIVIKQPIGVTAAITPWNFPAAMITRKAGPALAAGCTMVLKPASQTPFSAFALAELAQRAGIPKGVFSVVSGSAGDIGSELTSNPIVRKLSFTGSTEIGRQLMSECAKDIKKVSLELGGNAPFIVFDDADLDKAVEGAIISKYRNNGQTCVCANRLYIQDSVYDAFAEKLKVAVAKLKIGNGLEEGTTTGPLIDEKAVAKVQEHIADAVSKGATVLAGGKPMEGNFFEPTILTNVPKDAAVAKEETFGPLAPLFRFKDEADVIAMSNDTEFGLASYFYARDLGRVFRVAEALEYGMVGVNTGLISNEVAPFGGIKASGLGREGSKYGIEDYLEIKYLCLGI

SEQ ID NO: 27547 - protein, 425 aa, Pseudomonas fluorescens PfO-1
MSKTNAELMARRTAAVPRGVGQIHPIFAESAKNATVTDVEGREFIDFAGGIAVLNTGHVHPKIIAAVTEQLNKLTHTCFQVLAYEPYVELCEKINARVPGDFAKKTLLVTTGSEAVENAVKIARAATGRAGVIAFTGAYHGRTMMTLGLTGKVVPYSAGMGLMPGGIFRALYPNELHGVSIDDSIASIERIFKNDAEPKDIAAIIIEPVQGEGGFYVAPKEFMKRLRALCDQHGILLIADEVQTGAGRTGTFFAMEQMGVAADLTTFAKSIAGGFPLAGVCGKAEYMDAIAPGGLGGTYAGSPIACAAALAVMEVFEEEKLLDRCKAVGERLVTGLKAIQAKHPVIGEVRALGAMIAVELFENGDSHKPNPTAVAAVVAKARDKGLILLSCGTYGNVLRVLVPLTSPDEQLDKGLAIIEECFSEL

SEQ ID NO: 27548 - protein, 334 aa, Pseudomonas fluorescens PfO-1
MSTQPIKQQLQRFNRLDLLGQPTPLEKLERLSTWLGRDVYIKRDDLTPLAMGGNKLRKLEYLAADAIAQGADTLITAGALQSNHVRQTAALAAKLGLGCVALLENPLGTDDSNYTGNGNRLLLDLFDTKVELVDNLDNADEQLAALAVRLRSNGKKPYLVPIGGSNAIGALGYVRAGLELAEQIKDTGLQFSAVVLASGSAGTHSGLALALSEALPQLPVIGVTVSRSEEDQRPKVQGLAERTADLLGVALPDSFKVELWDEYFGPRYGEPNAGTLSAVKLLASQDAVLLDPVYTGKAMAGLLDGIGRGRFDDGPIIFLHTGGAPALFAYKDFL

SEQ ID NO: 27549 - protein, 352 aa, Pseudomonas fluorescens PfO-1
MGALQLTNRIVMAPVTRSRMAEDGVPNELHATYYAQRASAGLIIAEATNISAQGRGYAMTPGIWSDAQGAGWKKVTDAVHAAGGRIVSQLWHVGRFSSVELQPDRAAPVAPSAIKAEGSTYTENGFVEVSMPRALETSEIPGIIEQYKRAAENARRAGFDGVEVHSANSYLLDQFLRDSTNQRTDRYGGTIENRARLTLEVTEAVISIWGSDRVGIRLSPVTPDAGNTPPDSNVMATYGYLIQQLNRLNLAYLHFVEGATATSRTVPDGVDLDALSAQFEGPFIGNNNYDLEMALERRAQGRIDAVAFGRLFISNPDLVERLRRGTELTIAPRESYYGGGAKGYTDWPTADH

SEQ ID NO: 27550 - protein, 464 aa, Pseudomonas fluorescens PfO-1
MPIDLTRRQLLQRASIVGAFSALACNPALGQLMRAPRLIPWRNWSGGQSCLPAARVAPKNLDELTAVIQQAPGKIRPVGSAHSFSALVPTDGTLLSLSYFNGLLDHDPKTLQAEFAAGTPMSRMGTPLKDVGQALQNMADIDYQTLAGAISTSTHGTGKTFQSYSAHVCGMQLVTARGEVLDCDSQRHPEVFNAARVSLGALGVATKIRLQNRPAYRLRERQWIAKTEELLEDLDKNTRENQHWEMLVVTHSDYALSIALNETTDPPTLPIPPEEEGGNEFVTLIEKIDKYGSDFPNLRSSLLNSLRHLASFDDRVGDSFEIYANVRTVRFNEMEYSVPAEHGPACLREILKLIRDKDLRTWFPIEYRYVKADDIPLSMFEGRDSCSISVHQHYQMDHHNFFAAVEPIFWKYNGRPHWGKLHTLNARTLQTLYPRWQEFIQVRQAVDPSGKFLNGHLSSILGVS

SEQ ID NO: 27551 - protein, 189 aa, Pseudomonas fluorescens PfO-1
MPDMLKRWCAVPALLMALTGLAQAADCPDLLQGSLPKLRAKESIDLCQRYADKPLVVINTASFCGFAPQFEGLEALNQRYKAQGLEMLGVPSNDFKQESKDSAETAKVCYANYGVTFTMTEPQKVRGDDATHLFQVLARQSSAPKWNFYKYVIDRQGKVIANFSSLTKPDDPEFLAAIEKAIASQSLKP

SEQ ID NO: 27552 - protein, 471 aa, Pseudomonas fluorescens PfO-1
MTPDKKVKILATLGPAVDGIEDIRELVEAGVNIFRLNFSHGDHADHAKRYQWIREVERQLNYPLGILMDLQGPKLRVGKFADGKVQLHRGQAFRLDLDATPGDERRVNLPHPEIIAALEAGMDLLLDDGKLRLRVVTKYSDAIDTTVLNGGELSDRKGVNVPQAVLDLSPLTTKDRRDLSFGLELGVDWVALSFVQRPQDILEARELIGDKAFLMAKIEKPSAVEQLREIAELSDAIMVARGDLGVEVPAESVPQIQKNIITTCRHLGKPVVVATQMLESMRFSPAPTRAEVTDVANAVAEGADAVMLSAETASGEYPLEAVQMMSKIIRQVENGPDYQTQLDVSRPKAEATVSDAISCAIRRISNVLPVAVLVNYSESGASSLRAARERPKAPILNLTPNLQTARRLSVAWGIHSVVNDRLRQVDEVCSTALEIAQAQGMAERGDTLLITAGVPFGQPGSTNSLRIETLI

SEQ ID NO: 27553 - protein, 472 aa, Pseudomonas fluorescens PfO-1
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGDAPKALAKIDKRGVPVRSILASAAVTLVAVLLNYLIPQHALELLMSLVVATLVINWAMISFSHFKFRQHMNKTHQKPLFKALWYPYGNYICLAFVLFILGVMLLIPGIQISVYAIPVWVVFMWICYVIKNKRGAQQALHAASAAK

SEQ ID NO: 27554 - protein, 316 aa, Pseudomonas fluorescens PfO-1
MDKILHQPLGGNEMPRFGGIATMLRLPHVPTAAGLDAAFVGVPLDIGTSLRPGTRFGPRDIRTESVMIRPYNMATGAAPFDSLSVADIGDVAINTFNLLDAVRIIEEAYDNILEHNVIPMTLGGDHTITLPILRAIHKKHGKVGLVHIDAHADVNDHMFGEKIAHGTTFRRAVEEGLLDCDRVVQIGLRAQGYTADDFNWSRDQGFRVVQAEECWHKSLAPLMAEVREKVGGGPVYLSFDIDGIDPAWAPGTGTPEIGGLTTIQAIEIVRGCQGLDLIGCDLVEVSPAYDTTGNTSLLAANLLYEMLCVLPGVVHR

SEQ ID NO: 27555 - protein, 220 aa, Pseudomonas fluorescens PfO-1
MGTFWLVLGGCGSAVIAASSPLGIGVLGVALAFGLTVLTMAFAIGHISGCHLNPAVSVGLVVGGRFPAKELPAYVIAQVLGGILAAALLYHIASGKEGFDIAAGLASNGYGEHSPGKYSMASGFVTELVMTAMFVVIILGATDKRAPAGLAPIAIGLALTLIHLISIPVTNTSVNPARSTGPALMVGGWAIAQLWMFWVAPLLGAVVGGVLYRWLGKEDS

SEQ ID NO: 27556 - protein, 441 aa, Pseudomonas fluorescens PfO-1
MNKHIGTLARWRMQIFAVTWLAYAAFYFTRKAFSVAKLGIAEDPSFTLDKMAMANLDAIYLAAYAIGQFTWGMLADRFGPRIVVLGGLLISAAAALVMGSFATLPIFATCMLIQGLAQSTGWSGLCKNLGSFFPSEQRGRVLGLWSSCYAFGGLVASPFAGWWAYTLVGTWHAAFISSAAVVAAVAVLFFIFQRNKPEDVGLPAVEPEPVISAEEAEANSKLSVWEPLKEILRNRTVLVLGLAYFLLKPARYAILLWGPVIVFEQMPSVGKVGAAIIPTAFELAGLLGPIMIGLASDKLFGARRMPACVLSLLALTVTLALFMGALHTGSVMLVVALLFVMGLTLYGPDSMISGAAAIDFGKAKAGATAAGFVNGCGSVGAVLGGLLPGYFDSVTVFIVFAGCALFSALVLIPHWNSRPVGVMEPRAYVPNRALTVKPLRN

SEQ ID NO: 27557 - protein, 346 aa, Pseudomonas fluorescens PfO-1
MDYRQLGRTDLNVSAICLGTMTWGEQNTEAEAFAQIERAKEAGINFLDTAEMYPVPPKADTYATTERYIGNYFKSRGDRADWILASKIAGPGNTIDYIRDKNLRHNRQHITEAVDASLKRLQTDYIDLYQLHWPERSTNFFGQLGYKHQTEANLTPLEDTLEALDEQVKAGKIRHIGLSNETPWGTMRFLALAEARGWPRAVSIQNPYNLLNRSFEIGLAEIAIREQCGLLAYSPLAFGFLSGKYEGGARPPKGRLSLYSRFSRYFNPQSEAACSRYVALAREHGLDPAQMALAFVNQQPFVTSNIIGATTLEQLDSNIASYELKLSKEVLEGIEAIHKDYPNPAP

SEQ ID NO: 27558 - protein, 395 aa, Pseudomonas fluorescens PfO-1
MTAALMNTYQPLDLSFIKGLGTRLWDLSGREYLDAVAGVAVTNVGHSHPRIVSAISEQAGLLLHTSNLYSIDWQQSLARKLTQLAGMERAFFNNSGAEANETALKLARLYGWHKGIEQPLVVVMANAFHGRTLGTLSASDGPAVRLGFNELPGDFVKVPFGDLEALEQVQRKHGQRIVAILVEPIQGESGVQLAPPGYLKALRELCNRHAWLLMLDEIQTGIGRTGRWFAFQHEGIVPDVMTLAKGLGNGVPIGACLARGRAADLFTPGSHGSTFGGNPLACRVGCTVLEIIEEQGLLENARVQGERLLTRLRAELADNPNVLAIRGQGLMIGIELKQPIRDLTLIAARDHGLLINVTRGKTIRLLPPLTIDEREVGMIVRGVGRSLSHVSSLGQ

SEQ ID NO: 27559 - protein, 173 aa, Pseudomonas fluorescens PfO-1
MGIPCHFALFELQPGFRLDLEQLATRYRELARGVHPDRFADASEREQRSALEQSARLNDAYQTLKSPAQRARYLLTISGHEVPMEVTVHDPEFLLQQMQWREELEDLQDSADLAGVAAFKRRLKTAQEELNESFAACWDDAAQREQAERLMRRMQFLDKLTYEVRQLEERLDD

SEQ ID NO: 27560 - protein, 489 aa, Pseudomonas fluorescens PfO-1
MLRISQEALTFDDILLVPGYSEVLPNEVSLKTRLTRGIELNIPLVSAAMDTVTEARLAIAMAQEGGIGIIHKNMTIEQQAAEVRKVKKFEAGVVKDPITIEADATVRDLFELTRMHNISGVPVLHDGDLVGIVTSRDVRFETRLDATVREVMTPKERLVTVREGADKNEVRELLHKHRLEKVLIVDDKFALKGMMTVKDIEKAKAYPLASKDDQGRLRVGAAVGTGKDTGDRVAALVNAGVDVVVVDTAHGHSKGVIDRVRWVKENFPEVQVIGGNIATGAAAKALAEAGADAVKVGIGPGSICTTRIVAGVGVPQISAIANVAAALEGTGVPLIADGGIRFSGDLSKAIVAGASCVMMGSMFAGTEEAPGEIELFQGRSYKAYRGMGSLGAMSQAQGSSDRYFQDSSAGAEKLVPEGIEGRVPYKGTLSAIIHQLMGGLRSSMGYTGSANIEEMRTKPEFVRITGAGMAESHVHDVQITKEAPNYRVG

SEQ ID NO: 27561 - protein, 473 aa, Pseudomonas fluorescens PfO-1
MPVGNHPPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKDSVQGAMRSAS

SEQ ID NO: 27562 - protein, 429 aa, Pseudomonas fluorescens PfO-1
MVLFGIAYMTPIIVLGTFGILAQSTAGMVPAAYLAALVAMFFTAMSYGRMAAAFPVAGSAYSYVRKAISPKLGFIAGWAVLLDYLFLPMAIWLIGAAYLASAFPSIPQWIWVLAFIGITSAINIIGLKLANGINALLMLVQFLVLIAFVGLCVHYVGGDASQPLWSIKPFFNGDMQMPLIMSGAAIACYSFLGFDAVSTLTEETRDPRRTIPRAIMLITLIGGLIFVGVSYFVQIAHPSFQFDSVDSAAYEIARNIGGDLFVSIFLIGLIVGQFASGLSAQASGSRLLFAMGRDGVLPKSFFGTLHERFGTPVNSILLCAVVALLALKLDVTTSTSFINFGAFLAFSLVNLSVIFHYWIGGEKKGLRELILFLIFPFIGLAADLWLMVSLDHLAVYLGLSWLAIGVVYLAVLTGGFRRQPPEMDFQEAA

SEQ ID NO: 27563 - protein, 283 aa, Pseudomonas fluorescens PfO-1
MTTALQQPSLSSQCLAEFLGTALLIFFGTGCVAALKVAGASFGLWEISIIWGVGVSMAIYLTAGVSGAHLNPAVSIALSIFADFEKRKLPFYILAQVAGAFCGALLVYTLYSNLFFDYEQTHHMVRGTEASLELASVFSTFPNPALSTAQAFLVEVIITAILMGVIMSLTDDNNGLPKGPLAPLLIGLLIAVIGSSMGPLTGFAMNPARDFGPKLMTFFAGWGEISFTGAREIPYFLIPIFAPIVGACLGAAGYRGLIARHLTGATPATKDAEPAIDGKPRTS

SEQ ID NO: 27564 - protein, 482 aa, Pseudomonas fluorescens PfO-1
MNFPTTLDGLYINGQWSAGREHLRVINPATEALLTTVNGGDESAVHQAVTAATEAFKAWSKTTGAERASILRNIANGVRNGREHLMNLQSSNNGKPQFEAGIDVDDVIATFEYYAELAEGLDAKLDSNVPLPSDDFSARLRREPCGVVGLIVPWNFPMVTTAWKLAPALAAGCCVVLKPSEVTPLPELELATIIAESGLPKGVFNLVCGTGLAVGAPLSADPRIAKVSFTGSNAVGVQVMQRAAETVKGVSLELGGKSSLLILEDADLDLAVELACGGGFFNAGQMCSATSRVLVADELADEFLIRLKAHAEKIRVADPFDPEVEMGALVNQAQYQRVLGHIDRGLSAGAKLICGGNRPADLPRGYFLQPTIFTEVPLDSALWCEEIFGPVICVRSFATEAEAIALANDSQFGLVASVVTRNAETADRVANALQAGLVWLNAPQVIFPQTAWGGYKQSSIGRELGPWGLAAFQEIKHVIRAL

SEQ ID NO: 27565 - protein, 483 aa, Pseudomonas fluorescens PfO-1
MSVRRTKIVATLGPASNSPEVLEQLILAGLDVARLNFSHGTPDEHKARAKLVRDLAAKHGRFVALLGDLQGPKIRIAKFANKRIELKIGDQFTFSTSHPLTEGNQQVVGIDYPDLVKDCGVGDELLLDDGRVVMRVETATATELNCVVTIGGPLSDHKGINRRGGGLTAPALTEKDKADIKLAAEMEVDYLAVSFPRDAADMNYARQLRDEAGGTAWLVAKIERAEAVADDETLDGLIKASDAVMVARGDLGVEIGDAELVGIQKKIILHARRHNKAVIVATQMMESMIQNPMPTRAEVSDVANAVLDYTDAVMLSAESAAGAYPLEAVQAMARICVGAEKHPTSKTSSHRIGKEFERCDESIALATMYTANHFPGVKAIIALTESGYTPLIMSRIRSSVPIYCFTPHREAQARAAMFRGVYTVPFDPASLAPNEVSQKAIDELVKRGVVEKGDWVILTKGDSYHTTGGTNGMKILHVGDPQV

SEQ ID NO: 27566 - protein, 454 aa, Pseudomonas fluorescens PfO-1
MNTQLKPTLGTLHLWGIAVGLVISGEYFGWSYGWGVAGTLGFLVTSFMVATMYTCFIFSFTELTTAIPHAGGPFAYSRRAFGEKGGLIAGLATLIEFVFAPPAIALAIGAYLNVQFPALDPKHAAVGAYIVFMGLNILGVKLAATFELIVCILAVAELLVFMGVVAPAFSFSNFALNGWAGSDVFGAPAIAGMFAAIPFAIWFFLAIEGAAMAAEEAKDPKRTIPKAYISGILTLVLLAMGVMFFAGGVGDWRTLSNINDPLPQAMKTVVGDNSGWLHMLVWIGLFGLVASFHGIILGYSRQFFALARAGYLPASLAKLSRFQTPHRAIIAGGVIGIAAIYSDGLINLGGMTLTAAMITMAVFGAIVMYIMSMLSLFKLRKSEPNLERTFRAPCYPLIPLIALVLAVVCLVAMAWFNALIGLIFLGFMAVGFGYFLLTGQLRANAPADAMLTGL

SEQ ID NO: 27567 - protein, 350 aa, Pseudomonas fluorescens PfO-1
MYTAIGYAAQTATTPLAPMKFERRSPRADDVAIEILYCGVCHSDIHQARNEWGIAVYPLMPGHEIVGKVTAVGANVTKHKVGDLVGVGCMVDSCRTCEACQSNLEQYCLEGPTMTYATPDRVDGSNTMGGYSDSIVVSEHFVVRIPEKLDLAAAAPILCAGITTYSPLKHYGVKAGDKVGILGMGGLGHMGIKFAKAMGAEVTLFTRSASKAEEGRRQGADHVIVSTDEEQMKAAAGRFDFLLDTIPVQHDLNPYLDTLRFDGVHILVGLIEPIDPPVHAAKLVLGRRVLAGSLIGGVAETQEVLDFCAEHNISCDIEMLDIRQINEAYARMIAGDVKYRFVIDMATLKL

SEQ ID NO: 27568 - protein, 300 aa, Pseudomonas fluorescens PfO-1
MTLQYPTIADCVGNTPLVRLQRLPGVTSNTLLLKLEGNNPAGSVKDRPALSMITRAELRGQIHEGDTLIEATSGNTGIALAMAAAIKGYKMILIMPDNSSAERKAAMTAYGAELILVSQEEGMEGARDLAQRMEAEGRGKVLDQFANGDNPEAHYTTTGPEIWRQTQGSITHFVSSMGTTGTIMGVSRYLKEQNDNVQIVGLQPMEGSAIPGIRRWPQEYLPKIYQADRVDRIVDMAQSEAENVTRRLAREEGIFCGVSSGGAVAAMLRLSKEVENAVIVAIICDRGDRYLSTGIFDAPN

SEQ ID NO: 27569 - protein, 387 aa, Pseudomonas fluorescens PfO-1
MTVLKMSDLDLQGKRVLIREDLNVPVKDGVVTSDARILASLPTIKLALEKGAAVMVCSHLGRPTEGEFSAENSLKPVADYLSKALGREVPLVADYLGGVDVKAGDIVLFENVRFNKGEKKNADELAQQYAALCDVFVMDAFGTAHRAEGSTHGVAKFAKVAAAGPLLAAELDALGKALGAPAKPMAAIVAGSKVSTKLDVLNSLSQICDQLIVGGGIANTFLAAAGHPVGKSLYEPDLLDTARAIAAKVSVPLPVDVVVAKEFAESAEATVKLIADVAADDMILDIGPQTAANFAELLKSSKTILWNGPVGVFEFDQFGNGTKVLAEAIAESAAFSIAGGGDTLAAIDKYGVAEKISYISTGGGAFLEFVEGKVLPAVEVLESRAKA

SEQ ID NO: 27570 - protein, 283 aa, Pseudomonas fluorescens PfO-1
MTDTSVLLHKHSFVELGARQRAKALLDAGTFRELLDPFQRVMSPWLERQGVVPQADDGVVIAKGSLDGLPVVIAAIEGAFQGGSLGEVGGAKIAGALELAAEDNREGIPTRAILLLETGGVRLQEANLGLAAIADIHAAIVDLQQYQPVVGVVAGSVGCFGGMSIAAALCSYLLVTQEARLGLNGPQVIEQEAGIEEYDSRDRPFIWSLTGGEQRFASGLVDRYVADDVAQIRGQVGELLYQGLPAQPRSQRAEWFLKRLTSLDTDKQIEPSVVRDLYQGERS

SEQ ID NO: 27571 - protein, 476 aa, Pseudomonas fluorescens PfO-1
MTADIAYLQTLQQPLEELNRLFNAQRAAYAANPMPPATQRQQWLKALRDLLSSERQALIDAISSDFSHRSADETLLAELMPSLHGIHYASQHISQWMKPSRRKVGVAFQPASAKVVYQPLGVVGVIVPWNYPLFLAIGPLTGALAAGNRVMLKLSESTPATGLLLKELLARIFPEDLVCVVLGEADVGVAFSKMRFDHLLFTGSTSVGRHVMRAAAENLTPVTLELGGKSPAIVSHDVPLKDAAERIAFGKTLNAGQTCVAPDYVLVPEARIGGFVEAYRQAVRGFYPTLADNPDYTAIINERQLARLNSYLSDATSKGALLIPLFDQGQGRRMPHSLLLNVSDEMTVMQDEIFGPLLPIVPYQDLDQAFAYINQRPRPLALYYFGYDKREQQRVLSETHSGGVCLNDTLLHVAQDDMPFGGIGPSGMGHYHGHEGFLTFSKAKGVLVKQRFNAAKLIYPPYGKSIQKLIQKLFIR

SEQ ID NO: 27572 - protein, 159 aa, Pseudomonas fluorescens PfO-1
MIDPDGFRPNVGIILTNDAGQVLWARRINQDAWQFPQGGINPEETPEDALYRELNEEVGLEREDVEILACTRGWLRYRLPQRLVRTHSQPLCIGQKQKWFLLRLISNEQRVRMDLTGKPEFDGWRWVSYWYPLGQVVTFKREVYRRALKELAPRLLARD

SEQ ID NO: 27573 - protein, 436 aa, Pseudomonas fluorescens PfO-1
MPEEKIDSTYRRLRWQIFAGIFFGYAGYYLLRKNFSLAMPYLIDEGYSRGDLGLAMSAIAIAYGLSKFLMGLVSDRSNPRYFLPFGLLVSAGVMFIFGFAPWATSSVTMMFILLFINGWAQGMGWPPSGRTMVHWWSQKERGGVVSVWNVAHNVGGGLIGPLFLIGMGLFNDWHAAFYVPAAVALAVAVFAFVTMRDTPQSVGLPPIEKYKNDYPEGYDASHEDEFSAKEIFVKYVLRNKMLWYIAMANVFVYLLRYGVLDWAPTYLKEAKGFTVDKTSWAYFFYEWAGIPGTLLCGWMSDKIFRGNRGLTGMVFMALVTVATLVYWLNPAGNPTIDMIALFSIGFLIYGPVMLIGLQALELAPKKAAGTAAGFTGLFGYLGGSVAASAAMGYTVDHFGWDGGFVLLVGACLLSMAFLAPTLWHKQVASQSREAVA

SEQ ID NO: 27574 - protein, 464 aa, Pseudomonas fluorescens PfO-1
MQRPVRTELWAILRLAGPLIASQLAHMLMVLTDTLMMARLSPEALAGGGLGAASYSFVSIFCIGVIAAVGTLVAIRQGAGDIIGAARLTQAGLWLAWLMALGAGLLLWNLKPVLLLFGQTETNVNAAGQFLIALPFALPGYLSFMALRGFTSAIGRATPVMVISLAGTVANFLLNYALITGMFGLPKLGLTGIGLVTAIVANCMALALAWHIRRHPAYDAYPLREGLSRPNRQYLKELWRLGLPIGGTYAVEVGLFAFAALCMGTMGSTQLAAHQIALQIVSVAFMVPAGMSYAITMRVGQHYGAGQLSDARMSGRVGIVFGAVVMLGFAMVFWLLPNQLVGLFLDHNDPAFAEVIRLAVSLLAVAAWFELFDGTQTIAMGCIRGLKDAKTTFLVGLVCYWLIGAPAAWLMAFHLHWGPTGVWWGLALGLACAAVSLTLAFEWKMKRMIRLEPQSQGFKIAQPE

SEQ ID NO: 27575 - protein, 382 aa, Pseudomonas fluorescens PfO-1
MSAPVVIVGTGLAGYNLAREFRKLDGETPLLLITADDGRSYSKPMLSTGFGKNKDADGLSMAEPGAMAEQLKAEIRTHTRISGIDPGHKRLWIGEEAVSYRDLILAWGAETVRVPIEGDGGDLVFPINDLEDYARFRAAAAGKRRVLLLGAGLIGCEFANDLILGGYEVQLVAPCEQVMPTLLHPAAAAAVQAGLESLGARFHLGPVLTRLQKVADGLEAHLSDGQVVPCDVVVSAIGLRPRIDLAAAAGIQTNRGVVVDRHLQTSHANIYALGDCAEVDGLNLLYVMPLMSCARALAQTLAGNPTVVNYGPMPITVKTPVCPLVVSPPPRGREGVWTVEGQGADIKVLCHDAEGQLLGYALTGAAVMEKLALNKQLPALLA

SEQ ID NO: 27576 - protein, 341 aa, Pseudomonas fluorescens PfO-1
MLTIYSDDHHLHHGRCELIDGQLKPCFEMPSRADHVLQRVKNQNLGPVEAPKDFGLGPIERIHSRDYLDFFKGAWARWTEFNTDGDLLPYTWPARTLRQVKPTSLHGQLGYYSFDGGAPITAGTWQAAYSAAQVALTAQAEIQRGARGAFALCRPPGHHAAGDLMGGYCYLNNAAIAAQAFLDQGHKKVAILDVDYHHGNGTQSIFYERSDVLFTSIHGHPEAEFPFFLGYEDERGEGAGEGFNFNYPLPAGSGWDIWSAALDQACQEIDNYGADIIVVSLGVDTFKDDPISQFKLDSPDYLAMGKRIAALGKPTLFVMEGGYAVEEIGINAVNVLEGFEQ

SEQ ID NO: 27577 - protein, 380 aa, Pseudomonas fluorescens PfO-1
MLFNVIDGLDAMVMVFTVHRVAALWSLSAAQMGLLLSASLVGMAAGSLCVGAMTQRFGRRPVVLASLALSGMTMLLGFWSQELYSLLCLRMLTGLGVGAVLVCANVLTHDHAPPRHRSLGIALQSVAFALGVTLGGLLAHRLNDSLGWRYVFLAGGVLTLLLAAIGARWLRESASPLAVEKTAPRYRDLISRARWQSTCTLAVVCFLLMFGFYFVMSWTPMLLTLGGFSERHGITGGMLLTIGGMCGALLLGLGANRLGCHRLLGAGLLLNALLMLSMVSAAHVPVLAVVMGFTVGFSLYAAIAALFVMAPQAFDSAVRTRGVGLVLATGRLGAILSPTVAGVLLDAQWRPQDLFTFYAGTQLLAVLLIGRNRRPTPEAG

SEQ ID NO: 27578 - protein, 327 aa, Pseudomonas fluorescens PfO-1
MLFAISALASTLAAQATSRTEPKPDWSTQDMPSQNGRIVLVTGGTSGMGYEDALALTRAGAEVIIAARNAERGREAIANIRQAVPEARVQFETLDLANLQSVRDLANRLQGRLPRLDVLINNAAIMSPPVRGVSADGYEMQLATNYLGHFALTGLLMPLLRKSDDGRVVSLSSIAAGRAVLNFDDLQAERAYDPFTTYSQSKLAVLKWSIELQQRSDAAGWGIRSIAAHPGVAVTELIARGPGLDSEFGKQWAVERDMYHSAAQGALPTLYAATAPEAVGGAYYGPTGDNEKRGPLGFAKMPPAAADRSNSDALWQLSERLTGVTYR

SEQ ID NO: 27579 - protein, 196 aa, Pseudomonas fluorescens PfO-1
MDLSRRQFFKVAGIGLAGSSLGALGMAPTQAFAEQVRHFKLAHTHETRNTCPYCSVGCGLIMYSQGDAAKNVAQNIIHIEGDADHPVNRGTLCPKGAGLLDFIHSPGRLQYPQVRKPGSSEWTRITWDEALDRVADLMKADRDANFVEQNAQGQTVNRWLTTGFLAASAASNEAGYITHKVVRSLGMLGFDNQARV

SEQ ID NO: 27580 - protein, 312 aa, Pseudomonas fluorescens PfO-1
MYLVCGEALFDFFSEDDAGGQASKVNFKAIAGGSPFNVAVGLRRLGVDSALFGGLSTDYLGRRLQQVLQDEGVHPDYLVDFAAPTTLAMVAVGANGSPHYSFRGEGCADRQLSLAHLPALGPEVRGLHFGSFSLVVQPIADTLLALVQRESGKRLISLDPNVRLNPEPNIDLWRERIATLVPLADLIKVSDEDLSLLYPEQDPARVIEGWLQHRCQVVFLTRGGEGATVFSRVHGSWSVPASSVKIADTVGAGDTFQAALITWLTEHELDSVEGVQHLSREQIDGMLRFAVQAAALTCSKTGPDLPYRHQLT

SEQ ID NO: 27581 - protein, 316 aa, Pseudomonas fluorescens PfO-1
MGGNIARRLMLNGHTTVVYDRNTAFVDTLAAEGSTGVADLPALVAGLAKPRAVWVMLPAGAPTEDTIETLSHLLEAGDTIIDGGNTNYKDDIRRAKTLAEKGLHYIDVGTSGGVWGLERGYCMMIGGDAETVKRLDPLFAALAPGMGDIPRTKDRKSDDHRAEHGYIHAGPAGAGHFVKMIHNGIEYGMMAAFAEGFDILKTKSSELLPEDQRFDLNVADIAEVWRRGSVVSSWLLDLTADALAVDPKLDGFSGSVADSGEGQWTIEAAMEQKVPVPVLSNSLFSRYRSRGQGTFGDKILSAQRFGFGGHVETPKK

SEQ ID NO: 27582 - protein, 220 aa, Pseudomonas fluorescens PfO-1
MHIQKLVLAMAIGAVLSASTVLIPDNLSGVSSVQAKEGGSGGGGSGGGGGGGGNGGGGGGNGGGGSGGGGGGNGGGGSGGGGGGNGGGGSGGNGGGHGGSGSGGNSGSGGGGNSGHSGSDHGSGHSGNTASSGRSGTHSEPGDDHGVHRAGEVGDDHGVHRAGEIGDDHGVHRAGEVGDDHGVHRAGEIGDDHGLHAAGQPGDDRGVHVGGEPGDDKRAN

SEQ ID NO: 27583 - protein, 326 aa, Pseudomonas fluorescens PfO-1
MTRIEITEPGGPEVLQSRRVPLPVAAEGEVLIRVHAAGVNRPDALQRAGKYPMKPGMNPIPGLEVAGEVVAIGSGVSTFAVGDRVCALTNGGGYAEYCTVPAGQTLPIPDGLDWIQAAAIPETFFTVWANLFGLGGASRGQRALIHGGTSGIGTTALMLCREFGIEAFATAGSADKCAAIRNLGGDAINYREQEFAAVIAEKTASQGVNVILDIMGGSYLNGNISALGMDGRLVMLGFLGGARANDIDLLAILGKRAVVTGSLLRARTSAEKAAIADQLREHVWPVLAAGRCLPIIDKVYPLAEAAKAHAHMEAGDHIGKIVLKID

SEQ ID NO: 27584 - protein, 403 aa, Pseudomonas fluorescens PfO-1
MNKSFWKSGHTPTLFAAFLYFDLSFMVWYLLGPLAVQIAGDLHLTTQQRGLVVATPILAGAVLRFAMGMLADRLSPKTAGLIGQVIVICALFGAWKLGIHSYEQALLLGLFLGMAGASFAVALPLASQWYPPEHQGKAMGIAGAGNSGTVFAALIAPVLAAAFGWSNVFGFALIPLILTLVLFAWLAKNAPERPRAKAMADYFKALGDRDSWWFMFFYSVTFGGFIGLASALPGYFNDQYGLSPVTAGYYTAACVFGGSLMRPLGGALADRFGGIRTLLAMYTVAAVCIAAVGFNLPSSYAALALFVCTMLGLGAGNGAVFQLVPQRFRREIGVMTGLIGMAGGIGGFALAAGMGAIKQSTGSYQLALWLFASLGVLAWFGLHGVKRRWRTTWGSAAVTAARV

SEQ ID NO: 27585 - protein, 163 aa, Pseudomonas fluorescens PfO-1
MNHYLTPDLCDAYPELVQVLEPMFSNFGGRDSFGGEIVTIKCFEDNSLVKEQAELKGNGKVLVVDGGGSLRCALLGDMIAEKAAKNGWEGLVIYGCIRDVDVIAQTDLGVQALASHPKKTEKRGLGDLNVPVTFAGVTFHPGQYIYADNNGVIISPSPLKMPE

SEQ ID NO: 27586 - protein, 265 aa, Pseudomonas fluorescens PfO-1
MLGLECSGVISEVGAGSSWQVGDRVCALLAGGGMAQEVVVDGRHVLPVPEGVSLIEAAALPEVYATVWLNVFQLAALKPGEKVLLHAGASGIGSAAIQLCKAFGNPCWVSVGSAERLAYCESLGAQGGVVRTDDLESLRDFGPFDVILDPVGGNYSALNLKLLAQDGRWVLIGLMGGREAKLDLAQVLAKRVQLLGSTLRSRDDQFKADLFSDLSQHVWPLFSEGRLKPQLAKAFPIKDAEAAFAELASNTVAGKLVLVIDESLS

SEQ ID NO: 27587 - protein, 499 aa, Pseudomonas fluorescens PfO-1
MPHTKDQLPDALYRAAQVRELDARLIAGGTPGFELMQRAAHATWRALVRQWPAANEMTVFAGHGNNAGDGYLVAALAHRAGWQVQVLAVGEPQRLKGDAAVAHAEAVAEGVSIAAWDLSCELRGIVVDALLGTGLNGEVREPYAAAIAAINASGLPVVAVDIPSGLCADTGHALGDAVHADLTVTFIGLKLGLFTGAAADHVGELRFNDLQATAENFSDIPAAAQRLSAINLPRLAARAPAAHKGRFGHVLLIGGDHGFGGAILLSTESALRSGAGMVSVATRPEHVPAALSRVPEAMVLGTSSANQLMGLLEKVSVLVVGPGLGQAAWGRALLSAAANASLPQVWDADALNLLARGFVSLPKDCVITPHPGEAARLLGISTAEVQADRPAAALALSKKYTAVVVLKGAGSLIAHPDGRLALCHQGHPAMATAGLGDVLAGLIGALLAQGMDGFDAACLAVWLHASAGAQQGKFGRGLAASDLIPAIRQLLEEHAPCLK

SEQ ID NO: 27588 - protein, 240 aa, Pseudomonas fluorescens PfO-1
MHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 27589 - protein, 367 aa, Pseudomonas fluorescens PfO-1
MPVQALFKPFQLGALELPTRVVMAPMTRSFSPGGVPNSKVIEYYRRRAAAGVGLIITEGTTVGHQASNGYPNVPHFYGEAALAGWKKVVEAVHAEGGKIVPQLWHVGNVRRLGTEPDASVPGYGPSEKLKDGQVVVHRMTKQDIQDVIAAFAQAAKDAQSIGMDGVEIHGAHGYLIDQFFWEGSNQRTDEYGGSLANRSRFAIELIQAVRAAVGEGFPIIFRFSQWKQQDYTARLVQTAEALGEFLKPLSDAGVDIFHCSTRRFWEPEFDGSDLNLAGWTRKLTGKPTITVGSVGLDGEFLQFMVNTDKVAQPASLEKLLERLNNEEFDLVAVGRALLVDPDWAQKVREGREQDILPFSREALMTLV

SEQ ID NO: 27590 - protein, 324 aa, Pseudomonas fluorescens PfO-1
MKKTVLAFSRITPPMIERLQQDFDVIVPNPKNGDINAQFNEALPHAHGLIGVGRKLGKAQLENAAKLEVVSSVSVGYDNYDLAYFNERGIMLTNTPDVLTESTADLAFALIMSSARRVAELDAWTKAGQWQASVGAPLFGCDVHGKTLGIVGMGNIGAAVARRGRFGFNMPIIYSGNSRKTELEQELGAQFRSLDQLLAEADFVCLVVPLSDKTRHLISHRELALMKPDAILVNISRGPVVDEPALIEALQNNRIRGAGLDVYEKEPLAESPLFQLKNAVTLPHIGSATNETREAMANRALTNLRSALLGERPQDLVNPQVWRG

SEQ ID NO: 27591 - protein, 254 aa, Pseudomonas fluorescens PfO-1
MSEAIKKPVGPEGIIQMQGVNKWYGQFHVLKDINLNVRQGERIVLCGPSGSGKSTTIRCLNRLEEHQQGRIVVDGVELTNDLKQIEAIRREVGMVFQHFNLFPHLTILQNCTLAPMWVRKMPKRKAEEIAMHYLERVRIPEQAHKYPGQLSGGQQQRVAIARALCMKPKIMLFDEPTSALDPEMVKEVLDTMIGLAEDGMTMLCVTHEMGFARTVANRVIFMDKGEIVEQAAPNDFFDNPQNDRTKLFLSQILH

SEQ ID NO: 27592 - protein, 485 aa, Pseudomonas fluorescens PfO-1
MAGAQTHMHTALLIDGELVAGQGFVEPILNPATGEVLTQIAEASTEQVEAAILAAHRAFAEWSRTTPQQRSNLLLEIANAVEKHADHLARLEALNCGKPLHLARQDDLTATIDVFRFFAGAVRCQTGQLSGEYVPGYTSMVRRDPIGVVASIAPWNYPIMMAAWKIAPALAAGNTLVFKPSEHTPLSILALAPALAEILPRGVINIVCGGGEGVGSHLVGHPKVRMVSLTGDIVTGQKILQAAAKTLKRTHLELGGKAPVIVCNDADLKAVVEGVRTYGYYNAGQDCTAACRIYAQAGIHDKLVAELGAAVSSLRFAGKRDADNEIGPLISTRQRDRVASFVERALGQPHIERVTGAAVHSGAGFFYQPTLLAGCKQSDEIVQREVFGPVVTVTRFDELAQAVDWANDSEYGLASSVWTQNLDKAMQVAARLQYGCTWINSHFMLASEMPHGGLKRSGYGKDLSSDSLQDYSVVRHIMARHGQHL

SEQ ID NO: 27593 - protein, 216 aa, Pseudomonas fluorescens PfO-1
MRVILLGAPGAGKGTQAKFITEKFGIPQISTGDMLRAAVKAGTELGIKAKSIMDAGGLVSDDLIIALVKDRIAQADCAKGFLFDGFPRTIPQAEALVTAGVELDAVVEIAVEDEEIVQRIAGRRVHEASGRVYHIVYNPPKIAGKDDITGEELVQRKDDTEETVRHRLSVYHSQTKPLVEFYQNLSAKNGGKPKYSHIPGVGSVEAITAKVLEALS

SEQ ID NO: 27594 - protein, 429 aa, Pseudomonas fluorescens PfO-1
MAKIVDIKGREVLDSRGNPTVEADVLLDNGIIGSACAPSGASTGSREALELRDGDKSRYLGKGVLKAVANINGPIRDLLLGTDPSDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLSTAVGDEGGFAPNLASNEDALKVISEAVANAGYKLGTDVTLALDCAASEFFEDGKYNLSGEGQVFTAEGFADYLKGLTERYPIISIEDGLDESDWAGWKILTDKIGEKTQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRSEFRG

SEQ ID NO: 27595 - protein, 364 aa, Pseudomonas fluorescens PfO-1
MSDNRQWAREAIRIIEADFQRSADTHLIPLPLPGFPGIKLYFKDESSHPTGSLKHRLARSLFLYALCNGWLKPGAPVIEASSGSTAISEAYFARMLGLPFIAVMPATTSKEKIAQIAFYGGQSHLVDDPTQIYAESERLAREHDGHFIDQFTYAERATDWRANNNIAESIFQQMRYEQHPCPAWLISSPGTGGTTATLGRYVRYRQHCTRVLCADAERSVFFDFYQSGDASLRLDHGSRIEGIGRPRVEASFLPKVIDAMVKVPDALSLAAMHYLAQRLGRHVGGSSGTNLIGALMAAQQMKAAGESGSIVAILCDGGERYADTYYDQAWLKAQGYELDGLMAAVAASAEQGEALPASVLRANI

SEQ ID NO: 27596 - protein, 448 aa, Pseudomonas fluorescens PfO-1
MNQPQSAVGHCLDVQSFINAQPISRYQWRVVILCFLIVFLDGLDTAAMGFIAPALSQDWGIDRASLGPVMSAALIGMVFGALGSGPLADRFGRKVVLVGAVFLFGAFSLASAYATNVDQLLVLRFLTGLGLGAGMPNATTLLSEYTPERKKSLLVTSMFCGFNLGMAGGGFISAKLIPAFGWHSLLLIGGILPLILTVVLLLWLPESARYLVVRNRGTDKVRKTLAPIDPAIVAQAASFSVPEQKTVKARNVFAVIFSGTYSVGTLLLWLTYFMGLVIVYLLTSWLPTLMRDSGASMEQAAFIGALFQFGGVLSAVGVGWAMDRFNPHKVIGIFYLLAGVFAYAVGQSLGNITLLATLVLVAGMCVNGAQSAMPSLAARFYPTQGRATGVSWMLGIGRFGAILGAWMGATLLGLGWNFEQVLTALVIPAGLATAAVVIKGLVSHADAT

SEQ ID NO: 27597 - protein, 232 aa, Pseudomonas fluorescens PfO-1
MAGFDKRVYSYEEAMAGLEDGMTVIAGGFGLCGIPENLIAEIKRKGTRDLTVVSNNCGVDGFGLGVLLTDRQISKVVASYVGENKLFEEQLLKGDIEVVLTPQGTLAEKMRAGGAGIPAFFTATGVGTPVAEGKEVREFHGRKYLMEESITGDFAIVKGWKADHFGNVIYRHTAQNFNPLAATAGKITVVEVEEIVEPGELDPAHIHTPGIYVDRVICGTFEKRIEQRTIRK

SEQ ID NO: 27598 - protein, 496 aa, Pseudomonas fluorescens PfO-1
MTTTRNDWEQRFQSLTLESRAFINGEYRPAISGETFECLSPVDGRFLASVASTDEADANLAVEAARQSFNAGVWANKAPAERKRILIRFADLILQHQEELALLETLDMGKPISDSMSIDIPATANAIRWSAEAIDKIYDEVAATPHDQLGLVTREPSGVVAAIVPWNFPLIMASWKFAPALAAGNSFILKPSEKSPLTAIRIAQLALDAGIPKGVFNVLPGFGHTVGKALALHMDVDVLAFTGSTAIAKQLMIYAGQSNMKRVWLEAGGKSPNVVFADAPDLRAAAQAAAGAIAFNQGEVCTAGSRLLVERSIREQFIPLLVEALQAWKPGHALDPATTVGAVVDQRQLDNVLRYISIGREQGAELIAGGRRTLEDTGGTYIEPTIFDGVTNAMTIAKEEIFGPVLSLITFDTVEEALHIANDSIFGLAAGVWTSNLSKAHTFARGLRAGSVWVNQYDGGDMTAPFGGFKQSGNGRDKSLHAFDKYTELKATWIKL

SEQ ID NO: 27599 - protein, 256 aa, Pseudomonas fluorescens PfO-1
MIEVRGLCNRFGHQSVHENLDLDLYKGEILAVVGGSGSGKSVLLRSIVGLRRPSEGMVKVFGQNLPSLPEHERSLIERRFGVLFQKGALFSSLTVTENVALPLIEHAGLSRDDAEHLAAVKLALAGLPLSAADKYPASLSGGMIKRAALARALALDPDILFLDEPTAGLDPIGAAQFDQLILTLRDALGLSVFLVTHDLDTLYTITDRVAVLAQKKVLVAGPIDVVSETDDAWIHEYFHGPRGRSALDAATQLNEV

SEQ ID NO: 27600 - protein, 384 aa, Pseudomonas fluorescens PfO-1
MSAVIKDASQQNDKPLVSLRNLNKHYGDFAAVDNISLDIKDGEFLTFLGSSGSGKSTTLSMLAGFETPSSGEILVNGQSLVNVPPHKRDIGMVFQRYSLFPHLSVRDNIAFPLAIRKLAAAERDKRVDAMLKLVQLEQFAHRRPSQLSGGQQQRVAIARALVYEPRILLMDEPLGALDKKLREDLQDELRQLHRRLGITIVYVTHDQEEAMRLSQRIAIFSHGKIVGLGSGYDLYQNPPNAFVASFLGNSNFLKLKAQGNAAASFEGQSLSIRLTAGLPTGQDVLLMVRPEKALALSVQQANDEPLAAGWNEVSAKVVEVLFLGESQTCSVVTSGGTSMTVKALSAAGMPLKAGDPVRVRWATADACVYTEWAESDLNKAAGAH

SEQ ID NO: 27601 - protein, 458 aa, Pseudomonas fluorescens PfO-1
MSKDSRPAVLGLIGNTPLVQVTRFDTGPCTLFLKLESQNPGGSIKDRIGLAMIDAAERDGRLQPGGTIVEATAGNTGLGLALVGRAKGYRVVLVVPDKMSTEKVLHLKAMGAEVHITRSDVGKGHPEYYQDVAARLAKDIPGAFFADQFNNPANPLAHEFSTGPEIWAQTEHDLDAIVVGVGSAGTLTGLTRFFKRVQPDLEMVLADPVGSVMAEYSRSKHLGTAGSWAVEGIGEDFIPSITDLSSVRSAYSISDEESFDHARQLLKAEGILGGSSTGTLLAAALRYCREQTEPKRVVSFVCDTGTRYLSKVYNDQWMTDQGLLQRKRYGDLRDLIARRFEDGKVVSVGPDDTLMTAFQRMRLADVSQLPVLVDGKQLVGVIDESDILVRVHEDASLFSKPVSSAMTDKLQTLAPGATLAELEAVLSSGLVAIIADASGFHGLITRVDMLNQLRRSLA

SEQ ID NO: 27602 - protein, 455 aa, Pseudomonas fluorescens PfO-1
MIETLNHLPHPQESAAALAGHFTDLAPPLNDRQAHLEASRCLYCYDAPCVNACPSEIDIPSFIRNIHQDNVPGAAQKILSANILGGSCARVCPTEILCQQACVRNNAHECAPVLIGLLQRYAVDNANFTEHPFQRAAATGKRIAVVGAGPAGLSCAHRSAMHGHEVVIFEAREKAGGLNEYGIAKYKLVDDYAQKELDFLLQIGGIEIRHGQKLGENLTLSELHQQFDAVFLGLGLNASKQLGLPHEDAPGLLAATDYIRELRQADDLSQLPLAERCIVLGAGNTAIDMAVQMARLGARDVNLVYRRGAADMGATGHEQDIAKANQVRLLTWAQPDEVLLDAQGKVRGMRFARTHLVDGRLQTTGETFELAADAIFKAIGQAFDGSALADPLARELKRQGERIQVDENLRTSIPGVYAGGDCTSLDQDLTVQAVQHGKRAAEAINAQLMLNVEAA

SEQ ID NO: 27603 - protein, 457 aa, Pseudomonas fluorescens PfO-1
MQSLNTTLLIIGGGPGGYVTAIRAGQLGISTILVEGESLGGTCLNIGCIPSKALIHVAEQFHQTQHHNQHSALGISVSAPTLDITKSVEWKDGIVDRLTTGVAALLKKNKVQVINGWAKVIDGKTVEVGDTRIQCEHLVLATGSKSVNLPILPIGGPIISSTEALAPKSVPKRLIVVGGGYIGLELGIAYRKLGAEVSVVEAQDRILPAYDAELTQPVHDALKQLGVKLYLKHSVLGFDGTLQVRDPNGDTLNLETDQVLVAVGRKPNTQGWNLEALNLDMNGSAIKIDSRCQTSMRNVYAIGDLSGEPMLAHRAMAQGEMVAELISGKTREFNPTAIAAVCFTDPELVVVGKTPDEAKAAGLDCIVSNFPFAANGRAMTLESKTGFVRVVARRDNHVIVGWQAVGVGVSELSTAFAQSLEMGARLEDIGGTIHAHPTLGEAVQEAALRALGHALHL

SEQ ID NO: 27604 - protein, 326 aa, Rhizobium leguminosarum
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAASRVISLDPNIRPGFIKDKPSHMARIKRMAAKSDIVKFSDEDLDWFGLQGDHDALAAHWLNHGAKLVVITKGAEGASGYTKDRKVTVPSERVTVVDTVGAGDTFDAGILASLKMDNLLTKRQVASLDEQALRNGPDPRRQSRRRHRLPRRRQSTLGARDWSLRLEQDSDPHPPDDTFSP

SEQ ID NO: 27605 - protein, 505 aa, Rhodospirillum rubrum
MDQDDQEKGTTMASQSASAPITPVILSGGSGSRLWPLSRALYPKQFLPLVSELTMIQETALRASGERFTAPLVICNDEHRFIVAEQLRAAACQPTAIILEPVGRNTAPAVAVAALKLLESASDPIMLVMPSDHVIQNADAFLAAIDQAAPAARAGALVTFGITPNAPETGYGYIKAGGSFAPFTGVLRVERFVEKPNLQTAESYLAEGSYLWNSGIFLFSAKAYLAELGRTNSKIIEACSQALAQGQRDLSFCRLDAAAFAASPADSIDYAVMEKTANAAVFPVEMGWSDLGAWSALWEIGPKDAQDNVALGDVLLQDVEGSYIRSDHRLVAVAGLCNVVVVATDDAVLVIDRGKVQDVKQIVERLKKANRDEHALHSTVHRPWGHYRGIDRGERFQVKRIVVQPGERLSLQMHHHRAEHWIVVTGTALVTRGAETFLLHENESTYIRAGQTHRLENPGKVPLHLIEVQSGGYLGEDDIVRFEDGYGRTLPQKEPPLISLENKTE

SEQ ID NO: 27606 - protein, 258 aa, Rhodospirillum rubrum
MAGGTIALQVKDIHKTFGRLEVLKGISLTARDGDVISILGSSGSGKSTFLRCINLLEAPDRGEISLRGQDLALRPDRGGGLTARDARQLAAFRARIGFVFQSFNLWPHLTILENVMEAPVHVKGLPKAQAREKAMALLAKVGIAEKRDHYPAHLSGGQQQRAAIARALAMEPEVILFDEPTSALDPELVAEVLGVIRALAEEGRTMLIVTHEMTFARDVSSEVVFLHQGHIEEQGPPAQMFSQPRSDRVRQFLTNHLH

SEQ ID NO: 27607 - protein, 449 aa, Rhodospirillum rubrum
MGATLSLAWPLILTNLAQAALTTTDLLLIGSLGSRSLAAAAMAAGLFQALMLFGLGLVSATLPLLATALGRNRHSVRDVRRTVRQGLWSAGLISLPLWLILWHTEAVLIAFGQEPALAAEAAGFMHTLQWGLLPFLGYIVLRAFLSALERPMWPLLVAGLAIGFNALAAWALIFGHLGLPALGLPGAGVSSSLSSLFMVAGLALVITRQRRLKRYRLFGRFWRPDWPRLVTLWRLGLPMAISFAFEVSIFQASMMMMGILGADALAAHTIALQIATLTFMVPLGLGQAATVRVGRALGAGTIPALRRAGWVAYGAGVAFMGGAALMMLSVPRLLIGAFLDADLAENAPVIDLAVVLMALAALFQIADGAQAVCNGMLRGLHDTKVPMLLAALGYWGLGLPLGALLAFPLGVGAPGVWIGLAGGLSVVAVLMTRRWIRLVAALERASVTA

SEQ ID NO: 27608 - protein, 365 aa, Rhodospirillum rubrum
MSSPFPHLFDPLALGDLHLPNRIVLAPLTRSRALPGEVAGALTARYYAQRASGGLLISEGTQISPSGRGYPRTPGIHSPEQIAGWKGVTEAVHAAGGRIFAQLWHVGRISHRSLQPGGVLPVAPSAIRPKTKIFTESGLVALETPRALDTAEMADIVASFRAAAENARAAGFDGVEIHAANGYLLDQFLRDGTNHRDDAYGGSIDNRLRLVLEVVEAVLGVWDKARVGLRLSPANPFNDILDSTPQATFEAVVSALDGFGLGYLHMVEGSLGSGEGAPEIDFAALRRLWQGVYMANGGYDGPRAEAALASGHAQLVSFGTAYLANPDLPERLRTNAPLNTPDSTTFYQGEDKGYVDYPTLADGAA

SEQ ID NO: 27609 - protein, 512 aa, Rhodospirillum rubrum
MGNPTSWVGLAGAGRRRRVLPTHPPADHAGRSRLFQARAVLAEAIAIAGAPFMAYQTINPFDGSVVQTFQEFSDSELASALDSAADCFAGWRQTSFAERAAIAHKAAGLLREQSGDYARLITLEMGKRIEEAEGEVALSADIIDYYADHAEAFLKPQPLKPESGEAVIESSPLGVLFGVQPWNFPYYQLARFAAPNLMAGNVVMVKHAGCVPQCAQAFEKLWRDAGAPAGAYTNLVISYDQVNAVIDDPRIKGVALTGSADAGKSVAARAGQNLKKSTMELGGSDAFIVLEDADLDKTVEWAVWGKMNNMGQCCVAAKRFLVVDSLADRFLEKFQAALAGLKAGDPMDRATTLAPLSTEGALTKLVEQVDKAVSDGATLVMGGKRLDRPGFFMEPTILTDIAPDTAAFREEFFGPVALFFRVKDEDEAVALANDSDFGLGGSVFTQDVARGKRVAERIETGMVFINQPTWTAPDLPFGGINISGYGRELSGLGIQEFVNKKLVRVALIDAAA

SEQ ID NO: 27610 - protein, 469 aa, Rhodospirillum rubrum
MAKNAPRFVCQACGAVYPRWMGRCEACGEWNSIAEEAPAEALPKGQTGGRGGQRLSFVSLEGVGAPPPRLLTGIPELDRVAGGGLVAGSALLIGGDPGIGKSTLLLQAVAGLARGGARSVYISGEEAIDQVRLRALRLGLEKAPVDLAAATSVRDIVATLDSGEPPDVVVIDSIQTMYLDTLDSAPGTVAQVRAGSHELIRLAKRRGFVLFLVGHVTKEGQMAGPRVMEHMVDAVIYFEGERGHPFRILRAVKNRFGATDEIGVFEMSDAGLSEVPNPSALFLAERRGNVTGSCVFAGMEGTRPMLVEIQALVGPSAPGSARRAVVGWDGGRLAMVMAVLETRCGLALGGNDVYLNVAGGLRIGEPAADLAVAAALVSSFSGVPVPPDMVVFGEIGLSGEIRAVAHGDTRLKEAAKLGFDQALMPARPRDSGKRGGPGVKEGLRMREIGHLQDLVALLAPPENAGQGQR

SEQ ID NO: 27611 - protein, 335 aa, Rhodospirillum rubrum
MMKAVRLHAFGGPEVLRYEDAPRPVAASGEVLVRVHAAGLNPPDWYLRDGYRALPAEWRPDPAFPLILGTDVSGVVEAVGDDGGDFSVGDEVYAMVRFPEKVMTGSNAYAQYIKVPVSDLALKPAGIDHCHAAGAPMSLLTAWQFLIDLGHDEPNPFQSVRHRPVPLEGKTVLVNGAGGGVGHLSVQLAKGKGARVIAVASGKNEALMGALGVYRFIDYTRAAADEVVHDVDLVLDTVGGPQMDRLLRPLKRGGALFLVNPLGFTAHKEAEKRGITVSSTQVRSNGRQLAEAAPLLDNGSVRVVVDSSYPLAEASRAHERAAAGGIQGKIILTMT

SEQ ID NO: 27612 - protein, 499 aa, Rhodospirillum rubrum
MTQAAPPIDWTARARALRLPNHALIDGAPASAGDGATFDCVSPIDGRVLTRVAACGAADVDRAVAAGRAAFEDRRWCGLSPAARKKILLAFAERIEAHRDELALLETLDMGKPIADSLAVDVPATARCLRWYAEALDKVYGEVAPTGDDVLATITREPLGVVGVVVPWNFPMIMAAWKIAPALAAGNSVVLKPAEQSPLTAIRLGELALEAGLPAGVLNVVPGLGPVTGRAIGLHPDIDGAFFTGSTAVGKLFLSYSSQSNMKRLGLECGGKSAHIVLASCKNTTAAAQAAASAIFFNQGEMCTAGSRLIVERAIADEVIEKVVAEAAFWRPGPPLDPATRMGALVDAEQTERVLGYIALGQDEGARLATGGSRAMAESGGCYVEPTIFTGVAPTMRIAREEIFGPVLSVITVESADEAVRVANDSDYGLAAAVWSDDVTTLHRVAKRLRAGMVYANCYDADDITVPFGGFKQSGIGRDKSLHAIDKYTELKTTWLRLG

SEQ ID NO: 27613 - protein, 313 aa, Rhodospirillum rubrum
MSDALLPVFSPASVLFDHGEGAWLVAANGERYLDFGAGIAVNALGYSHPHLVGALERQGRKLWHLSNVYRISEAERLAERLTAACFADVAFFANSGAEANECAIKIARRHHHAHGRPERWRIITFDGAFHGRTLATMAAGGNRKYLDGFGPPVDGFDQCPLEDIEAVRARVGPRTAALMIEPIQGESGIRPVSHGFLRQLRELCDERGLLLIFDEIQCGMARTGHLFAHQEAGVVPDIMSLAKGLGGGFPIGACLATRGAAFGMRPGAHGSTFGGNPLAGAVANAVLDIVMDDGVLAEIRRKSALLRGLPCRP

SEQ ID NO: 27614 - protein, 378 aa, Rhodospirillum rubrum
MTKRDFYEVLGVSKGASNDEIKKSYRTLAMRYHPDRNPNDAEAEANFREVNTAYEVLKDEQKRAAYDRFGHAAFEQAGAGRGAGDFGFGAGFADIFDEMFGEFMGGGRRGGSTAMRGADLRYNMEISLEEAFAGKKTTVHVPTSVSCESCRGSGSKGGAAPDGCPTCHGSGRVRAQQGFFTIERTCPTCHGQGKVIRDPCPDCAGSGRQRREKTLEVTIPAGVEEGTRIRLAGEGEAGLRGAPSGDLYIFLTIAPHRIFLRDGANIACKVPIPMTTAALGGTIEVPTIDGGRAAVTIPQGTQTGNQFRLRSKGMSVLRSASRGDMFVHAVVETPVNLTKRQEELLREFEEAGDKDTAHSPESSSFFKKVKEFWEDIAG

SEQ ID NO: 27615 - protein, 300 aa, Rhodospirillum rubrum
MIFPNASQSGSFLIGGDLPVNRLGFGAMRVTGPGVWGAGPQPVEALKTLKMLPEVGVTLIDTADSYGPGISEAMIAEALYPYEGANADLVIATKGGLVRPAPDVWIPLGRPEYLRQQAQVSRRTLKVEKIGLWQLHRIDPKVPRDEQFDAIKSLIDDGIIAHAGLSEVTIADIEEASDYFPVATVQNRYNMLDRASEPVLEYCEAKGIGFIPWSPLGAGGLFDAGSELAVLAKRWSITPGQIALAWLLKRSPVILPIPGTSKRAHLQENIAAAAIVLTDDDFSAFDQLARDYARKIAQTA

SEQ ID NO: 27616 - protein, 149 aa, Rhodospirillum rubrum
MQVSEIYEVEGGSPGGFGGGGYDRGGYSGGFDRGGYNGGFDRGAADRGGYAGATDRGGYAGGAADRGGYAGGADRGGFQGETEIDGVVKFFSADKGFGFVVPDGGGKDVYVGSRTLQDCGVSVLEQGQRVRMSIRMGKKGPMAGSLELI

SEQ ID NO: 27617 - protein, 346 aa, Rhodospirillum rubrum
MNWLTTYVRPKIRSLVGPREVPENLWRKCPACGHMIFHKELEKALQVCTHCGHHMRLPIKQRLELLFDDGAYTAIELPKPPLDPLRFKDIKRYSDRLKEAQAKTGEKDAIIVGHGKLMGQGVVVAAFNFDFMGGSMGMAVGEGLVAAAELALLQKVPLIAIPSSGGARMQEGILSLMQMARSTVAVDRVKEAGLPYIVLLTDPTTGGVTASFAMLGDIALAEPGAVIGFAGARVIETTIREKLPEGFQRSEYLLEHGMVDMVVPRSELKETLARLMALLMRRPPAAEVVTLSPDHRPAVVETPREAPKPKPRPPVEDLEAVARKVDDADFDGADAPPPPAPKPAKP

SEQ ID NO: 27618 - protein, 372 aa, Rhodospirillum rubrum
MIVSRAAIAWEAGKPLSVEEVEVAPPRQGEVLVRIIATGVCHTDAYTLSGSDPEGVFPAILGHEGGGIVEEIGPGVTSVAVGDHVIPLYTPECGTCKFCRSGKTNLCQAIRATQGQGLMPDGTSRFSIKGREIRHYMGTSTFSEYTVLPEIALAKVNKAAPLEKICLLGCGVTTGMGAVLNTAKVEPGATVAIFGLGGIGLSAIIGCVMAGAGRIIGVDINPDKFEIARQLGATDVINSRDYDRPIQEVLIDMTDGGVDYSFECIGNVGVMRSALECCHKGWGQSVIIGVAGAGQEISTRPFQLVTGRVWRGSAFGGVKGRSELPALVERYLAGDFELDTFITHTMGLADINHAFELMHEGKSIRSVIHYDL

SEQ ID NO: 27619 - protein, 283 aa, Rhodospirillum rubrum
MTEWFSETLHPHWRQSFAADRVLLREQTAHQDLVILENQTFGRVMVLDGMVQLTERDEFVYHEMIAHVPLFGHGAARRVLIIGGGDGGTLREVLRHKTVERATMVEIDATVVEMARDHMPMVSDGAFDDPRAELIIADGIAFVAGAHQPYDVIIIDSTDPFGPAEGLFTPAFYGACRQLLTPGGVLVVQAGVPFLQPREIAHVNAALSAAFPEVAFYAIAVPTYVGGLMTLGWASEDAGKKVPDPAVLAARVAASGLAFGYYSPEGHAGAFALPPHIRAAARG

SEQ ID NO: 27620 - protein, 195 aa, Rhodospirillum rubrum
MEQASKGSGGGDWLIRGVFSLGLALASFGGPASAQAAGAHDYSFPAIDGGTLPLAAWAGHPVLVVNTASECGFTAQYEGLEALWKAYRAKGLIVLGVPSNDFGGQEPGSAAEIKDFCESTFAVDFPLTDKTAVSGARAHPFYAWAKASRPDLSAPRWNFHKYLIAPDGSLAASFSALTDPKDRDLTDAIDKLLEK

SEQ ID NO: 27621 - protein, 239 aa, Rhodospirillum rubrum
MNGLKAEGQGLARDLAQRLNKAGGVDFDLLLCPPFPLISTVVGAVAGSGIAVGGQDCHAKAKGAHTGDVSAPMLADLGCQFVIVGHSERRADHGETDALVKAKAEAALAAGLIAVICVGETEAQRDAGETLAVVSGQLAGSLPTHADSGKVVIAYEPVWAIGTGRVPTTEDVAKVHGALRKDLVGALGADGNGVRLLYGGSVKPDNAAELMALENVDGALVGGASLKAEDFWAIAQSCA

SEQ ID NO: 27622 - protein, 385 aa, Rhodospirillum rubrum
MIEGLRSGLSFDDVLLVPGRTRARSRADITLASRFSRRIALALPLVSANVPWCTQAPMAIALGRLGGLGVLHRMCAIEDQERQVALVKAAPVDGEDAARATVDDGGALIAAAAVGAKPEDLERADRLVAAGCDALVVDIAHGHADYALDTIAALKSRHPQIDVIGGNVATAEGTADLIAAGADAIKVGIGPGGICTTRRVAGAGVPQMTAIADCVGVARARNVPVIADGGIRFSGDIVKALAVGAASVMLGSLLAGTDESAAVFIDHQGRRCKATTGFVTLGVGLTRKRLRGEKINAEDLDAYVAEGVESTFEASGPLARLIGQLAGGIRSGVSYGGALSIAELQDKARFIRVSEAGRAESRPHALDRAPAPPPDYARLFVEEEA

SEQ ID NO: 27623 - protein, 333 aa, Rhodospirillum rubrum
MSKDPYRILGVGKDATADDIRKAYRKLAKASHPDLHPGDPQAAATFRELAAAHDILGDSAKRARFDRGEIDASGAERAPERPSSAPGGPGSGASSRYYYRDYADAGATGGYGTTAGFEDFEDLSDLFSAGLGRGRKGPRPGRDLRFHLTLDFLDAANGLRKRVTLPDGPVLDLTIPPGTRDGEILRLKGKGAPGLNGGEAGDGLVEISVPPHPAFQRDGDDIVIEVPITLDEAVLGGKIEVPTISGKVAMTLPPGTTSGDVLRLRGKGIHPANRPAGDQRVILKIALPPAIDGALANFLSQWRKDHPYDPRAPLMAQTTPAAHTAHAGRSKTS

SEQ ID NO: 27624 - protein, 455 aa, Rhodospirillum rubrum
MVSNALRDADLSYTIHPYTNLVAHETKGPLIAVRGEGVRVFDDKGKDYIEGMAGLWCASLGFSEPRLAAAAARQMAELPFFHMFSHKSHEPGIRLSEELVKRAPVPMARAFFCNSGSEANDTAIKMIWYINNALGRPQKKKIIARKRAYHGVTVASASLTGLPANHRDFDLPIANILHTSSPDYYREGKPGESEEAFAKRCADELEAMILAEDPNTVAAFFAEPIMGAGGVVLPPKGYFEHIQAVLKKYDILLVADEVICGFGRTGQYWGSQTFGLKPDILTCAKALSSAYMPISAVLVTEEVYKPLRDNSGKIGTFGHGYTYSAHPVAAAVALETLAIYDERDILGNVAVSGARLQERLRSFADHPLVGNVRGIGLIGAIELVADKATHGAFPASDAVGPRVVTKAEEAGVILRAMAGDVVAFSPPLIITPEEVDQMMDRFTVALEAVTAEVLG

SEQ ID NO: 27625 - protein, 499 aa, Rhodospirillum rubrum
MLGVAEMAAADQAAAAAGRPGLVLMEAAGAAVVREIAARWSKRPVRVLCGPGNNGGDGYVIARLLAARGWPVRVMALEGAPPPGGDAAGMAHLWRGRVDPMTAEDLRPGDLVVDALFGAGLSRPLAGAAAEAVARINALGLTCVGVDVPSGVDGDSGRILGAAPFCALTVTFFHPKPGHLLVPARERIGELVIADIGLPETVLDAAPPRAFVNGPGLWTLPRPAVEGHKFARGHAVVIGGARMTGAARLAARACRRVGAGLLTIACAEEARLIYALDQPGAMVWGIGGEGPIARLLDDPRRNAFLLGPGYGRGAETAALALMLAKGGRALVLDADALTSLSGKLEEFSRTLCYDCVLTPHEGEFRALFAAALGAEAAPERGRLARARAAARASGAVVVLKGPDTVIAAADGRAAISVGAPADLATAGSGDVLAGLVLGLLAQGLPGFEAAAAAVWLHGAAGRAAGPGLIAEDLPEALPALLAALRSAPSPNRRPTDRTV

SEQ ID NO: 27626 - protein, 360 aa, Rhodospirillum rubrum
MLYQEHPPLSIPTLGFAAQSATTPLAPFSFERRDPRPDDVTIDILYCGVCHSDIHQARNEWHNSLFPMVPGHEIIGTVSAVGAKVSGFKVGDRVGVGCMVDSCRECAPCKADLEQYCEDGATLTYNGRDRHDHSLTFGGYSERIVVSEAFVLRLPDALDAKSAAPLLCAGITTYSPLRHWQVGPGSRVAVIGLGGLGHMGLKLAKAMGAEVSLFTRSPGKEDEAKRLGADHVVLSTDEARMKAVAGHFNLIIDTVPHPHDLNPYVSTLALDGTLVLVGLLGPIEPVIDSVPLVIGRRAVAGSAIGGIAETQEMLDFCAAKGVTADVEMLDINNINAAYDRMLKSDVRYRFVIDMATLRGA

SEQ ID NO: 27627 - protein, 220 aa, Rhodospirillum rubrum
MSKITPLEKAVARIPDGAVLMIGGFMGAGTPHRLMDELVRQGKRDLTVIANDTARPTVGIGKLIDAGLVSKVIASHIGTNPQTQKLMIAGTIEVALIPQGTLAEQIRAGGFGLGGVITPTGVGTLAAEGMQTIELAGKSYLIALPLRADFALINAKAADYRGNLRYAMTSRNFNPLMAMAAETVIAEAEDFVPIGAIEPDAVATPHVLVDVLIAKERSHG

SEQ ID NO: 27628 - protein, 219 aa, Rhodospirillum rubrum
MDDKTLIAKRVALELRPGDLANLGIGLPTLVASYLTPGVEVFFQSENGIVGMSPLPDIGFADDDLTDAGGSPIGVLPGACAFDSAFSFGLIRGGHLDVTVLGGLQIDERGLLANWMVPGKMVPGMGGAMDLVSGAKRVIVAMTHTAKGAPKIVKTCTLPLTSVRRVDLVVTELAVIEPTAKGLLLREVAPGVSVDQVIEATEANLLIAEDLREMPILAA

SEQ ID NO: 27629 - protein, 197 aa, Rhodospirillum rubrum
MIGGFMGVGSPHRLIDELVRQGKRDLTIIANDTARPNHAIGKLIDAGAVSRLIASHIGLNPETQRRMIAGEIDVTLVPQGTLAEQIRAGGTGLGGVLTPTGVGTLVQDGKQTVDVDGTVFLLEKPIKADFALIHAWRADHLGNLQYELTARNFNPSMAMAAATVIAEAQTIVPVGVIPPDQVETVSIIVDLIVAREA

SEQ ID NO: 27630 - protein, 246 aa, Rhodospirillum rubrum
MHKTIAEAEAYVGELTASPLLDRVEAFIVPPFTALAAVHRALGDAPVHLGAQTMHWQDEGAQTGEISPLMLRDCGVGIVELGHSERRASHGETDATVNAKVASALRHGLRPLICVGDQGDDLDAGASIETVLRQVKLAIKGIDTASLGRALIAYEPVWAIGEAGRPAEPAHVAEVHGALRAMLGQRGLAALPLLYGGSVDRANAGALTALANVDGLFVGRAAWTARGFEEVIEAALHGAKDRAGLA

SEQ ID NO: 27631 - protein, 318 aa, Rhodospirillum rubrum
MPNWKALQDSSFLEANARDRALGVVDEGTFTELAGPFDRRFSPHLEVLGEAVEFDDGIVTGVGRIGVTPVFVISQEGRFIGGSVGEVGGAKMVNTIRLAVEFHDQLVASVPDLTDAEKPIVVISFETGGVRLHEANAGLLAHAEVMDQIQKARGKVPVITLIGSKVGCFGGMGFVAAATDVIVMSEFGRLGLTGPEVIEQEMGKEEFDSSDRGLVFRTTGGKHKYIMGDCNYLVENTVAAFRAKVAELAVLPISAFEEMRRIGSAATVERQLRGVALAAEMQPKDARDVWAKAGNANAAALTDLPLADFLAQVKRLSV

SEQ ID NO: 27632 - protein, 450 aa, Rhodospirillum rubrum
MINEFEAWINEHGIAEVECLLSDMNGIVRGKVLPARKFLRSLEDNSLRIPSSVFLVTVTGEYPFADDNNTVVIDPDADLRPDFRTLCVAPGYRTPTAFVVVDAYKSNGIPLDLSPRQVLKRVLALYSEQGWKPVVAPEIEFYLTQVNADPDLPLSPPAGRSGRPETSPQPYGLEAITEFEDLIENIYEHAEIAGLQIDTLIHEAGAAQLEINFLHGDPITLSDQVVVFKRLVRQVALKHGVYATFMAKPMADQPGSAMHIHQSLVEIGTGKNLFVRDDGSDSPMFRHYIGGLQALLAQVTPLFAPNINSFRRMRPHHSAPINLECGYDNRSCGLRVPLSDPANRRLENRLPGADANPYLAMAASLACGYIGIMERIEPSIMVEGGNAYRRSRTLPRTLDEALDRLEKCTVIKNVLGEHFFEAFTMIKRVELDAFQDVISSWERNHLLLKV

SEQ ID NO: 27633 - protein, 466 aa, Rhodospirillum rubrum
MSDFDVVVIGGGPGGYVCAIRAAQLGLRVACVEKRPTLGGTCLNVGCIPSKALLQSSHLFDEANHGFAAHGITVGTLGLDMKTMMARKDEVVEANTKGIVFLFKKNKVTHVVGSARIAGAGQVVVSGEGGEQTLTTRAIVIATGSEVTPLPGVTIDEERIVSSTGALALAKVPKSLVVIGAGVIGLELGSVWRRLGAEVTVVEYLDHILPPMDGEVRKQSQRILEKQGLRFKLGRKVTAAERKGEGVSLTVEPAKGGEAETLEAETVLVAVGRRPFTDGLGLEEVGVEKTDRGFVKVDGDFQTAIEGIFAIGDVIGGMMLAHKAEDEGMALAEMLAGESAHVNYGAIPSVVYTWPEIAGVGKTEEMLKKDGVAYKVGKFPFTANARAKANGDTDGFVKILSNAETGRVLGCHIIGAQAGDLIMEVVLGMEFGASSEDIARTCHAHPQLGEAVKEAALAVNKRTIHM

SEQ ID NO: 27634 - protein, 381 aa, Rhodospirillum rubrum
MLFDHGEGAWLVAANGERYLDFGAGIAVNALGYSHPHLVGALERQGRKLWHLSNVYRISEAERLAERLTAACFADVAFFANSGAEANECAIKIARRHHDAHGRPERWRIITFDGAFHGRTLATMAAGGNRKYLDGFGPAVDGFDQCPLEDIEAVRARVGPRTAALMIEPIQGESGIRPVSHGFLRQLRELCDERGLLLIFDEIQCGMARTGHLFAHQEAGVVPDIMSLAKGLGGGFPIGACLATRGAAFGMRPGAHGSTFGGNPLAGAVANAVLDIVMDDGVLAEIRRKSALLRGLLEELAGRYPDLLVEVRGRGLMLGLKTTRPSPEIVEALRARAKVLTIAAGDTVTRVLPPLIVTDKDIRLFAERCDETFAGLSRPAA

SEQ ID NO: 27635 - protein, 327 aa, Rhodospirillum rubrum
MDSLPLGSSGLRCSALGLGCMGMSEFYGPSDDARSLATLEAAVEQGITLFDTADMYGAGHNETLLGGFLKGRRDKVVLATKFAIVRPTAAYARTIDNSPAYVRSACEASLRRLGIDTIDLYYVHRRNPQTPLEDTLGALAELKAEGKIRAVGLSEVSAQTLRAAHAILPIAAVQSEYSLWTRDAEAEVLAACAELGITFVAYSPLGRAALTGAITPTTLVEGDFRRAMPRFGAEAWAVNRPLVEALGDFASARGATPAQVALAWLLGRPQPLVPIFGTRSPERLRENIGAAALRLSADDRAILDALFPPGIAQGMRYTEEGMKNLDV

SEQ ID NO: 27636 - protein, 334 aa, Rhodospirillum rubrum
MTAPLPDQMRCVEIAGAGGPEVLKMAARPLPVPGDGEVLIAVAAAGVNRPDVFQRQGSYPPPPGASDLPGLEVAGTIVAIGAKAGEGWRIGDRVCALLSGGGYAQYASADAALCMPVPQTLGLDEAAALPETFFTVWHNLFQRARLQEGESLLVHGGSSGIGTTAIQMAKAFGVTVYVTAGTPEKCAACEALGADRAINYRTEDYPTVIKELTGGRGVDVVLDMVGGDYIDRDLRILAEDGRHVNIAFLQGSKVTVDLMRMMLKRLTLTGSTLRSRPATVKAGIARALEEKVWPLLEQGKLRPPIHARFALEDAAEAHRLMERSDHIGKIVLTL

SEQ ID NO: 27637 - protein, 506 aa, Rhodospirillum rubrum
MLYAAPGTADAIFAFKPRYDNFIDGTWQPPVRGEYFDNVTPITGKVFCKAARSTEEDITLALDAAHAAADRWGRTTAAERALILNRIADRLQDNLETLAYVESIDNGKPIRETLAADIPLAIDHFRYFAACIRAQEGSLSQIDETTIAYHFNEPLGVVGQIIPWNFPILMATWKLAPALAAGNCIVLKPAEQTPISILVLTELIADLLPPGVLNVVNGFGLEAGKPLASSKRIAKIAFTGETATGRLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 27638 - protein, 438 aa, Rhodospirillum rubrum
MTVDVAPPKAAQYHQDTLALHGGSYRADPTTGAVAVPIYQTTSYQVHDTAHAARLAGLEEIGFAYTRIGNPTQDAFEQRLAALEGGVAALALASGQAASAIAVLTLAQAGDNIVTSTDLYGGTWNLFANTLRTLGIEARFVDPADPEAFRRATDARTRLYYGETLPNPKLTVFPIAEVAAIGRSLGVPLIIDNTATPLIARPFDHGAAVVVYSTTKYIGGHGTTIGGAIIDGGTFPWADHAERHALLTGPEPSYHNASWTDLAAPFGPLAYILRARAGVLRDLGASIAPVSAFNLIQGLETLPLRLARHNANAIKVADYLASHPKVSSVTFPGLQSGEARRRADAYLKGGYGGLIGFELAGGEEAGRRFIEALRLFYHVFNIGDARSLAIHPATTTHSQLSPEDQRATGVTPGFVRLSIGIEHPDDIIGDIAQALDLV

SEQ ID NO: 27639 - protein, 228 aa, Rhodospirillum rubrum
MTRAIRIAPSLLSADFAFLGRDAQAMADGGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALRKRIDDAGLPVAIEVDGGVNPANARALGAAGADILVAGSAIFGASDRAKAIASIRGAAESGLGQEAA

SEQ ID NO: 27640 - protein, 413 aa, Rhodospirillum rubrum
MVVSNLSLPKDKIRVVLFENIHDSAVEYFHSRGYHNIERLTGALDGEALKDKIRDAHMVGIRSRTRLTRDVLESAEKLMAVGCFCIGTNQVDLDAAELLGIPVFNAPYSNTRSVAELVVAEAVMMMRDIPRRNWDTHEGGWNKAATGCHEVRGKTLGIVGYGHIGTQVSVLAESMGMSVRYFDIVEKLAIGNAQPCATLNELMAVADVVTLHVPDTADTRDMIRAPQIAAMKDGAYLINASRGKVVDIDALAEALTAGKLRGAAVDVFPKEPASLGDPFESPLRGMRNVLLTPHIGGSTEEAQMGIGREVAEKLVKYSDDGSTLGAVNFPEVALPQQASVTRFLHIHRNVPGVMSALNEVFSSHHINIRGQYLMTNPRVGYVVVDVEKDLKAGEGFRQALAAINGTLRFRFLN

SEQ ID NO: 27641 - protein, 478 aa, Rhodospirillum rubrum
MKRNRCAKILATLGPATSSESTLETLVRAGADMVRLNFSHGAHEEHRRRYDVVRAVENKLGRPIGILMDLQGPKLRVGDFVGGKVKLETGATFRLDMEKDLGTIQRVRLPHPEIFAAIGEGTDLLLDDGKLRLRVETFGADYAITRVITGGVLSDHKGLNVPNAVLPISALTEKDRRDLQFGLDLGVDWVGLSFVQRPEDVAEARKLIGGRAAIISKIEKPAALDHLTHIIELSDALMVARGDLGVEVPPERVPILQKRILAACHLAGKPVVVATQMLESMINAPTPTRAEASDVATAIYDGADAVMLSAETAVGQYPVEAVAMMDKIIQQVETDEHYQYLRNARRESPEGTAADAISAAASQVAETIKAAAIVTYTSSGSTTLRAARQRPGVPILCLTTNPRIARRMAMVWGVHSVLDKDISNFQEMVELAVKAAYREGFANIGERIVMTAGVPFGTPGTTNVLRIAWVEGDDSWAE

SEQ ID NO: 27642 - protein, 459 aa, Rhodospirillum rubrum
MTSPSKTPNLFAPLAEIDAERPALISEEGLLTHGALRRRVGAVQRWLADQPAERPLLLSATAASDLLPAFIAAGALGRTAAVGDRRWSEAVRARVVAALGQPLIGESLPAFPTGEAADDPPRFAPNPSRPFYVGFTSGTTGLPKAYARSHRSWIETMVAGRDGFALDAADRILVLGPLVHSLALYGALQALWLGGAAIVDGMGGWGVDQGATVVIGVPPLLAALARTGPHSAIRTVLSSGQALDPTTEAVLRRGFPKAVLVDFYGTSEQSFIAWRAVGEEATRGTVGRPFAGVEAEIRDAEGRPVAPGVQGRLHVKSPMVFDGYLEGLDRGGFSSKDGWSSVGDLGWLGEDGTLTLAGREGGMVVVRGVNVFPQEVEAALKALPGILDAGVVGLPDAGRGALLVALVEGEGVVDPAALGALRPEKRPRRIIGVSALPRTLTGKIDRRALAELAAGLIAR

SEQ ID NO: 27643 - protein, 297 aa, Rhodospirillum rubrum
MTASSLRSPQAPKNQAKPIEQLIPILDETASFLAALKGRTPVVFLDFDGTLAPIAERPEAVVFSAARREAVRKLAGKLPVAIVSGRDRADVEKQVGLPGLTYAGGHGFDIRLAPSGSASEVAPDDADPLAAELDGGLAGLVERLDAMEAALHAGLDGIAGALIERKRFSVAAHDRMVAPADRPAFAAALEAARRDLRGLREKAGKRLVEFLPDIDWDKGKAVLHLRRALGVDGEGYVAVFFGDDLTDEDAFRVLPEIDGIGVLVAGADEDGRGRTSHAFFRVADPDGVCRLLNDMVA

SEQ ID NO: 27644 - protein, 311 aa, Rhodospirillum rubrum
MGMSDLYGPSDRQESIATIHAALEAGVTVLDTGDFYGMGHNEMLIAEAIKGRPRDGFQVSVKFGALRGPAGDWLGYDGRPQAVKNFLAYTLRRLGLDHIDIYRPARLDPAVPIEETVGAIADLVTAGYVGHIGLSEVGTDTIARAAAVHPICDLQIEYSLISRGIEEAILPRCRELGIAITAYGVLSRGLISGHWQAGSTDPSDFRSRSPRFQQGNIEHNLALVEALAVIARRKSVSVAQIAIAWVAAQGEDIVPLVGARRRDRLSEALGALEVSLDAGDLAAIEAAVPKGAAAGERYNAPQMAHLDSERP

SEQ ID NO: 27645 - protein, 443 aa, Rhodospirillum rubrum
MKQILALNAFDMSDAPTLSDSAQRLLAKRKALFGAASVLFYDKPLELVRAEGCWLFDEAGERYLDVYNNVPSVGHCHPHVVAAVADQLAKINTHTRYLNEAIHRYAERLVATLPPSLSNITFTCTGSESNDLALRLASHYSGGRGVIVTETAYHGNTAAVTEVSPSSARDHALAPHVRVVRAPDSYRVAPEALAARFAGDVAAAIADLADHGITLSALLVDSIFSSDGVYADPAGFLAEAVAVVHRHGGLFIADEVQPGFGRTGSALWGFQRHGVTPDIVTMGKPMGNGLPMGGVATRPEILDAFCAEVGYFNTFGGSPAAGAAGSAVLDVIEGEGLMANAEAVGAYLRESLGALAKRFPVIGDVRGAGLFDAVELVSDPEAKTPSPELASAIINGLRQRHVLIGAAGPFGNILKVRPPLCFTRDQVDILGAALEEVLTEIAP

SEQ ID NO: 27646 - protein, 374 aa, Rhodospirillum rubrum
MNETSEALFLNSGYVYPNAEEAEAAFDGTLERYVYSRFRNPTISVFEERLAALEGAPVCKATASGMAAVTSALLCQVRAGDRVVAARDLFGSCSWVIGDLLAQYGVSAEFVDTENLDAWAQALAKPTRAVFLETPSNPTLRIVDLKGVCDLAHAAGATVVVDNAFATPLLQRPRDFGADVVVHSATKWIDGQGRCLGGAVLCDEAFNETYLGPFLRHTGPCLAPFNAWVMLKGLETLSLRINRHSATALTLAGLIEGHPAVARALYPGLASHPRHALAQSQMKAGGGVIALSLKGGRASAYRFLNALSIVDISNNLGDAKSLACHPWTTTHQRLSPEEKLIQGIDEGLIRFSVGLEDPEDLAADIGAALDAAGG

SEQ ID NO: 27647 - protein, 367 aa, Rhodospirillum rubrum
MATSQLFQPITLDGLTLPNRIIIAPMCQYSAKDGRTTGWHTIHLGQLALSGAGMLIIEATAVEPAGRISPADLGLWSDETEHALAETLAQVRAYSTMPIALQIAHAGRKASTAVPWEGGAQIAPDAGGWQTRAPSALPFDPSENPPVALTVADLTELREAFADTARRAARAGIDAIEIHAAHGYLLHEFLSPLSNRRSDAYGGSLENRLRFPLEVFDAVRAAFPAGKPVGVRVSATDWVEGGWSLEETIALAEALKARGCAFIHVSSGALSLDQKIPVGPGYQVPLARAIKAATGLPTIAVGLITEPEQAETILVSGDADMIGLARGILYDPRWPWHAAARLGQKIEAAPQYLRAAPHQAADLFKVV

SEQ ID NO: 27648 - protein, 495 aa, Rhodospirillum rubrum
MPEGTTRIAALDIVREAGLLKDKAYIDGAWVGADDGGDFPVLDPATGREIGRVPNMGAAETRRAIDAAAAAWPAWRARTAKDRAAVLRRWYGLIMDNQEALAVLMTAEQGKPLGEARGEIAYGASFVEWFAEEGKRLYGEVVPAHGTDKRILTLREPIGVVAAITPWNFPSAMITRKVAPALAAGCPVVLKPAEDTPLSALALVELAERAGLPKGLINVVTTHEAKAVGGEMTANPIVRKLSFTGSTEVGKILMAQCAGTVKKVSLELGGNAPFIVFDDADLEAAVAGAIASKYRNAGQTCVCANRLYVQEGIYEAFTEKLKAKVEAMRVGPALEGDVQQGPLINKKGLDKVDGLVRDALDKGATAVLGGKVHALGGTFYEPTILTGVTAAMRMATEEIFGPVAPLYRFSTEAEAIALANATRFGLAAYFYTRDIGRVWRVAEGLEYGIVGINEGIISTESAPFGGVKESGIGREGSRHGIDDFVEIKYLCMGGI

SEQ ID NO: 27649 - protein, 395 aa, Rhodospirillum rubrum
MAQATLALHAGTTDESDGAQVLNPLVPATSFFTKPEAVGFSANDMAEDTPFLYTRWNNPTNALLEERLAALEGGEAAVVFASGMAALSGLFLSQLKAGDHLVISSVCYAGLAEVAHDILPGLGIATTAVDTSNLEAVRAALRPETRLIHIETPGNPILRLSDIEALAAIAHAHGALLSVDSTMATPIATRPLALGADFVAHSLTKYACGHGDALGGAIIGKAQAMAALRKHALIHFGGAISPFAAWLILRGLETLSLRMAGHQAGAAAVAAYLEGHPRLRRVLWPGLPSHPQHALACRQMKNFSGMVSFSADDGPALARQLAERLQVISYAVSLGKTRSLLFYIPTEALIASSFHLDGDDARSYRDWTGDGTFRLSVGLEDPADLIADLERALAP

SEQ ID NO: 27650 - protein, 485 aa, Rhodospirillum rubrum
MARKMLQFTRLDQRTPDKRSAGTRRVDFDEIYGRFTPDAAGDQASRCEQCGIPFCQIHCPLQNNIPDWLMLTAAGRLEEAYALSSATNSMPEICGRICPQDRLCEGSCVLEQSRHGAVTIGAVEKFITDTAWERGWVKPILPLREREQSVGIIGGGPAGMAAAEQLRAQGYQVTLYDRYDRIGGLLVYGIPGFKLEKSVVERRVDLLARSGVIFKTNFEVGRDASLPELRKTHDAVLIATGVYKARGLSIPGAGLRGVTKALDYLIASNRTGLGDRVPAFEDGTLDAKDKAVVVIGGGDTAMDCLRTAIRQGARSVKCLYRRDRANMPGSQREVINAVEEGVDFVWLTAPEAVLGDERATGVRAHRMHLGVADATGRQSPQPIAGSEFTLEADLVIEALGFEPEDLPAVFGEPRLPITRWGTIQIDPVSKMSGLDGVFAAGDIVRGASLVVWAVRDGRDAAEGIRRYLVAKAAAAPAKAAPLVNA

SEQ ID NO: 27651 - protein, 266 aa, Ralstonia metallidurans CH34
VTILARSTLFFREDPAIGEAVTDAFRAEGIEVLDHTQASHVAYAGGEFVLTTGQGEVRADKLLVATGRAPNTRSLNLEAAGVEVNAQGAIVIDRAMRTSAPHIFAAGDCTDQPQFVYVAAAAGTRAAINMTGGDAALDLTAMPAVVFTDPQVATVGYSEAEAHHDGIETDSRLLTLDNVPRALANFDTRGFIKLVAEAGSGRLIGVQAVAPEAGELIQTAALAIRHRMTVQELADQLFPYLTMVEGLKLAAQTFNKDVKQLSCCAG

SEQ ID NO: 27652 - protein, 272 aa, Ralstonia metallidurans CH34
MDPTPLPPHPVRGQRRRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANARELLAMPDIDGGLLGGASLNVDEFMAVAITAQRLAQENT

SEQ ID NO: 27653 - protein, 110 aa, Ralstonia metallidurans CH34
MRHAVALMHASAIVCYTSSGHTSLRVARERPEAPVLSLTPHLRVARRMGLAWGIHSVHIEDVADVDQMTAKACAVACQEGFAQGGQTLVVIAGVPFGTPGTTNLMRIATV

SEQ ID NO: 27654 - protein, 196 aa, Ralstonia metallidurans CH34
MQRPEDVVEARKLIGERAAIVAKLEKPSAVEQLEAIAECADAVMVARGDLGVELPAERVPGIQKRILRTCRRLGRPVIVATQMLESMVTSPVPTRAEASDVATAIYDGADAVMLSAESAAGRYPVEAVDMMSRLITEVEGDPQYLQLMNASRPSAPAGAGAADAVCCARAPCRRADACERHRLLHELGPHQPACRP

SEQ ID NO: 27655 - protein, 248 aa, Ralstonia metallidurans CH34
MKARHTMRRNRNAKIVATLGPSSSDKDTIRRLFAAGVDVFRLNFSHGDEAAHRASFAILRELEREAGRPIGILADLQGPKLRVGTFAAGSVMLDESQPFRLELDTAPGDARRVGLPHPEIFAALAPGAELLLDDGKLRLIVERCGADFADTRVVAGGKLSDRKGVNVPGVLTTHQRTDRQGPARSGAGAGPRCGLDRPVVRAAARRRRRGAKADRRTRGHRCEAREAVGGRTTGSHRRMRRRRDGGAR

SEQ ID NO: 27656 - protein, 396 aa, Ralstonia metallidurans CH34
MNVLRFADLVAQGRVCGQRVFIRADLNVPQDDAGNITEDTRIRASVLCIRMALDAGAAVMVTSHLGRPTEGEFKPEDSLAPVAARLAALLGRPVPLKSNWVGGVDVQPGEVVLLENCRLNKGEKKNSEALARQMAALTDIFMHDAFGTAQRAEASTYGIAQFAPVACAGPLLAAEIDAIGKALAAPKRPLVAIVAGSKVSTKLTILQSLAKNVDGLIVGGGIANTFLLAQGLPIGKSLAEPDLVDEARAVIDAMKARGAEVPIPVDVVCAKAFKADAPATVKAVAEVDDDDLILDIGPQTATLLAHKLAAAGTIVWNGPVGVFEFDAFANGTKTIARAIAASDAFSIAGGGDTLAAIAKYGIDKDVGYISTGGGAFLEVLEGKTLPAFEILARRAQ

SEQ ID NO: 27657 - protein, 232 aa, Ralstonia metallidurans CH34
MTMHRIAPSILSADFACLGDEVRGVIAAGADWIHFDVMDNHYVPNLTIGPAVAKALKPHTRRADGSSAPLDVHLMVHPVDTLAAEFAQAGAGLISFHPDASVHVDRTLQLIRGAGCKAGLAFNPAAPLDVLDWTLDKIDLVLIMSVNPGFGGQSFIDSALRKIESARRLIDQSGRDIRLQVDGGIKVDNIRRAADAGTDTFVAGSAILGQSNYKAVIDAMRAELAAPMGKVA

SEQ ID NO: 27658 - protein, 291 aa, Ralstonia metallidurans CH34
MRVAFLGLGVMGYPMAGHLAAKGHDVTVYNRTAAKAERWVQAFGKHGGKQAATPALAAVDCDIVCACVGNDDDLRAVMTGPDGAFQHAAPGTIFVDHTTASASVARELHEAARERGCHFIDAPVSGGQAGAEQGILTIMCGGDPEAFQRAEPVIAAYARAVTRIGESGAGQLAKMVNQISVAGLLQALSEAIAFGEHAGLDMRVVLDVISKGAASSWQMENRGPTMLQSKFDFGFAVDWMRKDLGLCLDEARRNGATLPVTSLVDQFYADLQQMGSSRDDTSSLIKRLRRS

SEQ ID NO: 27659 - protein, 331 aa, Ralstonia metallidurans CH34
MKPSILVTRAIFPDVIERLAQYFDVDDNQEDLVLDSGALRERLAGKVGVLANAADRIDGELVGALPQLRAVCNMAVGYNNLDLPALTAAGIVATNTPDVLTETTADFGWALLMATARRVTEGEHYLRAGKWERWSYDMLVGMDVQGSTLGILGMGRIGQGLARRAAGFDMQVLYHNRSQLPDDVERSLNARYVSKAELLQQSDHLILVLPYSVESHHAIGAAEIAQMKPTATLINLARGGIVDDAALAAALRARKIFAAGLDVFEGEPSVHPDLLTVPNVVLTPHIASASEKTRRAMANLAADNLIAALDVGPQAGKPPTVVNPEVMARRR

SEQ ID NO: 27660 - protein, 507 aa, Ralstonia metallidurans CH34
MTRQAGAGHPRPASFQKNQAPPTKEAARMTRSTKIVATIGPASSTLEVLTRMIGAGVDVVRLNFSHGTAQDHIDRAALVREAAAACGREVAIMADLQGPKIRVGKFENGKITLKPGDAFILDSACQMGNQERVGLDYKDLPRDVGPGDLLLLNDGLIVLVVDRVLGNEIFTTVRIGGELSNNKGINRQGGGLSAPALTAKDMEDIKTAMALGADYVAVSFPKNATDMEMARQLTNVAGQPHNHKARMIAKIERAEAIRPGVLEEILLASDGIMVARGDLAVEVGNAAVPALQKRMIKLAREANKLTITATQMMESMIVNPVPTRAEVSDVANAVLDGTDAVMTSAETAAGRYPVETVEAMAAICLEAEKSEVVQLDTDFLNQTFARIDQSIAMGALFTAYHLGVKAIAALTDSGATALWMSRHRIHVPIYAMTPNLASQRKMQLYRNVVPLPLQSSADRDVALEQAEELLLSQGVVQRGDFIVLTIGEPMGQPGGTNTLKIVRVGTR

SEQ ID NO: 27661 - protein, 378 aa, Ralstonia metallidurans CH34
MFIRADLNVPQDDAGNITEDTRIRASVPAIQACLEAGATVMVTSHLGRPTEGEFKPEDSLAPIATRLSELLGKPVKLVQNWVDGVEVAPGQIVLLENCRVNKGEKKNSDELAQKMAKLCDVYVNDAFGTAHRAEATTHGIAKFAPIACAGPLLAAEIDALGRALGQPARPLVAIVAGSKVSTKLTILKALADKVDNLIVGGGIANTFMLAAGLKIGKSLAEADLVGDAKTIIDIMAARGASVPIPVDVVCAKEFSATAAATVKDVKDVTDDDMILDIGPKTAAMLADQLKAAGTIVWNGPVGVFEFDQFGNGTKVLAEAIATSKAFSIAGGGDTLAAIAKYGIADRVGYISTGGGAFLEFLEGKKLPAFEVLEQRAAG

SEQ ID NO: 27662 - protein, 411 aa, Ralstonia metallidurans CH34
MKLFTPLTLPNGAVIPNRLAKAAMEENMADADHAPSDALLRLYEAWAAGGAGLMLTGNVMVDHRAMTGPNGVVLENDAHLDRFRQWARIARAHGAHVWMQINHPGRQMPAALGQTTLAPSAVPLELGALSKQFPVPREMTAADIDDVRELFVRSAQLAEQSGFTGVQIHAAHGYLLSQFLSPLANRRQDQWGGPIENRARLLLDIVRAVRQAVSPAFVVSVKLNSADFQRGGFSPDDAKRVVELLNPLGVDLVELSGGSYEAPAMQGQARDGRTLEREAYFLAFARDIAAIAQMPLMVTGGIRRRAVADQVVDSGIAMVGIATALSIDPNLPRDWLAGKNNAPALRPITWKNKVLGSLANMAVVKFQLKRLSQGRGTHPRVSPLRALLMQQMANACQTRRYKRWMMGRELG

SEQ ID NO: 27663 - protein, 233 aa, Ralstonia metallidurans CH34
MSSPTFRIAPSILSADFARLGEEVRRVTEAGADWIHFDVMDNHYVPNLTVGPLVCEAIRPHVTAPIDVHLMVRPVDRIIPDFARAGANIITFHPEASDHIDRSLALIRDNGCQAGLVFNPATPLHYLDHVMDRLDVILLMSVNPGFGGQSFIPETLNKLRAVRQRIDAYTARTGRRILLEVDGGVKVDNIAEIAAAGADTFVAGSAVFGKPDADGGYKGVIGALRAELATVGK

SEQ ID NO: 27664 - protein, 500 aa, Ralstonia metallidurans CH34
MAADLWFESLHRTGTEVLDRGNRLAGGLRRLGLEEGAVVAVMLRNDPVFADVVFACRTAGVYYCPINWHFTPEEARFLLEDSSARVLIIEADLFPSMREVIPAGMTVLTVNGSDADATITIAYEPWLATQSPYDGPRVAPRGHLAYTSGTTGRPKGVLRSAVPLGELEDQTARMRSVVAKAIGIVPGCRALMSAPLYHSAPGVFIQNALQMAERLVLTPRFDAEQVLALVEKHRIDVLYLVPIMYVRLLKLPPEVRARYDLSSIRFVASTGSPCAPEVKRAMLDWFGPVIHETYASSEAGMVTVATPEDAAERPGTAGRPVDAASVRIIDESGRPCAPGEVGLVYVRQPAYPDFTYLNNDAARRTIDVDGRVTLGDMGYLDADGYLFICDRASDMVISGGVNIYPAEIEHELVRYPGVADCVVFGVPDDEYGERLHGVIQPMAGTTLDPVAVIDWMRGRLSGFKVPRTIEIVAQLPRDETGKLAKRRLRDQHWAGRQRRV

SEQ ID NO: 27665 - protein, 137 aa, Ralstonia metallidurans CH34
MIMAKKWLNKVKWDDNGLVPVIVQEVGSNDVLMFAFMNRDALQRTVELGEAVFWSRSRKRLWHKGEESGHVQKVHEIRLDCDEDVVLLKVTQIDSIACHTGRHSCFFQKFEGDVESGDWQTVEPVLKDPSSIYAAKP

SEQ ID NO: 27666 - protein, 441 aa, Ralstonia metallidurans CH34
MTHVFHRNPKQTLPVAVGGQGIELIDSNGRRYLDASGGAAVSCLGHGHPRVIEAIKAQVDTIAYAHTSFFTTEVSETLAQTLADAAPGDLDHVYFVSGGSEAVEAALKLARQYFVEIGQTQRRHFIARRQSYHGNTLGALAIGGNAWRREPFLPLLVPAHHVSPCYAYRDQAAGEADTQYAQRLADELEAKILELGPDSVAGFVAETVVGATAGAVPPVADYLKRIRAVCDKYGVLLILDEVMSGMGRTGYLFACEEDGVVPDIVTIAKGLGAGYQPIGAMLSTSRIYDAIIGGSGFFQHGHTYIGHATACAAALAVQRTIVEDKLLDNVLARGEQLRARLRESLGDHPNLGDVRGRGLFVGVEFVADRATKATLDPAKKTHAVLKRTCMEHGVLVYPMGGTVDGIHGDHVLFAPPFICTPTDIDNIVDRFTQAVKTVLPA

SEQ ID NO: 27667 - protein, 367 aa, Ralstonia metallidurans CH34
MSIQVRNVHKRFGDFVALNDVSLDFAEGELTALLGPSGCGKTTLLRIIAGLERADAGQVVLAGQDASTQHVRQRNVGFVFQHYALFKHMTVFENVAFGLRVKPRGERPSEAKIREKVKSLLELVQLDWLADRFPAQLSGGQRQRIALARALAVEPRVLLLDEPFGALDAKVRKELRRWLRRLHDDLHVTSVFVTHDQEEALEVADQVVLMNRGSVEQFGTPEAVYNHPATPFVFGFLGNVNLFHGRLEVGDSGGLLHTGEAVLPVVGSGHETEGDAVAYVRPHDLDLERYAPGTDGIAVTLRRALTLGPVAQLELEREDNQDVIEVALPLERFRHHGFKEGELLAVRPRQLRVFNQGRTTQEQGAAR

SEQ ID NO: 27668 - protein, 166 aa, Ralstonia metallidurans CH34
MKPVTTDICDANEDRLADGSLRVLTPGFLHFGKRMAFSGPAVTLKVFEDNSMVRATLETPGAGRVLVVDGGGSMRCALVGGMLGVLAEKNGWAGIIVNGCVRDSEELKVCDVGIRALGVHPQKSQKRNVGQEDVTVQMPGAVVRPGNWIYADADGVLVSDEKLDGA

SEQ ID NO: 27669 - protein, 410 aa, Ralstonia metallidurans CH34
MLGFNRPAAATVNPRLDLLQTYPFEKLRALVADVKPAAVPPISFGIGEPKHPTPAFIKEAMTASLGGLANYPSTAGSDALRACIAGWLERRYNLPKVDAATEVLPVTGSREALFAFAQTVIDSSKPNPLVLCPNPFYQIYEGAALLAGARPVFANSDPARNFAPAFDQIGADVWPHVQLLYVCSPGNPTGAVLSLEDWKQLFELSDRYGFVIASDECYSEIYFDEAKPPLGALEAAHKLGRGLERLVMFSSLSKRSNVPGLRSGFVAGDPEILKKFLLYRTYHGAAMNPAVQAASAAAWGDEAHVRENRAAYVRKFAEVTPMLAGVLDVALPDAAFYLWADVSRTGLSDTEFAVRLLAEQNLTVLPGSYLARDAHGVNPGANRVRMALVATPDECLEGARRIVEFCKSLG

SEQ ID NO: 27670 - protein, 493 aa, Ralstonia metallidurans CH34
MNKTLLASAIALAFGIGGQALANPTNNNEKTGTTNTQNATATSTQSGAGASANENSTALQANGNSSSSTTNKTKNTTNTNTNSKNHTDQDMHGYGNAAAANGSTATANFTNSFNSSKALAISKLEGYVTGNYIHNIGNVATNNGTANGGAGGKGGAGYGGDGKGGSGGSGGASGAGGGGGSGGSAINGSAKAGYASNGSATAGDGAAGGKAVGWAGDGGNAKSNGGGALTASLGVGGFGGSGKGSGGAAGAGALGGFGGDGGNAKGSGGGALGASGGLGGDSAAGSALGKVHGNAGNSSATSGAGGNGTGGTASGTGGAGSGTGGAGGAGGAATAAAAGGAGTGSGGAGGANTSTAGAATGGAATSTGGAGGAQNSVAGNGGAGGAATNGSASSMASNGSATAGNGAVGASSGAGGAGGVGMGGTGGTGNGAVGGAGGNGGTNYVDAGTFNMSNMMSSVGQSAAGIMMANQNSGMSSLVQQSVNVQANLAVGK

SEQ ID NO: 27671 - protein, 453 aa, Ralstonia metallidurans CH34
MSTSDQRPRPGSESTLAQPSTGVLERLFKLGEHKTDARTEILAGVTTFLTMAYIIFVNPSILGDAGVPKDAVFVATCLAAAIGTLIMGFYANYPIAMAPGMGLNAYFAYTVVKGMGLPWEAALGAVFISGCLFLLVTLFRVREMIVNGIPHALRVAITAGIGLFLAIVALKNAGIITASPATLVTIGDLHQTSAILAVIGFFAIVALDHLKVKGAILIGILGTTILSFVFGGNTFHGVFSAPPSIAPTLFKLDISAALSIGIVNVVLVFFLVELFDATGTLMGVANRAGLLKAGRMDRLNKALMADSTAIMAGSLLGTSSTTAYIESASGVQAGGRTGLTAVTVAVLFLACLFIAPLAGTVPAYATAPALLYVSCLMLRELVDVDWSDATEVVPAVLTALGMPFTYSVANGVAFGFIAYAGLKLLTGRAREVPVMAWVIAAVFLFKFYYLPGH

SEQ ID NO: 27672 - protein, 444 aa, Ralstonia metallidurans CH34
MGKIPEGDARDAENAIAAARAAFEAWSATPPSVRADYIRKIAEGLKARCEELAQMIAGEVGMPIKLARAIQVGGPVYNWGQAAALLDQFAFEEQVGNSLVVREPVGVVAAITPWNYPLNQITLKVAPALAAGCTVVLKPSEVAPLNAFVLAEVIEAAGLPPGVFNLVTGYGPVVGEVLASHPEVDMVSFTGSTRAGKRVSELAAQSVKRVALELGGKSASVILDDADLPTAVKGTIGACYLNSGQTCSAHTRMLVPRSRYEEVKAIAAKVVEGFTVGDPLADTTKLGPLISAVQKERVTGYIRRGLDEGAELVAGGPDTPAGLDRGFFVKPTVLGNVDPKATVAQEEIFGPVLSVICYDTEDEAIRIANDSIYGLGGGVWSGDESRAIRVARRIRTGQVDINGGPFNMNAPFGGFKQSGNGREGGKFGLEEFLEYKSLQLKKPA

SEQ ID NO: 27673 - protein, 384 aa, Ralstonia metallidurans CH34
MYITNRPELVFTEGKGSWLTDHNGKRYLDFVQGWAVNALGHSNEGMIQALEKQARKLLNPSPAFYNEPMLKLAQQLTDNSCFDKVFFANSGAEANEGAIKLARKWGRKHKNGAYEIITMDHSFHGRTLATMSASGKAGWDTIFAPQVPGFPKAELNDLASVEKLITDKTVGIMLEPVQGEGGVIPATREFMQGLRALADKHKLLFIVDEVQTGCGRCGTLFAYELSGVEPDIMTLGKGIGGGVPLSALLCKADVASFEAGDQGGTYNGNPLMTAVGSSVMEQLTAPGFLDDVKAKGEYLREQLLVLTKEFGLGGERGEGLLRALVLGKDIGPQLVEEAREMSPVGLLLNAPRPNLLRFMPALNVTREEIDQMIGMLRELLKKLA

SEQ ID NO: 27674 - protein, 246 aa, Ralstonia metallidurans CH34
MSTEADAWIQHELMVAPMAATHGAPRSALVVGGGDGGSAFELLRIPTMREVVVAELDGEVVRLAREWLRGIHQGALDEPGDPRLSLAIGEGLGLMEAFARAGRQFDLIVYDLTEADDGSPAAALFSPHGLHTARRCLAPGGAMSLHLGPPLHRPETARRLLARLRHVFRHVAPLTTFVPAYGALWGIALASDALDIAAQPADKIATRLQQWQLEHKLRAYHAYLHPALFVHPRHVQAIFDSGSRPA

SEQ ID NO: 27675 - protein, 407 aa, Ralstonia metallidurans CH34
MAVPIYQTAAYAFDNAQHGADLFDLKVPGNIYTRIMNPTTDVLEKRIAALEGGVGALAVASGQAAVTAAIQTITEAGDNIVASSALYGGTYNLLAHTMPQFGVTTRFADHRCPESFEALIDDRTKAVFVESIGNPAGNVTDIAKIAAIAKRHGVPVIVDNTVATPYLLRPFEHGADIVVHSLTKYLGGHGTSIGGAIVDSGKFPWAKYPSRFPKLNTPDASYHGVTYTEAFGPAAYIGRARVVPLRNMGAALSPFNAFLILQGIETLGLRMDRINDNTLAVARHLSQHAKVGWVNYAGLEDNQDYALAKKYMNGKASGLLTFGVKAADGDGRAAGARFLDALQLFTRLVNIGDVRSLATHPASTTHRQLSPEELAQTGVGLDTVRLCVGIEHIDDLLADIDQALQAV

SEQ ID NO: 27676 - protein, 240 aa, Ralstonia metallidurans CH34
MRAGPFHTGTQVINKLYDSVESAMADIHDGATILIGGFGLAGMPAELIDALIAQGARDLTIVNNNAGNGDTGLAALLKAKRVRKIICSFPRQADSYVFDSLFHAGEIELELVPQGNLAERIRAAGAGIGGFFTRTAYGTPLAEGKETRIIDGQGYVFEKPIHADFALIKAETADRWGNLVYRKTARNFGPIMAMAAKCPIVQVSNVVELGELDPEHIITPGLFVKRVVKVASAAKPASAA

SEQ ID NO: 27677 - protein, 497 aa, Ralstonia metallidurans CH34
MLDRWLTESPDQPFIHLPDGRSLTFADLGALTTAAEAELLALGVLPGDRVLVVAENCPEHAALILACSRVGAWSCGVNARMAPAEIDAFAAKADARVIYFTAAASRAASAHARRFDAVPSALNGMEHSHVRANAMPEGQPLQDQVAALIFTSGTTGEPKGVMLTHDALIHFARVTCEARALSPVDRSYAFVPMTHIFGLGTVLLSSLLAGAQLVMRPQFDPADLLDALAHCGVSQLQGPPTLYSRLLAHLQHEGITTPTAPALRYLYTGAGPLDLSLKQRVEATFGLTLHHGYGLSEYAGSVHVTRLGDRRADTSAGYAVAEAEVQVTDPVTGTPLPLGERGELWLRGRGLMPGYFRDPDATAKAMREGGWYASGDLGEMHADGALFVVGRLKEMIIRSGFNVYPAEVETALNTHPSIQRSAVVGCRESDGNEEIIAFVELRPGATLDVAALQNHLRERLAPYKRPARIVALPELPTNNNGKILKRELQEQAASLLS

SEQ ID NO: 27678 - protein, 359 aa, Ralstonia metallidurans CH34
MSALFTPVRVGRYTLKNHLVMAPMTRSRASLDGTPGELAAEYYAQRASVGLIVTEGTQPSDDGQGYLATPGIYTEAHVDGWKNVTAAVHERGGRIFIQLMHAGRMSHPDNTPHHRQGVAPSAIAPGVPMFTLKGMQDIPAPRALTTAEVRQTVDDFRFAARQAIAAGADGVEIHGANGYLVQQFFAPNANTRTDKYGGSIDNRARFAIEVATAIAGEIGADRTAIRLSPGTPLWGIDEGAEGPALYRHLVTELDKLGLAYLHVSLQGNEPQLADIRERWRGTLILNRPGRTREAVGADVASGLADLEAYGQMVLANPDFVTRLKLGAPMNDALPNAFFGGDGRGYIDYPALALTDTVTS

SEQ ID NO: 27679 - protein, 474 aa, Ralstonia metallidurans CH34
MSKQFDVLVIGAGPGGYIAAIRAAQLGLNVACLEGNAYDDPKGEARLGGTCLNVGCIPSKALLASSEEFENASHHLADHGITVGDVKVDVAKMLKRKDDIVSKMTKGIEFLFRKNKVTLFKGYGKFTGKAAEGFQVEVNGETLTAKQVIIATGSKARHLPGVAVDNNLISDNEGALKFGTVPKKLGVIGAGVIGLELGSVWRRLGAEVTVLEALPAFLGAADEGVAKEAQKLLTKQGLQFHLSVKVDEVKTGKDNVTVNYTDKDGKAQTLEVDRLIVSVGRVPNTDNLGLDAVGLGVDQRGFIEVDDHCQTKVPGIWAIGDVVRGPMLAHKAEDEGVAVAERIVGQKPHIDFNTVPWVIYTFPEIAWVGKTEQQLKAEGREYKSGQFPFMANGRALGMGASDGFVKMLADARTDEILGVHIVAANASDLIAEAVVAMEFKAASEDIGRVCHPHPSMSEVMREAALAVDKRQLNM

SEQ ID NO: 27680 - protein, 463 aa, Ralstonia metallidurans CH34
MTPATPPIAVVGGQPVPDGHAGATSRNGAKVPFEAGIRLAGVGKFQYRLFVIFGLVWLADAMQVLSIGFSAPSIAKTFGITMPQALQTGTLFFVGMLVGAIVFGRLADRIGRRPVLMIAIVIDALSGIASAFAPELSWLLVLRFLTGVGVGGTLPVDYTMMAEFLPSDRRGRWLVLLESFWAIGTICLAVLALVALSHGDQAWRVIFLVTGIPALIGVVLRFYIPESPMYLNRSGRSDEARKVLQRVAKTNGRNVEIPALQSDIVAPKSVLTLFSGTFRRRSFALFAAWALISIAYYGVFVYLPIKLGAEGFAFMRGQVFLVVLAIVQLPGFALSAYGVERWGRKPTLIGFLLLSAVGCMLYSLGTSPTVVVGSTLLMSFALLGTWGALYAFTPEVYPTDLRATGMGAAGAVARFGGLFAPAIIAPVMATHFTLALALISSMLLAGAFAIGMVNVESKDRALD

SEQ ID NO: 27681 - protein, 459 aa, Ralstonia metallidurans CH34
MAQRFDAIIIGTGQAGPALAARLAGAGMKLAVIERGRFGGTCVNTGCIPTKALIASAYAAQLARRAAEYGVTIGGPVAVDMRQVKARKDEISGRSSQGVEQWMRGLDNVTVHQGHARFEHARGVRVNGELLEADQIFINVGGRALIPPMPGLDQVSYLTNSSMMEVDFLPEHLIIVGGSYIGLEFGQMYRRFGARVTIVEKGPRLIQREDEDVSQAVREILEREGIEVRLDANCLSARKDGDHIAVGLDCAGGAPEVHGSHLLMAVGRVPNTDDLGLDKAGIETDARGYIKVDDQLRTSVPGIWALGDCNGRGAFTHTSYNDYEIVAANLLDNDPRAVTDRIPAYALFTDPPLGRIGMTEREARQSGRKVLVGTRPMSRVGRAVEKGESQGFMKILVDADTRLLLGAAILGLNGDEVVHSLLDVMYAGAPYTTISRAVHIHPTVSELVPTVLQGLRALT

SEQ ID NO: 27682 - protein, 460 aa, Ralstonia metallidurans CH34
MKNLQRNLSARHIRFLALGSAIGTGLFYGSASAIQLAGPAVILAYIVGGAAVYMVMRALGEMAVREPVTGSFGRYASEYLGPLAGFLTGWTYILEMIIVCLADVTAFGIYMGFWFPEVPQWIWVLGIVMLICGLNLCNVKVFGELEFWLALVKILAIAAMIIGGTLILFLGVKMNGEHSPGLTNLWAHGGFLPHGAGGLIASLAVVMFAYGGIEIIGITGGEAQNPEKVIPRAINAVPARILLFYVLTMTVLMAIFPWTGIGSQGSPFVQIFSGLGIKSAAAVLNLIVISAAISAINSNIFGAGRMMYGMAEQGQAPRLFATTSRHGVPWVTVLAMAAALLGGVVLNYLIPEQVFVIIASIATFATVWVWLMILLSQVAMRRRLSAEEVRALKFKVPLWPVGPALAIAFMLFVIGVLGYVEDTRVALYVGAGWVVLLSLAWFLRAKPKADALLARETSVS

SEQ ID NO: 27683 - protein, 503 aa, Ralstonia metallidurans CH34
MTAAYTASQTIAGDCTVSLPSALYRNYVDGRFEEAANLFPNLSPVDGSIVGHVCEADASQVDRAVQAARAAMEGPWGNTSAAERARVLHAVADGIERRFDEFVAAEVADTGRTEQQARALDIRRGVLNFRTFADLASQAGGDYFDMRTAEGDVFSYTVRKPHGVVGIISPWNLPMLLMTWKVAPALACGNAVVVKPSEETPGSATLLAEVMHEAGVPAGVFNLVHGFGGGSAGEFLSRHPGIDALTFTGESRTGSTIMKAVADGVKEISFELGGKNAAVVFADCDFDKAVAGVMRSSFTNTGQVCLCSERVYVERPIFERFVAAMKARAEALRIGYPTVEGVEMGSLISRNHRDKVLSYYALAREEGATVVTGGGVPHFGDARDNGAYVQPTIWTGLPDSARCIQEEIFGPVCHIAPFDTDAEVVKRVNDSRYGLAASVWTRDLARAHRVTRQFDVGIVWVNTWFLRDLRTPFGGTRLSGIGREGGRHSLDFYSSLTTICVNP

SEQ ID NO: 27684 - protein, 373 aa, Ralstonia metallidurans CH34
MMTSTSNPLFQPYSLGPLSLPNRIVMPPMTRSRASQPGDVPNALMAEYYAQRASAGLIVSEGTWISPLGRGYAWTPGIHTPEQVAGWRKVTTAVHQAGGRIFAQLWHVGRLSHISLLDGHAPVSSSAIQAQGVNVFVAQSDGKPGFAQASQPRALSVEEIHAIVDDFRQAARNAMAAGFDGVELHAANGYLVNQFIDSGANDRTDEYGGSLENRLRFLGEVAQALIEGTGGKDRVGIRLAPLTTLNGCVDADPETTYTAAARLLGEIGVGYIHIAEADWEDAPHMPTAFKQQLRKVYPGTLIYAGKYTAARAQAALHEGWADLIAFGRPFVANPDLPERLRTGATLNAHDRDTLFGGDARGLTDYPPLVAKAA

SEQ ID NO: 27685 - protein, 510 aa, Ralstonia metallidurans CH34
MLPIELFWRAADRWPDNVAIDAPGGSLRYRELAGQVAALATHFMTLDPAPQSRVGICAGNSAEHIVALLAVLASGKIWVPLNPKSTQPELRRIIDATTPSIVVLDAASEALLGDAPGTRLYTDYADHASGGADVLSAVVLRYPDATRPVLDLHRDATQAIKFTGGTTGAPKGVMQPYRAWMTNIVNQIHAWGFTEADRYVMAAPITHGTSTYVMPILAQGGCHVIMEGSGAEAVRATFRDRAGTVCFMPPTLIYMLMALPGTSRADYPALRRLIYGGAPMPPQKIQQAREFFGSVVATTYGQTEAPQLLTVIGPDDLADERRMASVGRATWFSEVAIMSPDGRLLPRGEVGEVVARGDLVMTGYWNRPDLTAATIVDGWLHTGDRGMLDAQGFLYLKDRLREVVITGGFNVYPIDVENALGQHPAVHECAVFGVPDDKWGEAVHAAVQLREGCAVQATELIAFVRERLGPVQTPKQIHFHTSLPRSTVGKVLKNTVRDQALTALQTGDQA

SEQ ID NO: 27686 - protein, 477 aa, Ralstonia metallidurans CH34
MERLFQAQRSAFAAAPYPALADRKQGLRRLRDAVRKHADSLAQAADRDFGGRAHAETMMVDVLPSVLHINHLLGGLRRWMRPSRRSVELLFLGNSAKVVYQPKGVVGIVVPWNFPVYLALGPLATALAAGNRCLIKTSEFAPRTSAALRALLAEAFTEDEVAIVEGDADVARQFTGLPFDHLVFTGSPEVGRHVMRAAAEHLTPVTLELGGKSPAIVSSSANLATAARRIAHGKTVNAGQICVAPDYALVPEALAARFATEVLNASAALFPADRDDYASIIHDRAHQRMNDLLDDARAHGAQVMRSAMPEDGRRVPLHVVLGVTPRMRIAREEIFGPILPVFTYRAFEDVVTHIRGGTRPLAMYYFGDDKAESTTLLQRTHAGGVTLNDWGWHVLNHDLPFGGTGTSGMGNYHGAEGFRELSHAKAVFSERKWFPIELFHPPYGTFIQRLTLRMFLGRPTAAPPVQTEASPVTASQD

SEQ ID NO: 27687 - protein, 352 aa, Ralstonia metallidurans CH34
MIYTSGTTGHPKGVKRDPATPEQAKAYVDIIERVYGLTPGVRALITGPLYHASPNAYGRQAITAADVLVLQSKFDPEETLAAIEKYRITNAVMVPTMFIRILKLPKEVRERYDVSSLKWVTHTGAPCPREVKQELMEWWGPVVYETYGGTEVGTATLATPDDWLNHPGSVGVPTPGTQIAFFGEDGKPVEDGTPGEIYMRVPAYADFTYLNHEEKRKSVERDGLISVGDVGYLKEGRLYLCDRRSDMVISGGTNIYPAEIEMVLTQCPGVHDCAVFGIPDEDFGESLAAAVELMPGAELSASDIQKYLESHLAKYKVPRRIDFHASLPREDSGKIFKRRLRDPFWQAVGRKI

SEQ ID NO: 27688 - protein, 122 aa, Ralstonia metallidurans CH34
MRDEDGYYFLVDRLKRMINVGGYKVWPAEVESLLHSHPAIQEACVIAVTDERRGERVRALVVVRNGASLTEEELTEWSRSNMAAYKCPREIIFTDRLLRSPTGKIDWRRMQERANMPEERAS

SEQ ID NO: 27689 - protein, 248 aa, Ralstonia metallidurans CH34
MYKLVLIRHGESTWNLENRFTGWVDVDLTDTGAAQAKQAGTLLKEAGFAFDVAYTSVLKRAIRTLWHVQDEMDLMWIPVRNEWRLNERHYGALAGLNKAETAKKYGDEQVLVWRRSYDTPPPALEPTDERASFGDPRYANVPRAEIPLTECLKDTVARVMPLWNESIAPDIKSGKRVVIAAHGNSIRALVKYLDQISDDDIVGLNIPNGTPLVYELDADLRPLRHYYLGDQEAIAASLAAVASQGKAR

SEQ ID NO: 27690 - protein, 454 aa, Ralstonia metallidurans CH34
MRAASRHDQTPPWDVRADRLRRLRRLVQANHDAIAAAISADFTNRPHQETALLEVFPSVAGIDDALRHGKRWMRVRRASTGLWFKPGRSRLMPQPLGVVGIVVPWNYPLYLTIGPLTGALAAGNRAMVKLSEYTPRFSALFAQLVQAAFAPDEVAVINGDAEVAAAFSTLPFDHLLFTGSTNVGHHVMRAAAANLTPVTLELGGKSPAIIGPHADFERAVERILVGKLLNAGQTCIAPDYVLVQADQRDRFAEAARRCASRLYPDIARNPDYTSIISPRHFDRLVSMIAAATAAGAHAVPLTDATPDAAARRLPPVLLTDVPDNVMAMQEEIFGPVLPVVTYRSIEDAIGFVNARPRPLALYVFDKSGDVVDRVMRQTVAGGVTVNDTLFHIAQDDLPFGGVGPSGMGVYHGKAGFETFSKLKPIFHQAGLNGAGLLKPPYGKRFESMLKLLLR

SEQ ID NO: 27691 - protein, 468 aa, Ralstonia metallidurans CH34
MTHPVLDSGGGDTSLAARSQRAVWHPCTRLRPDASANEPPLAIVRGEGPWLIDAGDKRYFDAISSWWVNLFGHANPAINAAIGEQLQTLEHVMLAGCTHAPAVELAERLTALTGGALGNAFYASDGASAVEIALKMSFHYWRNTGLTAKREFICLRHGYHGETVGALAVTDVEIFRDAYDPLTRRAHVVMSPDARQAARSESAADVATRALAELEALLRERAGQIAALIVEPLVQGAAGMAMYDPSYLEGARALCDRYRVHLIADEIAVGCGRTGTFFAWEQARGGDAVPAHAWPDFLCLSKGITGGYLPLSLVLSRPEIQRAFVADDIARSFLHSHSYTGNPLACRAALATLDLFESEDVLARNRERAQWLGTAMAGIAADPRVSHVRQRGMIWAADIDPQAAGANFAGRFHLAARERGVLARPIGHTLYVMPPYVFDAELANWLGEQLLDTLQAVLDPAEEARHAA

SEQ ID NO: 27692 - protein, 279 aa, Ralstonia metallidurans CH34
MSPTIERGTPRETIIEVRNLEKRFGDNVVHKDLNLEVYRGEVLSIVGGSGSGKTVLLRQIVGLDRPTSGTIRVFGENPAELSADQLQALRSRWGLQFQRGALFSALSVIDNVALPLREMRALPDDLICRASLLKLQLVGLSAKDADKMPSDLSGGMIKRVGLARALALEPELVFLDEPTAGLDPMASDDYVALIRELRRELGLTVVMITHDLDTLVALSDRVAVLADHRVLAAAPIPEVIKVDHPFIREYFLGERAQRALQALPAPKGPGAPDAHPGEV

SEQ ID NO: 27693 - protein, 234 aa, Ralstonia metallidurans CH34
MHGSLAANAALLEGIKAAPARAKLAVCAPFPYLAQCQTLLSGSQVAWGAQDVSSEARGAFTGEVAASMLGEFGCGYALVGHSERRTYHGETDAVVAAKALRALEFDIVPVVCVGETLAEREAGQTEAVVGRQLQAVLDALSIEQLGRIVLAYEPVWAIGTGKTATSAQAQEVHAALRARVTAKDAGVAARMAILYGGSVKPDNAAELFSMSDIDGGLIGGASLKADDFLAIGNA

SEQ ID NO: 27694 - protein, 300 aa, Ralstonia metallidurans CH34
MAYKTIEDTIGNTPLVRLQRIPGTAIEARGNVILGKLEGNNPAGSVKDRPAVSMIRHAEARGRIKPGDTLIEATSGNTGIALAMAAAIRGYRMVLIMPEDLSLERRQSMAAYGAEIILTPVKGGMEYARDLADAMERDGKGVILDQFANPDNPLAHYETTGPEIWKDTDGRVTHFVSAMGTTGTITGVSRYLKEKNPLIQIIGAQPAEGSRIPGIRKWPEAYLPKIYDPKFIDRQEPVTQADAEHMARRMAREEGIFAGISAAGALCVALRIAEEVENATIVFVVCDRGDRYLSTGVFPA

SEQ ID NO: 27695 - protein, 387 aa, Ralstonia metallidurans CH34
MTEQDKSPAADAPAQEAGRQDAPGPSAQEQALSADLAPLRTQIDTVDRELLALLNRRAQLALDVGEVKKKYGAPVFRPERELQVIRKVQGANPGPLLDESVASIWREVMSACRGLEKPLEIAFLGPAGTFSEQALYAHFGHEVTGVPCPSIDEVFRAVEAGTVEYGVVPVENSTEGAVSRTLDLFLQTSLKISGEIALKVHHNLMASTPDMKGVTVVRAHAQALAQCQNWLSANYPHLERQAVSSNAEAARMASEDPTVAAIAGETAANRYHLHIIRSHIQDDPHNRTRFAVIGRYETEPSGSDQTSLILSVPNKAGAVYQLLAPLAENGVSMCRFESRPARSGAWEYYFYVDVEGHQHEPAVTRAIEMLRRNAAYLKVLGSYPSSK

SEQ ID NO: 27696 - protein, 430 aa, Ralstonia metallidurans CH34
MSRNQQLFDRAQQTIPGGVNSPVRAFRSVGGTPRFITRAEGAYMWDADGQRYIDYIGSWGPMIVGHAHPDVVRAVQETATQSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVTQLEEAFARHKGEIAAVIVEPVAGNMNLVRASEAFLTAMRNLCSEHGSVLIFDEVMTGFRVALGGAQAHYGIKPDMTCLGKVIGGGMPAAAFGGRRDIMAKLAPLGGVYQAGTLSGNPLAVAAGLTTLRLIQAPGFYDRLATQTRKLADGLTKAAREAGVPFCADAIGGMFGIYFTNEVPGSFAEVTKADVGRFNRFFHAMLAEGVYLAPSAFEAGFVSAKHDDAIIEATVAAAAKAFKAG

SEQ ID NO: 27697 - protein, 365 aa, Ralstonia metallidurans CH34
MKAAVMEKAGAPLVIHDVAIAEPGPREVRVRTAAVGLCHSDLHMMQGTYPLPLPAVLGHEVSGVVEAVGTQVSGLKAGDHVVGCLSVYCGHCSVCASGHQVLCQNPEVKLPPGKANRLRLAGNPLSQVFNLSGFAEEILVHENALVKIRDDMPLDRAALLGCAVITGTGAVFHSAKVPPGSTVVVVGCGGVGLSVINGAVIAGASRVIAVDMLPAKLELARKFGATDVVNAGDGDPVAQVMQLTGGGAEFAFECIGLKQTAEQCYAMLAPGGTATVIGLFRPDARIELPALDFLKEKRIQGSFMGSNRLSLDIPRLVELYMQGKLLLDDLISQRISLEDINEGFIAMQSGSVARSVITFPGVGGL

SEQ ID NO: 27698 - protein, 302 aa, Ralstonia metallidurans CH34
MKPVTLIGAPTDVGASIRGASMGPEALRVADIAGALVRNGLDVTDLGNLVGPGNPNLPPTDGVRHLPEVVAWNRLVMDATYQALATGQLPLLMGGDHCLAIGSVNAAARYCREQGKKLLVLWLDAHADANTGSTSPTGNTHGMPVACLCGDGPAPLVSLGGVTPATSPRNIRQIGIRSVDAEEKKRLRELGLTVYDMRYIDENGMRATMEQALAGIDGDTHLHVSFDVDFLDSQIAPGVGTAVRGGPTYREAHLALEMIEDTGALGSIDVVELNPARDVHNQTAELVVELLESLFGKSTLLR

SEQ ID NO: 27699 - protein, 488 aa, Ralstonia metallidurans CH34
MRRQRKAKIVATLGPASTDIAVIRQLFDAGADVFRLNFSHGTHEDHRARYDAVRQVEAETGRPIAILADLQGPKLRIGTFAAGKVAVSAGDTFVLDSDPTPGDAKRVYLPHPELFKAANAGQSLLIDDGKVRLNIESVASGSITTRVANNGTLSDRKGVNVPDAVIPIPALTEKDRKDLAFALELGADWIALSFVQRPSDILEARELIGTRAGVLSKIEKPAALQQLEEIVRVSDAVMVARGDLGVELPPERVPGVQKRILRICRQLGKPIVIATQMLESMIDSPVPTRAEASDVASAIYDGADAVMLSAESANGRHPVAAVSIMNRIITEVENDPLYRNMIDAQHEAPLSTRQDAICAALREVTQIIGAKATVTYTSSGATALRAARERPCAPIVSITPNLEIARRLAITWGVHSTVSPDVQSVDEMVEAAARAALVEGYAAPGDQITIAAGMPFGQGGTTNLLRVAEVGTEVAGLDIGKVPAAEAV

SEQ ID NO: 27700 - protein, 503 aa, Ralstonia metallidurans CH34
MRDRTLVLSVLIVASCGLGYELIAGALSSYLLGDSILQFSSIIGCYLFAMGVGSWLSRYVKDEDVLTRFIDIEILVGLLGGISAALLFVVFAWLSAPFRTALYALVFVIGMLVGMEIPLVMRILNARRAQFSDLVSRVLTFDYLGALAVSLVFPLVLAPRLGLSRTGFLFGMLNVAVALFTLRIFRDEVSRTTLRTLRAGMVLAVLTVGFAGSNYLTHWAERGLFGDEIIHSETTPYQRLVITRWKDDLRLYINGNLQFSSRDEHRYHEALVHPVLQALPWARRVLVIGGGDGLALREILKYRNIEHVTLVDLDPAMTTLFSRSEPLRALNHGSLTDQRVTVVNADAAQWLEQNQDSFDAIIVDLPDPSNFGLGKLYSVPMYRLMSRHLAEKGYAVVQSTSPYYAPRSFWDIDATLREAGLHTWPYHTYVPSFGEWGYILVGKRNDYTPPTRYDVPMKFLDGDTTALMFRFPADMAPRQGEPNRLNEQTLVHDFERDWRNVIR

SEQ ID NO: 27701 - protein, 1320 aa, Ralstonia metallidurans CH34
MATTTLGVKLDDASRERLKRVAQSIDRTPHWLIKQAIFTYLEQVERGHLPHEAGAGATADTDGADAGDATQADAAPQPFLEFAQSVQPQSVLRAAITSAYRRPETECVPVLLEQARLPQAQADAAIKMARALAARLREQKVGSGREGLVQGLIQEFSLSSQEGVALMCLAEALLRIPDKATRDALIRDKISGANWQSHLGQSPSLFVNAATWGLLLTGRLVATHTEAGLSKALTRIIGKGGEPLIRKGVDMAMRLMGEQFVTGETISEALANARKYEEEGFRYSYDMLGEAAMTEADAQRYLASYEQAIHAIGQASRGRGIYEGPGISIKLSALHPRYSRAQHERVITELYGRLKSLTMLARQYDIGINIDAEEADRLEISLDLLERLCFEPELAGWNGIGFVVQGYQKRCPFVIDYLIDLARRSRHRLMIRLVKGAYWDSEIKRAQVDGLEGYPVYTRKVYTDVSYVACARKLLSVPDAIYPQFATHNAHTLAAIYQIAGQNYYPGQYEFQCLHGMGEPLYDQVVGPVADGKFNRPCRIYAPVGTHETLLAYLVRRLLENGANTSFVNRIADETIALDDLVADPVAVVETMHKTEGVLGLPHPRIPQPRALYGKSRANSAGIDLSNEHRLASLSSALLAGTSETPRAEPLLGAAVAGTDATSEPVLNPADRRDVVGQVSEATPAETEAALVAAVNVAPIWQATPPEVRAAALERAADLMEAQMQSLMGIIMREAGKTFSNAIAEVREAVDFLRYYAVQVRASFSNDTHRPLGPVVCISPWNFPLAIFTGQVAAALAAGNPVLAKPAEQTPLIAAAAVRLLRDAGVPAAAVQLLPGRGETVGAALVGDARVKGVMFTGSTEVARLLQRNVASRLDAAGRPIPLIAETGGQNAMIVDSSALAEQVVGDVVTSAFDSAGQRCSALRVLCLQEDVADRILEMLKGAMGELTLGNPDRLSTDVGPVIDEEARGNILRHIEAMRAKGRRVHQADPGAADTPACRHGTFVPPTLIELDSIAELKREVFGPVLHVVRFPRTALDKLIDQINGTGYGLTLGVHTRIDETIAHIVDRADVGNLYVNRNVVGAVVGVQPFGGEGLSGTGPKAGGPLYLHRLLSVCPQDAVARAVRASDATGGVAAAPVSPELAALKAWAQASLPEVAEACDRLAAASPSGLGVTLPGPTGERNTYSLLPRERVLCLAQQESDLVLQLAAVLAVGSEALCVDTAQTRALSERLPAAVQSRVRMVSDWTSTDTAFDAVLHHGDSDQLRTVCEQVATRTGPIVGVQGLAHGEPNIALERLLIERSLSVNTAAAGGNASLMTIG

SEQ ID NO: 27702 - protein, 460 aa, Ralstonia metallidurans CH34
MPRRKRSVRPTTREADFVVIGAGSGGVAAARRAASHGARVILVERDAIGGTCVNRGCVPKKMLSYGANWASILSTCLSHTGGKEDWRDASVRVNAEVARLNASYAQRLNEAGVEILHGDARLSGADEVVVGNEIIRTRKTLIATGAHPLALPVPGGELASSSDDVFTWQTVPASIAVIGGGYIAVEMASILSRYGVKVDLLVRGDRLLPKFDHDIAAALAEALAAKGVRLHFRADVTMLSQANGATEVCYTQQNNPGRTQTVRAQAVLAAIGRRPSIAELGLDALGVQLGERGGICVDRQFRTTVRSIHAIGDCMDRNLHLTPVAIAQGRWLADRLFGKRGDIADFDFVPTAVFSEPAIGAVGLTEAQAIEAAGGRADRVRTEIKRFVSLENRFGGVAQPSVFKLVFNARSGRVLGAHLMDNAAPEIIQTFAVALRLGVKDAHLKTTMPLHPTVAEELFG

SEQ ID NO: 27703 - protein, 413 aa, Ralstonia metallidurans CH34
MTPPVSSHAKPRLVVVGNGMAGMRTVEELLKLAPDLYDITVFGAEPHGNYNRILLSPVLAGEKTVDDIMLNTRAWYGQHGIELLAGDPVVAIDRPRRLVRSASGKEVRYDRLLLATGSKPFIIPVPGHTLDGVIAFRDIQDVETMLHAARNHRHAVVIGGGLLGLEAANGLMRQGMDVTVVHLADSLMERQLDKPAAELLKAALERKGLRFLLSAQTAAVLGSERVTGVLFKDGTQIPADLVVMTAGVRPNIELAASAGLRCERAIVVDDTLQTFDPRIYAVGECVQHRQATFGLVAPIWDQARVCAAHLAGAGHRRYVQQATATKLKVTGVDLYSAGDFIGGDNSEDLVLRDPRRGVYKRLVLQGGRLVGAVLYGDVQDGPWYFDLIQTGQPVAALRQRLLFGKAQCEALAA

SEQ ID NO: 27704 - protein, 374 aa, Ralstonia metallidurans CH34
MALMPHLFDPYRIGNLELANRIAIAPMCQYSAQEGNATDWHMIHLGQMALSGAGLLIIEATAVSPEGRITPTDLGLYNDANEAALGRVLGAVRNHSPIAVTIQLAHAGRKASSEAPWDGGGQIRPDQPRGWQTFAPSAVPHAAGEVPPAALDKAGMKKIRDDFVAAAKRAARLGIEGIEVHGAHGYLLHQFLSPIANHRTDEYGGSLENRMRFPLEVFDAVREAFPAERPVWMRVSATDWVPNGWDIEGTIALSHELKARGSAAVHVSTGGVSPQQAIKIGPGYQVPYAQRVKAEVGLPTMAVGLITEAEQAEAIIANNEADIISIARAMLYDPRWPWHAAAKLGASVNAPKQYWRSQPRGLEKLFKDAHFGQR

SEQ ID NO: 27705 - protein, 291 aa, Ralstonia metallidurans CH34
MTKTTTARSSAVQPAAEQGEPYVVQHMVVSGDREIKVCVCYPAGYWPLSAGSATLPWLVYLHAGGFVEGDVEAAKELARDLAESVPAVVVTPGYSLAPENPFPAAPEDAVATVTWVLKQAKKLKVDKLRFALVGEEAGGNLAIATAQMLRDRGLPQPAGQWLIRPVTDPCLSAMSSTRQVPMEMLRRLACNYREYLPTPADSVHPYAAPALASRMAGLPATLVQVAEQDALRAEGEAFAAKLAKAGISARALIMPGACGDGVEQSHEKCQAWVEEGARFLRDCFAKADDAS

SEQ ID NO: 27706 - protein, 510 aa, Ralstonia metallidurans CH34
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 27707 - protein, 460 aa, Ralstonia metallidurans CH34
MIEQPYPSVADTDAAPPTAQGKIDQYFQISARGSTQRREVVAGITTFMAMVYAVFVVPGMLGKAGFDTSAVFVAVCLTTAFGSLLMGLWAKLPIAIGCAISLTAFMAFGLVLGQHLSPAVALGAVFLMGVVFTAISVTGVRTWILRNLPAGVAHGAGIGIGLFLLLIASNEVGLVIKNPGPGLPVSLGNITAFPVMMSILGLAAIFGLERRRVPGGILLVIVAISALGLVFDPSVKFTGIFALPTLSAPGHTSLIGAMDIRGALSAAVLPSVLALVMTAVFDATGTIRAVAGQANQLDATGRIHNGGRALTADSVSSIFSAFFGGAPAAAYIESTVGVAAGARTGLAAVTVGALFLAVMFFSPLAGLVPSYATAPALMYVGLLMLSSVSRLHMDDLVDALSGLVCAVFIVLTCNIVTGIMLGFCTLVIGRIVSGEWRKLNIGTVAIAVALAAFYAGGWAI

SEQ ID NO: 27708 - protein, 412 aa, Ralstonia metallidurans CH34
MGYVAPALVQDWGIEKSSLGPVMSAALFGLAFGAIFAGPMADRVGRKKVLVLSVFFFGACSLATAFAPTIRWLTVLRFLTGLGLGAAMPNAVTLMSEYAPARRRAVLVNTMFCGFPLGSAAGGFFAAAIIPQFGWHSVLVFGGVVPLVLAVVLVTTLPESVRYMVVRQYPADQIRQVLARVTGARVDGAGVFTISEAAPASSSAIGTVLAPRYRLGSTMLWLTYFMGLVIFYLLTSWMPTLMKDAGFSLQRASFLTALFPLGGGIGTIAAGWFMDRFNPNKVIAMTYALTGVLIYAVGQVASGDQVVLGVLIFLAGTAMNGAQSSMPSLAAAFYPTQGRATGVAWMLGIGRFGGITGALLGAELLRLHLGFDVIFTLLAIPAFAATAALVAKHVGARGAAPVDTGGAMVSGH

SEQ ID NO: 27709 - protein, 211 aa, Ralstonia metallidurans CH34
MVERASKFQAAILADVVGRRGTLNARVQGLSSTMKVCGPALTIEVRPGDNLMFHVGLAIAKPGDVIVVDGKGDQTAALCGEIMATQAQASGVAGFVIDAAVRDSHELAHGQFPVFSAGTNPCGPTKAIGGLVNWPASVAGVAVNPGDLIVGDADGVVVIPREEVPVILELAQKKVDAEAKRIAAIKAGDLRPGWLDKELRAAGVLAEGESL

SEQ ID NO: 27710 - protein, 333 aa, Ralstonia metallidurans CH34
MVAIEITQPGGPDVLAPVQRPVPVPAADEVLIRIHAAGVNGPDVMQRRGLYDPPPGASDIPGLEVAGEIVSVGRDVIRFAVGDLVCALVPGGGYAEYAVAHESNTLTIPEGLSMVEAAALPETFLTVWLNLFQRGKFSAGESVLIHGGASGIGTTATMLAKAFGASKIITTVGSDTQRDASIALGADVAVDYRNEDFVEAVARATDGRGVDVVVDIIAGDYVARNYAAAAMDGRIVQIGVIKGPAQSLDLFPMLAKRLTHIGSTLRSRTHEEKAVLIEDLEQSVFPHIRRGAVKPVMYKTFDLGDARRAHELMDSGTHIGKIVLTTQAAHSAP

SEQ ID NO: 27711 - protein, 339 aa, Ralstonia metallidurans CH34
MMKAAVVRAFGAPLTIDEVPVPQPGPGQIQVKIEASGVCHTDLHAAQGDWPVKPSLPFIPGHEGVGFVSAVGANVKRVKEGDRVGVPWLYSACGYCEHCLQGWETLCEKQQNTGYSVNGGYGEFVVADPNYVGLLPKNVDFIEIAPILCAGVTVYKGLKVTDTRPGQWVVISGIGGLGHVAVQYARAMGLRVAAVDIDDAKLAFARKLGAEVAINARTTDPAAFLQKEIGGAHGVLVTAVSPQAFSQAIGMVRRGGTISLNGLPPGDFPTPIFDVVLKAITIRGSIVGTRSDLQEALEFAASGVVKATVSTEKLDSINSIFDRMKAGQIEGRIVLDFSR

SEQ ID NO: 27712 - protein, 433 aa, Ralstonia metallidurans CH34
MSGTRFDTLALHAGAAPDPTTGARATPIHLTTSFVFRDSEHAASLFNMERAGHVYSRISNPTVAVFEERVAALENGAGAIATASGQAALHLAVATLMGAGSHIVASTALYGGSHNLLHYTLRRFGIETTFVNPRDIDAWRAAIRPETKLLFGETLGNPGLDVLDIATVAQIGQEHGIPLLVDSTFTTPYLLRPFDHGAGLLYHSATKFLGGHGTTIGGVLSEGGTFDFQASGRFPELSEPYEGFHNMVFTEESTVAPFLLRARREGLRDFGACMNPMAAWQLLQGIETLPLRMSRHVDNTRRVVQFLASHPMVESVAYPELESHPDYELAKRLLPRGCGAVFSFNLKADRTAGQRFIESLSLFSHLANVGDARSLVIHPASTTHFRMDAAALRAAGIGEGTIRLSIGLEDPDDLIDDLKRGLKAAEKAMGGKA

SEQ ID NO: 27713 - protein, 232 aa, Ralstonia metallidurans CH34
MNKVYASAAEALAGVVRDGQTIAVGGFGLCGIPEALIAALRDSGAKQLTCISNNAGVDGFGLGLLLATRQIRKMISSYVGENKEFERQYLAGELELEFTPQGTLAEKLRAGGSGIPAFFTKTGVGTIVADGKEIREFDGQQYVMERSLTADVALVKAKKADKAGNLVFRRTARNFNPVCAMAGKITVVEVEEIVETGEIDPDDVHLPGIFVHRIVLNTNPEKRIEQRTVRAK

SEQ ID NO: 27714 - protein, 303 aa, Ralstonia metallidurans CH34
MSKIGFIGLGVMGKPMALHLQTGGHAVHAHTRSGVPQALLDAGVKSCASAADVARQADVIFLMLPDTPDVARVLFGEQGVAEGLSPGKIVVDMSSISPIETREFAARIEKLGCDYVDAPVSGGEVGAKAATLSIMAGGKQDVFDKVLPLLQLMGKNITLVGNAGDGQVAKVANQVIVALTIEAVSEALVLAAKAGADPARVRQALMGGFASSRILEVHGERMIKRTFEPGFRIELHQKDLNLALSTAKALGLGLPNTASCQQLFNVCVAQGGAGWDHSGLVKAIEHMSSFAIGDKPTNAPTKG

SEQ ID NO: 27715 - protein, 321 aa, Ralstonia metallidurans CH34
MPAQPLDSQVAQLLDLIARAKRPAIHTMDPVDAKIAYEKSAPILDLSPAPVHGVEDFQVTARDGHAIPVRLYSPREASWADPLPLLVYFHGGGFTVGSVNSHDSLCRMFCNGAECLVLSVDYRLGPEWKFPVAANDAFDVLHWVFEEAARIGADATRIALGGDSAGGTLAAACAVEARDHGLAPVLQMLIYPGTCARQDTPSHRALAEGYLLTAEMIQWFFSQYLDVDASRDDWRFAPLDGGGEGADVRGCCPAWIAVAGYDPLHDEGVAYAAKLEAAGVVASLTDYPSMIHDFFKLGRFIGAVAGAHADATAALRRAFGI

SEQ ID NO: 27716 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNELNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 27717 - protein, 256 aa, Burkholderia fungorum LB400
MNVIQQKAPLIELVDVHKAFNGTDVLKGVSMTIRKGETACIIGPSGSGKSTLLRCLNGLIPIDAGTIRVGSFAVETLKRDRDLVPLRHQVSMVFQQYNLFPHRTVLQNIMMAPLQVLRQPHDEVKQRALDLLARVRLTGKEDAYPAQLSGGQQQRVAIARALAMQPAIILFDEVTAALDPEMVSEVLAVIRDLSRDGMTCVLVTHEMRFAEEIADVVFFTDRGTIVESGPPAEMFHTPRDPRLASFLGKVLSRTAA

SEQ ID NO: 27718 - protein, 420 aa, Burkholderia fungorum LB400
MRRLADLISRDWERLAEIEIRDNGKVISEVGPQIRYLAQYFHYYAGLADKIEGAVIPVDRPGMLNYTRHEPVGVVVAITPWNSPLMLASWKIAPALAAGCTVILKPSEHTSVSSLVFSDLFDEAGFPPGVVNVVTGFGAEIGNALVSHPDVAKVAFTGGDVAGQAVYERAAAGLKRVTLELGGKSPHIVFDDADLDGALAAAMDGVFSSSGQMCVAGSRLMLHDRIHDEFVARLLDRVRTLKLGAPMNPATSIGPVTTQAQFERILSYIDVAKQEGARCLVGGVASPEAEGGSGWFVAPTVFGDVKNDMRIAREEVFGPVLSIIRFSTDDEAVHLANDSRYGLASGIWTRDVGRAISVADRIQAGTVWVNTYRAVSAASPFGGMKRSGIGRENGQEAIMGFLQTKSIWISTTSRPVAAWS

SEQ ID NO: 27719 - protein, 254 aa, Burkholderia fungorum LB400
MESLAGLENVDVVELNLADPDSVDNFATSYLRTHNSCDILVNNAGIMATPLTRDSRGYELQFATNHLGHFQLTVQLWDALAVAGSARVVALSSLGHRFSAINFDDLNYLTRPYDPWRAYGQSKTANALFAVHLDRLGKGAGIRGFAVHPGRIPTTNLSRHMTDEEKKAATQAVQVGPDYVPSPLKSIAQGASTSLWAATSAQLSGKGGVYCADCDISPIVADDSPDVRGVRRWAIDPDQAVRLWDVSLDLVARR

SEQ ID NO: 27720 - protein, 465 aa, Burkholderia fungorum LB400
MDDHYDVIVIGGGPGGYVAALRAAQLGRRTALCERDQLGGICLNWGCIPTKALLHTADTLRTVRKAAHLGIGIDDPVVDFTRVMARSREVAQKLNRGVSHLLRKAGVTVLAGTAAFAADRSVRVHGADGALRTLQARHTIVATGAAARQLPALPWDGERIWTYREALAATAVPKSLLVVGAGAIGMEFAGFYAAMGTEVTVVEVAPRILPASDADVSEFVARACERDGIRLRTGCSVVHSAAHAEGVRVMFRSENAEEQREFERVLVAVGLDGNTEGLGLEHTRVAFERGLIIADAAGATSDPVVHAVGDVTGAPMLAHKASHQAIACVERIAEVNRGERHASPKIPGCVYSHPQTASVGLTEDEARRTGRALRVGRFPLDANGKAIALGDPSGFVKTIFDAASGELLGAHIVGPEAPELIHGFTLAATLEATESELIETVFPHPTLSEAMHESVLAAFGRPLHI

SEQ ID NO: 27721 - protein, 267 aa, Burkholderia fungorum LB400
MEPSDSTPLVALKASGIVKSFGANRILDGVDLTVARGETVCVLGPSGSGKSTLLRCLNWLSPPDEGAVWIGDQRLGLRETPNGATSPRPEREIRAQRSRIGMVFQSFNLWPHMTALENVMEGLLSVKRMNRLDATDLAVEALRQVGLGGKHTSMPANLSGGQQQRVGIARTLAMAPEVILFDEPTSALDPELVGEVLAVMRGLAANATTMIVVTHEIGFARDVSDRVIFMDRGRIVEQGPPAQVLDAPSSPRLQQFLYRFTPENSRS

SEQ ID NO: 27722 - protein, 249 aa, Burkholderia fungorum LB400
MLDREGFRPNVGIILLNAHNEVFWGKRLREHSWQFPQGGIKYGETPVQAMYRELHEETGLLPEHVKVIGRTRDWLRYEVPDKFIKREVRGHYRGQKQIWFLLRMVGRDCDICLRATDHPEFDAWRWNEYWVPLDCVIEFKRDVYQLALTELSRFMRRAAPRAEKPGGHHGPRYPRIASSMESPPDSTVMTVTTVTSVTTVSIETSVHATIASDCGPGSGSAAEVGAAPEHEDESARETAGSLFRPGVRN

SEQ ID NO: 27723 - protein, 462 aa, Burkholderia fungorum LB400
MQNTVYAATRLDRLPLSSFHWRLFFLIGAGLFLDAFDVYLGGVVTGALLKSGWSTLELNAWFTTLTFAGLTIGAWCAGILGDRFGRRFSYQLNLLIFGGASLAAAFAPSMTWLIALRFIMGIGMGAEIVISYGMLSEFVPPRYRGRLLAALSLFANSAVFVASLASLWIIPTFGWRYMFAITGVAATIVWVMRKKMPESPRWLVSQGRLEEAEAVLDGIETSVAKRHVLPDYLREDTVRAETVPLSVLFRTPVLWRSIVGSLIMVTIGYSVYGLINWLPSFFVQQGFNIVKSLTYSTVMSLGAPAGTVIGIFITDRMGRRPAIIGATLATAAIGLLYQHAASSAELLTAGFCLVAGIYVLVAVGQGAYVPELFATSYRLRGSGVCGTAGRAASALCQFFVLWLFTVGGVNMVVGSVVAVQLLLALAVWLLKIETSGLRLEQTVETGISTGTQERHRTVDISH

SEQ ID NO: 27724 - protein, 402 aa, Burkholderia fungorum LB400
MDEGIKRIVIAGAGQAGATVAFGLRRGGFGGEIALVGDEVHLPYERPQLSKEMLRPESAGHRSIRTRAEFNEQRIELVLGRRVVAVDVERHQIQLDDGRGLAFDRLVLAGGVSPRQLPGGPHDAAAVRYLRTVEDASGLCADLETGGHVAIVGGGVIGLEVAAAARARGCEVTVIEAADRLMSRSVDDTVSRFLDRAHRGKGVDIRYRVLVTELRDGRYLELSDGSTVAADTVLVGIGVTPNIAGFDALGITDAAGVRVDAYGQTALQGIFATGDIASQKNENGFGRIETWANAQDHALNVARNLLGERVAYESPVWFWSDQGTTNLQVVGNATRGRRIVRGDERGEAFSVFWLGEGDRVTGCASVNMPKDMALARRWVKQGNRVDPHQLAEPGTPLRNCAL

SEQ ID NO: 27725 - protein, 494 aa, Burkholderia fungorum LB400
MNANPKHVADPTRLRNQNLIGGQWKAALSGQSIAVENPANEEIIAQVPRGQQEDIDEAVKVARATFESAAWRKIRPIDRGRILENIARKVEEHAEELSWLESLDTGKAISFARVIDLPSTVDVFRYMGGWCSKLGGTTPPISFDGKEYHAYTRREPVGVVGAITPWNYPLALGSWKIASALAAGCTMVLKPTELTPLSTLRLAELCLEAGLPEGALNVVNGYGHEAGEALARHPDIDKITFTGSTVVGKKIVEYALGNMKRVTLELGGKSPSIVFDDADLDQVGLGAALAVFFNSGQICFAASRLFVQASVYDRVVEAVAAVASQFKVGNGQDTDTMLGPLVSRKQQERVLGYVQSGIEQGASLIYGGQKIGDKGYFLQPTVFADADQSMKIAQEEIFGPVVSIIRFKDEVEAIRLANDTTYGLAANIWTRDIKKAHRVAHRLQAGSVWINCHGVIDPAAPFGGFKQSGWGREVSEEGLAAYTEIKTVCALLDD

SEQ ID NO: 27726 - protein, 1309 aa, Burkholderia fungorum LB400
MASTTLGVKVDDLLRSRLKDAATRLERTPHWLIKQAIFAYLEKIEHGQLPPELSGVAGSADLTEGAAVEHEEDGGSHPFLDFAQNVQPQSVLRAAITAAYRRPEPECLPFLLGQARLPANLAGDVQTMAGKLVETLRTKSKGGGVEGLIHEFSLSSQEGVALMCLAEALLRIPDRATRDALIRDKISKGDWKSHMGQAPSMFVNAATWGLMITGKLVTTNSETSLSSALTRLIGKGGEPLIRKGVDMAMRLMGEQFVTGENISEALANSRKYEARGFRYSYDMLGEAATTEADAQRYYASYEQAIHAIGKAAGGRGIYEGPGISIKLSALHARYSRSQQERTMSELLPRVRSLAILARRYDIGLNIDAEEADRLEISLDLLEALCFDPELAGWNGIGFVVQAYQKRCPFVIEYLIDLARRSRHRIMVRLVKGAYWDTEIKRAQVDGLEGYPVYTRKIYTDVSYLACAKKLLSAPDAVYPQFATHNAHTLSAIYHLAGNNYYPGQYEFQCLHGMGEPLYEEVTGRDKLNRPCRVYAPVGTHETLLAYLVRRLLENGANTSFVNRIADETVAIKDLIADPVDEASKIVPLGAPHAKIPLPRNLYGSERLNSMGLDLSNEHRLASLSSALLASAHHPWRAAPMLEDNEIAVGLARDVRNPADHRDLVGTVVETTPEHVSAALAHAVAAAPIWQATPVDARADCLARAADLLEAQMHTLMGLVVREAGKSLANAVAEIREAIDFLRYYSTQIREEFSNDTHRPLGPVVCISPWNFPLAIFMGQVAAALAAGNTVLAKPAEQTPLIAAQAVRILREAGVPAGAVQLLPGNGETVGAALVADPRTRAVMFTGSTEVARLINKTLSSRLDPDGKPIPLIAETGGQNAMIVDSSALAEQVVADVLQSSFDSAGQRCSALRVLCLQDDVADRTLEMLTGAMRELAVGNPDRLSVDVGPVIDLDAKRGIDAHVAAMREKGRKVEQLPMPDGCAQGTFVPPTLIELDSIDELKREVFGPVLHVVRYRRSQLDKLLEQIRATGYGLTLGIHTRIDETIAHVISRAHVGNIYVNRNVIGAVVGVQPFGGEGLSGTGPKAGGALYLQRLLATRPAGLPKSLARALVVDVPRAAENGDNPSAVLTAYRDWLITEREPQLAARCDGYLSHVPAGATAVLSGPTGERNTYTLGARGTVLCIASTASGARVQFAAALATGNRALFEGAAGEQLVSQLPASLKSHASVKKSADTPFDAVLFEGDSDELLALVKEVAKRPGPIVSVQGVAARALESGDEDYALERLLTERSVSVNTAAAGGNANLMTIG

SEQ ID NO: 27727 - protein, 450 aa, Burkholderia fungorum LB400
MASPLIDVVEVIERQKVGIGQCLVVLLCALLMFLDGFDTQAISYIVPALSKDWHLPREVLGSIFSAALVGLMVGYLAIAPLSARFGHKRMMLASSVLFALFTLLTLFATNVTELIGLRFLTGIGLGAAAPSAVALTCEFAPKRLRATFVLLVYCGFSLGFVVAGLTAGALMPAFGWKSLMLVGALAPIALTVPLAWLLPESLVVLQRRPNGDERMRAVLLGFFPRLDVPVGSRFRLEDQGEARASVTALVRGRTSAGTLLLWLIFFLNLAEFYFMQSWLPTMLTGLQYSPATVVWVTALPTIAGVLSAVPLGLAMDRVGPYVTLTVMYLAGCVFMWLVGGAFSGSVAWLMVMVFCAGFCISGGQKSVIALAAVYYPLNLRSTGVGWALGIGRLGGIAGPLSAGMLYSAHWTPAEIFRFSAWPVLIAGLAVFVMGRIYGSRPVAVEVSTPH

SEQ ID NO: 27728 - protein, 489 aa, Burkholderia fungorum LB400
MGKATGFLEFERRHEAYEAPLTRVKHYKEFVAALSDEEAKIQGARCMDCGIPFCNNGCPVNNIIPDFNDLVFHQDWKNAIEVLHSTNNFPEFTGRICPAPCEAACTLGINNDPVGIKSIEHAIIDKAWTEGWVAPLPPKHKTGKKVAVVGSGPAGLAVAQQLARAGHDVTVFEKNDRIGGLLRYGIPDFKLEKWLIDRRMRQMEAEGVTFRANVFIGKADSLPAHIGNTAKETITPDQLKEEFDAVVIAGGSETPRDLPVPGRELEGIHYAMEFLPQQNKVNAGDKVANQLLAKGKHVVVIGGGDTGSDCVGTSNRHGAKSVTQFELLPQPPEEENKPLVWPYWPIKLRTSSSHDEGCSRDWAVATKRLEGKNGKVEKLIAARVEWKDGKMQEVPGSEFEMKADLVLLAMGFTQPVSPVLEAFGVDKDARGNVRSSTEGDKAYYTSVDKVFTAGDMRRGQSLVVWAIREGRQCARSVDAFLMGHSELPR

SEQ ID NO: 27729 - protein, 263 aa, Burkholderia fungorum LB400
MRDVDFGYGDRLVLSNLNLRFERGQVVAVMGGSGCGKTTVLRLIGGLVRAQRGEVLFHGQDIGRQTRDGLYALRRKMGMLFQFGALFTDMSVFDNVAFALREHTDLPDELIRDLVLMKLNAVGLRGARDLLPSEISGGMARRVALARAIALDPELMMYDEPFAGLDPISLGITANLIRALNQALGATSILVTHDVPESFAIADYVYFLANGGVHAAGTPAELRESTDPTVRQFIDGAPDGPFKFHYPSKTPLAADFGIGGGQS

SEQ ID NO: 27730 - protein, 350 aa, Burkholderia fungorum LB400
MSTTYAYAATDATAPLAPFEIQRRELRAHDVQMEVLFCGVCHSDLHQARNEWKNTVFPVVPGHEIVGRVTAVGPDVTKHKVGDLVGVGCLVDSCRTCASCEEGLEQYCENGFVGTYNGVDRVDGQITYGGYSTQLVVDEEFTLSVPDNLDPAGVAPLLCAGITTYSPLRTWGAGPGKKVGIVGLGGLGHMGVKLAHAMGAHVVLFTTSPSKIEDAKRLGAHEVVISKNAAEMEAHLNSFDFILNTVAAQHDLNPFLNLLKRDGTMTLVGAPEHDHPSPQVFNLIFKRRRLAGSLIGGIAETQEMLDFCGEHGITSDIEVIPMQGINEAYERMLKSDVKYRFVIDLDSLRK

SEQ ID NO: 27731 - protein, 300 aa, Burkholderia fungorum LB400
MASNPVWTHLAPGEWWPSRRLPLYRYFGGSGAMQLPVPMMNIVNGGAHANNSLDIQEFMIVPVSQPSFREALRCGAEVFHALKKILSDRGMSTAVGDEGGFAPNFGSNDECLSTILQAIEKAGYRAGEDVLLALDCAASEFYHDGKYQLAGEGLQLSSTEFADYLANLADKFPIVSIEDGMHESDWAGWKTLTDKLGKKIQLVGDDLFVTNTRILKEGIEKGIANSILIMINQIGTLTGNFRGDRNGQARRLHGCDLASFGRNRRFDDCGYRRRSERRADQDGFAVAFGPHFEVQPVAAH

SEQ ID NO: 27732 - protein, 407 aa, Burkholderia fungorum LB400
MGAGQAGFQTAASLRQAGFTGGIALVGDEPGVPYQRPPLSKAYLLGKIGTAALRFRPDEWFDQQHVERLQATVAAIDRDARCVVLADGARLAYDHLVLATGARNRVPSVDGIELDGVFGIRTLADADALSSRVDAARNVVVIGAGFIGLEFAAVAAAKGLSVRVIELGQRPMARALSEPMSALFGDAHRSWGVVFDFGQTVTRFIGKDGKVTAVETGSGEWVPADLVVYGIGVLPNTEIAAAAGLCVDNGICVDEQLVTSDPAISAIGDAVSFPCAWSATRVRLESVQNAVDQARAVAARLVGTPAPYNALPWFWSDQGDLKLQIAGLSGGHDEAVVIGSIEQRQFSVLCFREDRLIAVESCNRATDHMAARKLLARGTALRVADARTPGFDFRAYESSSRDVPVCQ

SEQ ID NO: 27733 - protein, 511 aa, Burkholderia fungorum LB400
MLLDFSGDLYTYAQVDGLSTRLANSLAELGVTAGQTVVTMLDNNLDAVITWLAINKLCAVSVPINTALRGEFLRHQLDDASARLVICEGDYVERIAAIADQLKEATRVLHRGATTVRKCGALALAPLDQHRGSDDTPLSRKPNPWDLASLIYTSGTTGPSKGCMISYNFMCNLARQQLRAGPATANDITITPLPLFHMNALAVGVLSNILVGARVAIVPRFSVSKFWSEVERSGATIASILGGMGGLLANAPDDEAAKRCYGQIHTVRGNPFTEATKQIWRERFGARQVGGNGYGLTEACVITSLPAGEYAAPGSSGKRIPEFDVRIVDELDRELPANQAGEIVCRPLHPDVMFMGYWHRPEDTLKLMRNLWFHTGDIGKFDDDGFFYFVDRKKDYLRRRGENISSFEMESAFSRHPDIAEVAVHAVPSDKGEDDVKVTAVLNPDAALTAEALFHWATDAVPYYALPRYIEFRDTLPKNPQGRILKYQLRDEGKTPDTWDLEATGIKVARR

SEQ ID NO: 27734 - protein, 428 aa, Burkholderia fungorum LB400
MIGVLFVVTLMSQMDRQLPSLVVGPLRREFGISDTAFSLLQGYAFAVFYTLAGLPLGRLVDRGSRRNLICAGLVFWGVATALFAFGQTYTQLLLARVGVGIGEAVLAPAAYSLIADCVEPARRGRALAVYYTSLAIGSGTSLLLGGWLLAIIPAAGIAVAGFGEVPAWRVAFVAAALPSLPLALLMLASVREPVRHETTASVADERAASVREFAHYLRTHAGTFTRVLTYPALLSIIGYGALAWAPALFARSFGMPPSHSGALLGIIVAVAGAAGTLASGALSDRWAARGIVAARFRVALAGACLFAVPSALWPLMPNAPLALALLFVNLLGLSIAQAAAPTSIQAVVPNRLRGQAIALYLLLAGLLGIGLGPTAVALLTEHLFHQDTALRYSLALTAAPSALLGLWLIGSGLRPYARTYAALHSASR

SEQ ID NO: 27735 - protein, 466 aa, Burkholderia fungorum LB400
MSKTSLIAADRKHLIHPVINYRAHEARGATVLESGQGAYLRDIDGNELLDAFSGLWCVNVGYGQQSIVEAATRQMTKLPYATTYFHFSSEPAIELADKLVALAPASLQHVYFTLGGSDAVDSAIRFITHYFNATGRPSKKQMIALERGYHGSSSVGAGLTALPAFHRNFDLPLPHQHHLPSPYAYRQTHGDDAQALIAASVAALEAKVAALGTDNVAAFFCEPIQGSGGVIVPPVGWLKAMRDACRRLDILFVADEVITGFGRTGPLFACEAEQVEPDLMTVAKGLTSGYAPMGAVLMSDEIYQGIAGDARDTAIVGHGQTYSAHPVSAAIGLEVLRLYQEGGLLANGQAQAPRFAAGLDALLGHPLVGDSRHRGLLGALELVADKDSRARFDPALKLPDRIAAAAYRNRLVFRAFGDSILGFAPALCFGEAEFEQMFGRLKRTLDEVLDETEVRAALRTAGRAAA

SEQ ID NO: 27736 - protein, 246 aa, Burkholderia fungorum LB400
MQLSKRLAAELFGTFWLVLGGCGSAVLAASFDGPVHGLGIGFVGVALAFGLTVLTMAYAIGHISGCHLNPAVSVGLTVAGRFPARDLLPYIVAQVIGAVLGAFVLSLIATGKPGFDLVASGFASNGYGERSPGHYSLAAAFICEVVMTGFFLFVILGATDKRAPAGFAPIAIGLCLTLIHLISIPVTNTSVNPARSTGPALFVGGAAVDQLWLFWLAPILGAVIAGVLYPALAESRDSNSQKLALD

SEQ ID NO: 27737 - protein, 459 aa, Burkholderia fungorum LB400
MEPHAQPISEVGAESFDAKGFLDRYFEISSRGSSQRQEIVAGITTFLAMVYSVFVVPGMFGKAGFDTSAVFVAVCLTTAFGSLLMGVWARLPIAIGCAISLTAFTAFGLVLGRGLHPNVALGAVFLMGVVFTAISVTGVRSWILRNLPTGIAHGTGIGIGLFLLLIAANDVGLVVKNPGAGLPVSLGNITALPALMSVAGLAAIFGLVRRRVPGSILIVIVAISAIALAVDPAVSFHGVFAVPSLSAPGHASLIGAMDLKGALSMAVLPSVLALVMTAVFDATGTIRAVAGQAGQLDENGRIINGGRALTADSLSSIFSGLLGGAPAAAYIESTVGVAAGAKTGMAAAVVGLLFLVVMFFSPLAGLVPSYATAPALMYVGLLMLSNVSKLHMDDMVDSMSGLMCAVFIVLTANIVTGIMLGFATLVIGRVVSGEYRKLNVGTVAIAIVLVGFYLGGWAI

SEQ ID NO: 27738 - protein, 130 aa, Burkholderia fungorum LB400
MLRYFNPVGAHESGLIGEDPAGELKHGPLALVTDAMPVVTIAPNDALLEKLKSNLQEVKARGGELYVFADADTRIGSEPGIHVIRMPEHYGPLSPILHVVPLQLLAYHTACARGTDVDKPRNLAKSVTVE

SEQ ID NO: 27739 - protein, 354 aa, Burkholderia fungorum LB400
MRDEGFTGQITLVGEEAHPPYQRPPLSKEVLLGDVPPEHCYLWPAGLDAELRLNTRVRSIDRSARQLRLADGGTIAYDRLCIATGGRVRRLDMPGAHYLRTIDDALALRAALLRGGSVLVIGGGWIGLEAAAAARRFGCSVTVVEAAARLCSRVVPPMLSEYLHGLHHRNGVTIACNATPDVAAHDTIIVGIGIVPNTELAEDAGLEVANGIVVDEYGTTSDADIFAVGDVAALNGQRIESWANAQNQAIATARSMLGKYTPYSEIPWFWSNQYDVNLQFLGFARPEDEVVVRGDVASDRFSLFFLSSDRISAMIAANSMKDIRAGKRLIERGISVSPDRLADPSQSLQDLLKA

SEQ ID NO: 27740 - protein, 305 aa, Burkholderia fungorum LB400
MASNELKVGFIGLGIMGSPMAAHLLAAGHRLFVNTRSKVPDAIAQGDTVICATPAAVAGQADVVFLMLPDTPDVEQVLFGTEGVATGLGDHGGATRKLVVDCSSIDPLATRTFAERIGKVGGDYLDAPVSGGEVGAKAASLTIMVGGAEESFERIKPLLLLMGKNVTRVGGVGDGQICKVANQIIVASNIVAVSEALVFASRAGADPGRIRQALMGGFAASRVLEVHGERMIKRTFQPGFRIRLHQKDLNIALQSARTLSLALPQAANAAQLMQTAAALGHAESDHAALVRAIECLAQHEIELDE

SEQ ID NO: 27741 - protein, 440 aa, Burkholderia fungorum LB400
MLCVIGFGLFLEFFDLYTGGAIVGVLLKQGWSTLQLNALFGTLTFAGLTVGAMMAGIIGDRYGRRLAYQINLVVFGIASFAAAVAPDMYWLSAIRFMMGLGIGAEAVISYGMLGEFVPPGFRGRMLAFLSVFGNSAVFVGSLVNLWVIPHLGWRYVFVIAGILAITLWIVRRSIPESPRWLETKGRIDEAEVVLQRIERSVARGGELPSYAHEVPAPTPQVSIGVLFTPPILVRTLVGSAILVCIGFSIYGLINWLPTFFIQQGFDIVKSLTWTTVITLGGPVGSLLGVAVSDRVGRRPAIIASCVVTAVCGLIYQQVDSAFALMGVGFLLVCSIYVLVAVGQGAYVPELFSTSYRLRGTGVCMTAGRLASAGCQFFILWLFTKGGVLMVVGSVVAAQLLLAFAVWAIRIETRGKRLEDLDSGVPGAPTTERSHSYSSGQ

SEQ ID NO: 27742 - protein, 462 aa, Burkholderia fungorum LB400
MQKTIHAGARLDRLPLSAFHWRLFFLIGSGLFLDAFDVYLGGVVTGALLKSGWSTLEMNAWFTTMTFAGLMVGAWAAGLLGDWFGRRFSYQVNLIIFGGASLAAVFAPSMYWLIGLRFIMGIGMGAEIVISYGMLSEFVPPRYRGRLLAALSLFANSAVFVASLASLWIIPAFGWRYMFAITGIAATIVWFMRKSMPESPRWLENEGRLAEADALLDSIEGKIALTHTLPDYSRDDVLQTGKVPLGVLFQPPVLWRSIVGSLIMITIGFSIYGLINWLPSFFVQQGFNIVKSLTYSTVMSLGAPAGTIIGVLLADRVGRRPAIIGAALVTAVMGVFYQHASSANALLVAGFLLVAGIYVMVAVGQGAYVPELFATSYRLRGSGVCGTAGRAASALCQFFVLWMFSIGGVNMVVGSVIGIQLLLALAVWLLKIETSGLRLEETVDEGTTLAADNRRQIVDVGH

SEQ ID NO: 27743 - protein, 167 aa, Burkholderia fungorum LB400
MDENGCEMPPGEPGELWIRGPMIASGYWRNPEATESAFVAGFWKSGDIGSVDSQGYVRIADRKKDMINRGGFKIYPAEVENVLCELGGVLEVAVVGRPHVILGETVVAFVRCVDVDVTDAIVREFCSEKLADYKIPDHVVIVEEPLPRNPNGKMQKEMLREMARALP

SEQ ID NO: 27744 - protein, 452 aa, Burkholderia fungorum LB400
MQEAASQSVDEFIDSQPVSGYQRSIIFFCFLVVALDGFDSACIGFVGPAIRAHWQLTVAALSPVFGAGLFGTMAGGILLGPVADRYGRKTVLVASVALFGLASVVSAFSPDIHFLAFMRFVTGIGLGGAMPNSITLTSEYCPGAKRSGYVTLMFCGFTIGASAGGLLTAEIVGTVGWQGILVAGGVLPLLLVPFLMGFLPESIRYLLLIDRAKSYVRVASIASRVAAPGVTVPRLRADEKVRRSPVKALFEKGVVTGTLLIWTIFFSSLLIIYLLTSWMPVLLSSAGIPLESAALISMMHQVGAALGCIWLGRQMDRFNPHRVLAWSYFVAIPIIVLCAFSGSHKALLVLSVFALGFLISGGNIGAYALVSGYYPTSSRSTGVSWANAVGRVGAALGSMAGGLMMAAGLRLQEIILVLAIPAAVATGCLCLLGIIRSHRKAGPVGEPVHSLH

SEQ ID NO: 27745 - protein, 461 aa, Burkholderia fungorum LB400
MSREHYPKQLIDVLGSDSLLQATVQRMEGFRADGSMVSAPIIVCGDEHRFVTSEQLRARGIDARIVVEPARRDTAPALTIAAADLCSEGDDAIIVAMPADHAIENLVAFHSAIAVAVQHAQRGAIVTLGVPPTRPDTGFGYIRLGSELGRGAHRIASFVEKPAAELAEQYLASGRYWWNSGIFAVRASVWLAMLRIMQPVMHDACVLAHAQGTHDGAYFRPGADAFKSSPADSIDYAVMERLGSDERFADGVVVPLDAGWSDLGSWDAVWEALDKDADGNAARGRVVFEGTTSSFAHSQGRLIACVGLTNVVVVETDDAVLVADRSRVQEVKSVVSRMRALQAPEVDAHRKVRRPWGYYDSIDHGERFQVKRIVVNPGGRLSLQLHHHRAEHWIVVSGTALVTRGNEEFMLSENQSTFIPLGVTHRLENPGKLPLELIEVQSGPYLGEDDIVRFDDTYGRA

SEQ ID NO: 27746 - protein, 495 aa, Burkholderia fungorum LB400
MTGHLPKLSMYIGGEWVEPASGEYFETVDPFTAKPWALIPRGNAEDADRAIRAADKAFRDGPWRAMHPSERGLVLQRFGQLIGQHADELAGIEVRDNGRLLAEMRHQIRGIPKWYYYYGGLADKIEGAVHPVEQPALSFTRHEPLGVCVGIVPWNAPLLLLSLKAAPALAAGNTIVLKPAEFTSASALKLMELVEQAGFPPGVVNVVTGFGKEVGEPLVAHPLTRHLGFTGSTATGSHLYALAAKDVKRASLELGGKSANLVFNDADLNNAVRGVVGGIFGAVGQTCIAGSRLLVQRRIHDEFVDKLAAFTKTARIGDPRKPETQIGPIANRMQYNKILGYIDIAREEGAELVMGGARPDIAECGEGFFIEPTIYTGIRNDMRIAREEVFGPVLATIPFDDPEEAIAIANDSDFGLGAGVWTSDMRLALRMSERLEAGSVWINTYRDISYTTPFGGYKKSGIGRENGIEGIREYLQTKAVWISTAEEIENPFVIG

SEQ ID NO: 27747 - protein, 442 aa, Burkholderia fungorum LB400
MTSRPVIDDLSSFWMPFTANRQFKAAPRLLESAKGMYYRSTDGREVLDGCAGLWCVNAGHGREEIIAAITQQLSTLDFAPTFQMGHPLAFEAATKVAELMPEGLDRIFFTNSGSESVDTALKIALAYHRSRGEGQRTRLIGRERGYHGVGFGGISVGGIAPNRKTFSGALLPAVDHLPHTHNLEQNAFSKGQPAWGAHLAEELERIVTLHDASTIAAVIVEPVAGSTGVLIPPQGYLQKLREICTKHGILLIFDEVITGFGRVGKATASEYFGVTPDLITMAKAINNAAIPMGAVAASRTVHDTIVNSGAQGAIELFHGYTYSAHPAATAAAIATLDLYRREGLFERAATLAPTFEAAAHSLRGAKHVKDVRNIGLIAGVELESRDGAPGARAYEAFVKCFEAGVLVRFTGDILAFSPPLIINEEQIAHIFKTVGDVLATVQ

SEQ ID NO: 27748 - protein, 467 aa, Burkholderia fungorum LB400
MKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLRGRRSDAMPGEPETVEYRHHHR

SEQ ID NO: 27749 - protein, 444 aa, Burkholderia fungorum LB400
MHDIDDFLKKNRVTEIEAIIPDMAGIARGKIIPRSKFESGESMRLPQAVMIQTVTGDYPEDGTLTGVTDPDMVCVPDPSTIRMIPWAVDPTAQVIHDCVHFDGTPVAISPRRVLRRVLELYKAKGWKPVIAPELEFYLVDMNKDPDLPLQPPIGRTGRPETGRQAYSIEAVNEFDPLFEDIYEYCEVQELEVDTLIHEVGAAQMEINFMHGDPLKLADSVFLFKRTVREAALRHKMYATFMAKPMEGEPGSAMHMHQSLVDEETGHNLFTGADGKPTTLFTSYIAGLQKYTPALMPIFAPYINSYRRLSRFMAAPINVAWGYDNRTVGFRIPHSGPAARRIENRIPGVDCNPYLAIAATLAAGYLGMTQNLEATEPLLSDGYELPYQLPRNLEEGLTLMGACEPIAEVLGEKFVKAYLALKETEYEAFFRVISSWERRHLLLHV

SEQ ID NO: 27750 - protein, 476 aa, Burkholderia fungorum LB400
MLHAAQFYIDGGWVEPTSPVWFDIVDPSTETPFEKLALGNAQDVDRAVAAARRAFASWSATSVADRVALLKRIVTIYERRYDEFAELMRREMGAPITFARNGQAARGPAHLNALIDVLERFEFEEQRGSTRIVLEPIGVCGLITPWNWPVNQIVVKIAPALAAGCTMVLKPSEYSPLSALLFADVLDEAGVPAGVFNLVNGDGPGVGSAIASHPDIDMVSFTGSTRAGVLVAQSAAETVKRVAQELGGKSANILLDDVDLDQAVTRGVAACFTNSGQSCSIPTRMLVPRHLMNDAAQIAKRAAQAYRLGPTDDPATQLGPLVNANQFKRVQALIQIGIDEGARLVTGGTGRPDGIDTGYYARPTVFADVTPQMTIAREEIFGPVLSMIPYDSEEQAIDIANGTDYGLAAYVQSADLARARKVGRALRAGGVHLNYPPADFGAPFGGYKRSGNGREWGEAGLREYLETKALAGYGVD

SEQ ID NO: 27751 - protein, 304 aa, Burkholderia fungorum LB400
MNKERVGFIGLGNMGGRMTRRLVDAGIAVLGYDTARERVDAAGAKAAGTVGEVLAFADVVMMSLPDSKVVEAVVEGEDGVLAHCREGQIVVDLSTAAASSTIRLAKRFAERGVRYVDAGISGGAAAAEKGSLTLMVGGAADAVAALQWAFAPISSKVAYMGESGAGHTTKLLNNFLNAVSLAASAEVMVAGKKAGLDLHLLLDVLNSSSGVNFATLNRFPKIVDGDYLEGGLTGKLMTKDVVLYVDRIRELGVISLNSAGPLASFGLGTALGYGDVISNRVVDAIGDVSGGVRLFDGANKEKNA

SEQ ID NO: 27752 - protein, 240 aa, Burkholderia fungorum LB400
MTLQTGTLVVLRHGQSIWNRANRFTGWSDVGLSVQGVADAQRVGERLREAGFRFDLAVTSALLRATDTLAHVLRTLEQPPPRTVRSWRLNDRHYGMLTGMEKDEAALAYGAERVRQWRRGFDLAPPALDADLHAALVRALHDDAMPHADALPRTESLRDTLRRVLPLWDECVAPALTRGQSVLMVGHGNSLRALFKQLDNIGDDAIASVEVAHAEPLVMKFDATLSVISRTPLAALAASR

SEQ ID NO: 27753 - protein, 316 aa, Burkholderia fungorum LB400
MAASMSATPEVQRPDILALGEAMIEFNQSVKDEPNYLQGFGGDTSNFCIAAARQGARTGFVSAVGADHFGRLLVDLWEREQVDTSLVRVDPHASTGVYFVSHGPEGHAFDYLRAGSAASRYAPQDLPLEAIAAARVIHLSGISLAISLSACDAALAAIAHARANGVRVSFDTNLRLKLWPLARARAVMLEAIRQTDICLPSWDDVTELTGLTGRDEIVDFLLSHGPGVVALKLGKQGSYIATPNERRVVPGQLVDAVDATGAGDCFGGAFIARIVAGDDPFAAARYANVAAALSTQGYGAVAPIPSRETVEQLLAD

SEQ ID NO: 27754 - protein, 1383 aa, Burkholderia fungorum LB400
MVLHVEDGQVVKISGDKEHPANFGRLCTKGQSAHVALRKSGRLEGAFVRHARGRDPAPLPMTQAISATAARLRGLLDEHGPDALSFYVSGQMSIEAQYLVNKLAKGFVGTNNIESNSRLCMASAGSGYKLSLGADGPPGSYEDIDHADLFFVIGANMADCHPILFLRMMDRVKAGAKLIVVDPRRNTTAEKADLFMQIKPGTDLALLNGLLHLLHENGHTDAAFIAEATEGWEAMPAFLADYTPEKAAQITGLAVEDIRAAAQMIGSANEWISCWTMGLNQSTHGTWHTNAICNLHLATGKICRRGSGPFSLTGQPNAMGGREMGYMGPGLPGQRSVLVEEDRAFIEDLWRIPKGTLKPEAGNGTIDMFTRMAAGEIKACWIICTNPVASVANRQNAIDGLRAAQLVIAQDAFLDTETNRYADVLLPGALWAEAEGVMINSERNLTLMQKGVEPPGAALPDWQIIARIACEMGYAEGFTYASAEEVFAEITRVSNPKTGYDLRGASHRRLKETPLQWPLASDESAERNPVRYLNDGVSQTLKELADGSRPRLVFPTASCKAVFFARAYAAPAELPDREFPIVLNTGRLQHQWHTMTKTGKVAMLNKLNPAPFVEIHPEDATTLGIKAQDPVEIRSRRGRAVLPAVVTERVSAGSCFAPMHWNDVFGDDLCINAVTSDAVDPISQQPELKFCAVALSPVAADSRQPLLTDDDATITDASVAVAVSAAPGNTVSASAEDLDMPRIDALTSLLQLPPTPAPSFNDQQRLYLAGFVSGLRSAEAKGIDSTPVLPGNAPFDTTSRLYVDGLLAGLYSRSAMVPAASAPTLAVSHAETSHASGVRIVRARPKVTLLWASQTGNTESLTEGYATRLMESGFEIRTSCMADYPASALAKAQYVLLMTSTFGDGDPPDNAQSFWTQLSGEGAPRLDGVRFAVLALGDRNYDQFCGHGRRLDERLAGQGAQRLMDRVDCDSEYQASADAWLERIIVRIKEEDAALYAVPAGGMVNAVVPGTVPTKTRPAASRLVSNLRLNKQGAAKDTRYVSLHTGDSGLEYEAGDALGVWPSNCPELVDELIGLSGLHADAAVNVAGAGEMRLADALGKHYEIARPNPDLLAFVAARSNNGALRDLLAPDRKADLKQWLWGQQIADVLHEFPVSLTASELTGMLKRLQPRLYSIASSPKAHAGEVHLTVAAVRYSNGRRHRKGVSSTFLADRAGDVNVPVFVQKSAHFRPPHGSETPMIMVGPGTGVAPFRGFLHERRARGDTGRNWLFFGEQHAASDFYYRDELESMRDSGVLTRLDVAFSRDQADKVYVQDRMREQGAQLWAWLEDGAHFYVCGDANRMAKDVDAALKEVVARHGGMSDDKALEYVSRLAQEKRYARDVY

SEQ ID NO: 27755 - protein, 452 aa, Burkholderia fungorum LB400
MDAPAEEYAYTVLLSPDFSQPDALAVIDVKPGSPTYSQVVHTVPVPYKGDEFHHFGWNACSSSLSPLTGHAFLERRYLIVPGMRSSRIYIVDTHPHPTQARIHKIIEPEEIFSKTGYSRPHTVHCGPEGIYISTLGGAGKDGTDGPPGIFIMDCETFEVLGRWEIDRGLQEKHYDFWWNLPRDYMVSSEWALPPQFENGIVAEDLLANKYGHRIHFWDLSGRRNVQTIDLGANHQMALEVRPAHDPSREYGFIGVVVDTTNLEGSIWTWWREGGEFHIEKTVTIPPEPAATELLPPLLQGFGAVPPLVTDIDLSIDDKFLYVACWGTGEMRQYDVTEPRKPKLTGSVHIGGIARRTPHPNGKTFAGGPQMVEISRDGKRVYWTNSLYSTWDNQFYPGGVPAAQVMARAEPGGGLTLTDDYWVDFPDGYRAHQIRLEGGDCSTDSFCYPSVGV

SEQ ID NO: 27756 - protein, 317 aa, Burkholderia fungorum LB400
MEPELKALIEQLSQAGRRPFWQCTVDDARNAPTLVKRLFPDAPSVERTQDIRISSTRGHAFPARLYVPRDRPCGLIVYLHGGGWVVGSVDDYHPLTATITARSGFAVLSVDYRLAPEHAFPIPLEDARAALEWASSGSAAVAIGADVNCLIVMGDSAGANLATVAARLHNEKNIDRRVDGQVLVYPVTGHDFKTASYDEFAEGNLLTRNDMQWFWDHYCPERAARANPLASPLEAEDLSMSPPALVMTAGRDPLRDEGEAYGARLRKAGVDVAVVRCDGLVHGFLAMIHQVPGAARAFDRIVDYITRLGEAVPEARR

SEQ ID NO: 27757 - protein, 390 aa, Burkholderia fungorum LB400
MNAPHDTPTSPTFPSRLPNVGTTIFTVMSALAAEKGAVNLGQGFPDFNCDPRIVDAVANAMREGHNQYPPMAGAAPLRQAISDKIANLYGRRYDATTEITVTAGATQALLTAILCSVHPGDEVVVVEPTYDSYLPSIELAGGKPVFVTLEAPDYAIPFDRLAAAITPKTRLLLINTPHNPTGTVWREQDMRKLEEIVRGTNVLILSDEVYEHMVYDGAPHESVARYPELAQRSFVVSSFGKTYHVTGWKVGYVAAPAALTVEFRKVHQFNVFTVNTPMQIGLADYMKDPAPYLDLPAFYQKKRDFFRAGLANSRFRLLPCTGTYFQCVDYSAISDLPEAEFAQWLTGEIGVAAIPVSAFYHEAHESGVVRFCFAKQESTLATALERLARL

SEQ ID NO: 27758 - protein, 244 aa, Burkholderia fungorum LB400
MHGRLAENAVLLQAVAQGAGELPAQVRVGVCVPSPYLAQSQSLLEGSRVAWGVQDVSAFTHGAYTGEVAAPMAVDFGATLAIVGHSERRAYHRESAELVAVKTQRVLEAGLTPIVCVGETLEEREAGSTEQVVGMQLDEVLAKLSEQEAARIVVAYEPVWAIGTGKSASSEQAQAVHAFLRARLAAKGAAVADVPLLYGGSVKPENAEELFRQPDIDGGLIGGASLKAQDFLVICKAATTSVAG

SEQ ID NO: 27759 - protein, 349 aa, Burkholderia fungorum LB400
MQRNPILELTQMKAIEITEFGAPEVLKLAERPTPQPAAGEVLIKVAASGINRPDVFQRKGGYAPPPGASDLPGLEVAGEIVGGTIDEKNNPFGLKVGDRVCALLAGGGYAEYAVAPLLQCLPVPAGLSDVEAASLPETFFTVWSNVFDRAQLGKGEGAPNETLLVQGGSSGIGVTAIQIAHALGFRVFATAGSDEKCRACEALGAERAINYKTEDFVEVIKSLTNDRGVDVVLDMVAGSYVSRELTALADGGRIVLIALLGGAKAELNLNEVLRRRLTVTGSTLRPRPIEFKAKIAAQLKERVWPHLEDGRIKPVVHRVFPAAQAAEAHALMESSTHVGKIVLSWGQDA

SEQ ID NO: 27760 - protein, 329 aa, Burkholderia fungorum LB400
MNTSSFIHPDAGERPQPLSGNAMPRCGGIATMMRLPNVGSAEGFDACFVGVPFDLGTSNRTGARFGPRQIRSESVLLRPYNMATRAAPFDSLRVADLGDVAINPYNLHDSIARIETAYDEILQHDCKPITLGGDHTIALPILRAMHRKHGKVGLIHVDAHADVNDTMMGEKIAHGTPFRRAVEEGLLDCGRVVQIGLRGTGYAAEDFDWCRDQGFEVVQAEACWNQSLAPLMARVRERMGDGPVYITFDIDGIDPAFAPGTGTPEIAGLTVPQALEIIRGSRGLNIVGCDLVEVAPPYDPFGTTALLGANLAFELLCVLPGVEYRASTR

SEQ ID NO: 27761 - protein, 270 aa, Burkholderia fungorum LB400
MSRIKNTFAALSAQGKKGLIPFMTAGDPDPARTVEFMHALAAGGADVIELGVPFSDPMADGPVIQQSSERALAQGVSLRHVIADVKRFRETNDTTPVVLMGYANPIERMGTEAFARAAKEAGVDGVLVVDYPPEECANFAEQMRSAGIDPIFLLAPTSTDERIAEVGKIASGYVYYVSLKGVTGAANLDVSSIASKIPAIKSRVPLPVGVGFGIRDAQTARAVAEVSDAVVIGSRIVQLLEQAAPESAAATLTRFIAEVREALDSVATAR

SEQ ID NO: 27762 - protein, 433 aa, Burkholderia fungorum LB400
MAMGVTDTILLGSLGPDALAAGGLGANLFFVVVTLLQGVLTSVSVSVSHARGAADEGRVPHIYWTGFVLSVLLSVPAFFLLSFATPILLAFGEPALLAHNVGEYAAVLRWGSLGSLVGVGLMRSFLPAIGAAKRLLWVSLASVGVNGFLNYGLIHGAYGLPRLGFLGSAAATSITVWLSALVLMALLHLRPRYRHFVVATRPNVPLMGELFGIGWPVAITYGVESTLFLATGLMVGLLGESQLAAHQIALNVASVAFMVPLAIGQAANVRVGFWSGAGQPLAARHAGFVALALGVGFMTLSGLVLIAAPHWIVGLYLHLDDPANAATVALASSLLGVAAIFQIVDGLQTVGSGCLRGLKDTRVPMIAAAFGYWVIGFPTGYTLAFHFGLGARGLWWGLAAGLASVALLMTLRFHKLSLRRVPAKPGAQPAKSV

SEQ ID NO: 27763 - protein, 292 aa, Burkholderia fungorum LB400
MGQWHPECPARLQAIEDQLIASRIDSLIERESAPLADEAALLRVHTQAHIDYIRSRSPPEGMAEIDPDTTMNPHTLQAALRAAGAAVAATDAVIEGRYDNAFCSVRPPGHHAEPARAMGFCFFNNIAIAARHALEVHGLGRVAIIDFDVHHGNGTEAAFSGDSRVLMCSFFQHPFYPFTGADNQAPNMCNVPLPARSKGMAVREAVDMLWLPRLHEFKPEMLFISAGFDAHREDDLGNMGLVEDDYAWITDQMREIAKRYSRGRIVSCLEGGYNLSALGRSVVAHMRSLAGI

SEQ ID NO: 27764 - protein, 360 aa, Burkholderia fungorum LB400
MDDELNTRLKPLRERIDALDAQLIALLNQRAAVALEVGEVKKHFNAPVFRPEREQQVIARLQDMSEGPLASEHISAIWREIMAASRALEKTIKAAYLGPVGTYSEQAMHEYFGQSIEGLPCSSIDEVFRSVEAGAAEFGVVPVENSTEGAVSRTLDLLLQTQLTIGGELALPIHHNLLTLNGGLTGVTRVCAHAQALAQCQRWLSTNAPHLERQAVSSNAEAARMAAEDPTVAAIAGDRAATHYGLQVAYALIQDDPHNRTRFVMIGKQPAGPSGYDQTSLIVSVHNEPGAVFKLLEPLARHSVSMTRFESRPARVGTWEYYFYIDLEGHRDDPAVAAALAELGEKAAFLKILGSYPRAR

SEQ ID NO: 27765 - protein, 427 aa, Burkholderia fungorum LB400
MSKNETLFERAQRTIPGGVNSPVRAFRSVGGTPRFIERAQGAYFWDADGQRYIDYIGSWGPMILGHVHPEVLEAVQRVLGNGFSFGAPTESEVEIAEEICKLVPSIEQVRMVSSGTEATMSALRLARGFTNRTRIVKFEGCYHGHADSLLVKAGSGLLTFGNPTSAGVPADIAKHTTVLEYNNVAELEEAFKAFGNEIASVIVEPVAGNMNLVRATPEFLQALRRLCSEYGSVLIFDEVMCGFRVALGGAQEVYGITPDLTCLGKVIGGGMPAAAFGGRRDIMAHLAPLGGVYQAGTLSGNPIAVAAGLKTLQLIQAPGFYDTLAARTTRLAQGLANVAREARVPFAADSLGGMFGLYFTESIPTSFAEVTQSDVPRFNAFFHKMLDAGVYFAPSAYEAGFVSIVHDDAIIDATIDAARGAFASLAA

SEQ ID NO: 27766 - protein, 471 aa, Burkholderia fungorum LB400
MIDIHTLGRNLNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQGGARVVGR

SEQ ID NO: 27767 - protein, 368 aa, Burkholderia fungorum LB400
MKTKAAIAWKAGAPLTIEEVDLEGPRAGEVLIEVKATGICHTDYYTLSGADPEGIFPAILGHEGAGVIVDTGPGVGTLKKGDHVIPLYTPECRQCKFCLSRKTNLCQAIRSTQGKGLMPDSTSRFSIDGKPLFHYMGTSTFSNYIVVPEIAVAKVREDAPFDKICYIGCGVTTGVGAVVYSAKVEAGANVVVFGLGGIGLNVIQGAKMVGADRIIGVDINSGRVELAKKFGMTHFINPTEVENVVDHIVQLTDGGADYSFECIGNTKVMRQALECTHKGWGQSFIIGVAAAGEEISTRPFQLVTGREWKGSAFGGARGRTDVPKIVDWYMEGKINIDDLITHRLPLERINEGFDLMKKGESIRSVVLY

SEQ ID NO: 27768 - protein, 478 aa, Burkholderia fungorum LB400
MHRATKIVATIGPASNTPEILLQMIQAGLDVVRLNFSHGTADDHRQRAGFVREAARQAGREVAIMADLQGPKIRVGKFENGKIMLVAGEPFVLDADCELGNEQRAGLDYKDLPRDLKPGDVLLLNDGLIVLNVSRVIGNEIHTVVKIGGELSNNKGINRQGGGLSAPALTAKDMEDIRTAMSLGVDYVAVSFPKNATDMEMARQLANIAGAPFGVKPKMIAKIERAEAIPALQGILDASDGIMVARGDLAVEVGNAAVPALQKRMIRMARESNKFVITATQMMESMIHAPVPTRAEVSDVANAVLDGTDAVMLSAESAAGKYPVQTIETMAAICIEAEKSEQSELDKDFLDRTFTRIDQSIAMGALFTAFHLGAKAIVALTESGSTALWMSRHWTHVPIFALTPRVGSERAMALYRNVTSLHLDTNTDRDTALQQALETVVSKGYASRGDMVVLTVGEPMGQAGGTNTLKIVRVGEPY

SEQ ID NO: 27769 - protein, 293 aa, Burkholderia fungorum LB400
MSAPLLFRPSLDAVYGFPHAKRVTQVVSPYQRIEVWDTPQLGRLFTLDGRPMTSTGDEFIYHECMVHPAALAHPSPQAALVLGGGDGGAARQLLRHAGIERIVVAELDAEVVRLTREHLPEVHGGAFDDPRVELVIGDAAHYVAHAAPARFDLVVFDLTPPDSPAAGLYTPTFYQQLKRVMRPIAAVSVHLGSPYFHAARIARLLDDLRAAFAVVRTMNTFIPLYGSLWIMATASDTLDPAALAADTLIERLAARRIGPLMHYDAGTHAALFSASRSVRDKLRRCCEIKFWVC

SEQ ID NO: 27770 - protein, 217 aa, Burkholderia fungorum LB400
MTETATAFTCGDWREPADVRQSTHGKPFDGSDLRICNPDETSPLGVGVEGEICVRGYNLMRGYTDGSHVERIDDDGFFHTGDIGFVDPAGYLHFVGRRKTLIKVKGLTVQPEEVEATLLRHPAISKAVVVGEGGGHESKGVVALIVLHEGDRWDMQALRTYCQEELSSYKVPRLLVVDANRFPLSASLKIDRIGAATLLKQIAAEVGCGDADSTEQN

SEQ ID NO: 27771 - protein, 458 aa, Burkholderia fungorum LB400
MKEPASGKRLARIGMADGALVAASAKTAFEAQQEWAALPYDERAAVLRRAARLAEESVEEIVGWIVRESGSTRAKAAFETQVTVKALHEASALPSRSAGEVLPSGPGRLSLARRRPLGVVGVISPFNFPLYLAMRAVAPALSLGNAVVLKPDPRTAVCGGFVIARLFEMAGLPNGVLHVLPGDGAAGAGLTSDPHVAMIQFTGSTNAGRKVGEAAGRHLKKVSLELGGKNSLIVLDDADLDRAVANTAWGAYLHQGQICMATGRVLVQRAIYERFVEKLVAKASSLTVGDPATDDVALGPLINGTQRDHVTRVLDAAQQAGARVEAGGSFRDLFFEPTVLTGVTKENPAFSEEIFGPVAVVVPFDTDEEAIALANDTEYGLAIAIVTSNVGRALRMGERLRSGLLHINDQTVNDEVINPFGGVGASGNGTSVGGPANWEEFTQWQWLTVKGEAPLYPL

SEQ ID NO: 27772 - protein, 454 aa, Burkholderia fungorum LB400
MLGLIGGGLFLDGFEVYVAGGVVGFLVKTGWANMHSAAMFVSASVAGMALGTWLAGVLGDRFGRRFTYQFNLLLFGLASFAAAVVSSMDQLIVARFVMGIGLGAEVVVSYGTLVEYIPPAHRGRWSSGLSLCGNAALFVAALVGYFVIPDLGWRWLFGGVGVAALIIWYMRKAVPESPRWLESQGRFEEADRILDDIEQELAYVGQPGEAAVPAYAVVPDLPRRMLVPRFIIGIMMSVAGNAAFYGLIVWLPTFFFRQGFTVGSSLGYSMVMSAGGPAGALVGMAIADRVRRKRAIIVLSIVAALLGLVYPLCKTPLSVLVTGFLLVSALYAFVAVAWASYLPELFPTRIRLRASAVCNVTGRLAAIAMPFAVVQLYAKFGVFGVVGALGGILLAQAAVIALLGIDTNNVSLEELTGQSAEEIGPAANQRFPSSRDGRLGSRSSQFGMSGIEDQ

SEQ ID NO: 27773 - protein, 315 aa, Burkholderia fungorum LB400
MSNFRGVIYDSIVDTIGATPLVRLSKLAAACDCRADVVGKLEFFNPLASVKDRIGIALIETAERAGRIKPGTLLIEPTSGNTGIGLAFVAAAKGYPLVLCMPESASIERRKMVGLLGAKVELTPASEGMGGAIRRAEALKRNHPDSLILQQFDNPANPDAHRHTTAEEIWNDTAGRVDIIVSGIGTGGTITGIGQTLKARKPELQMIGVEPSGSAVLSGGKPGPHKQQGIGSGFLSSILDLSVVDEIVTATDEDAIQTARQAAALEGVPIGISSGAALSVALRVGRRPGNAGKLIVVIVPSFAERYLSTELFADV

SEQ ID NO: 27774 - protein, 507 aa, Burkholderia fungorum LB400
MLLGHPVLFKSLCYVDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRYFCLGQLGLPVTESLPAHRLAAATGAAATA

SEQ ID NO: 27775 - protein, 480 aa, Burkholderia fungorum LB400
MSQFANYIDGQWVDGASVSRNVNPSNLDDVIGEFAQADAEQTQRAIRAARNAFAQWSLSTPQQRFDLLDQAGSTILARKAELGRLLAREEGKTLPEAIGEVGRAGQIFKFFAGEALRIGGEIVPSVRPGMTVEVTREPLGVIGLITPWNFPIAIPAWKIAPALAYGNTVVVKPADLVPASTWELVRIIAEAGAPAGVINLVMGQGAVVGEALVSSPQVDAVSFTGSVATGRAIGAKCFASGKKFQLEMGGKNPMVVLDDADLDVAVEACINGGFYSTGQRCTASSRFIVTEGIHDRFIDAMKARMQALKVGDALADGTHIGPVVDDKQLQQDERYIAIAREEGGTIFGGERIERDTRGYFLAPALITDTTPDMRINREEVFGPVASVIKVKDYNEALAVANDTEFGLSAGICTTSLKYSSHFRRHVQAGMVMVNTATAGVDYHVPFGGRKGSSYGPREQGSYAREFYTTVKTAYVSPGAV

SEQ ID NO: 27776 - protein, 265 aa, Burkholderia fungorum LB400
MNPSGNTTPIALKASAIIKSFGQNRILDGVDLSVARGETVCVLGPSGSGKSTLLRCLNWLSPPDDGAIWIGDERIGMRENANGSISPRPDREIRTQRSRIGMVFQSFNLWPHMTVLENVMEGLLSVKRMSRLAASDLAVEALRQVGLSGKHTAMPANLSGGQQQRVGIARTLAMTPEVILFDEPTSALDPELVGEVLGVMRGLAAKDTTMIVVTHEIGFARDVADHVIFMDGGRIVEQGPSKTVLDTPSSPRLQQFLYRFNPETK

SEQ ID NO: 27777 - protein, 300 aa, Burkholderia fungorum LB400
MNLSNDVPPAIRLAAAAAAPSAGVAGNALRSAADTVLQLNGISKSFGENCVLRDVSLTVHKGETVCLLGPSGCGKSTLLRCVNWLEIPDAGTVYVSNQRMGVREGSAIKLRDAELARSRARIGMVFQHFALWPHLTVLQNVMEAPLYVLKRPRDEVRAEAVRLLERVGLAGKMDAFPSRLSGGQKQRVGIARALAMNPDILLFDEPTSALDPMLVGEVLNVMRLLAQEGATMVIVTHEMEFARQVASRIVFMDAGQVIETAHPEQFFSAPQTPRARQFLARFRAPHLTGDEWNQASKLHD

SEQ ID NO: 27778 - protein, 336 aa, Burkholderia fungorum LB400
MKAVQVAQAGGPLELVERDVPEPGAGQVLIKIQACGICHSDVLTKEGQWPGLEYPRVPGHEIAGVIDTVGAGVEEWQAGQRVGVGWHGGHCGHCEHCRRGDFVLCQRALVPGISYDGGYAEFMLAPVEALARIPDDLADVDAAPLLCAGITTFNALRNSGARAGDVVAILGIGGLGHLGVQFARKMGFVTVAIARGQDKASLAKQLGAHHYIDSTAANVAQALQALGGARVILATVTSGKAMSAVVGGLGLNGKLIMVGLSDEPVEVPVAQFIMGRNSVQGWPSGTSADSQDTLAFSALSGIKPMIEEFPLTKAAEAYERMMSGAARFRVVLNTGR

SEQ ID NO: 27779 - protein, 287 aa, Burkholderia fungorum LB400
MAHNLLKAGHAVNVFDLNAQAVQALVDAGAKAAASPKAAVTDVECVITMLPAAAHVRSVLTADDGIFAGIARGVTIIDSSTIDPVSVKAFAELAQQHGNSFVDAPVSGGTGGAAAGTLTFMVGGSASVYEQVKPVLSAMGKNIVHCGDTGTGQVAKICNNLVLGITMAGVAEAMSLGEALGIDAKVLGGIINTSTGRCWSSDTYNPMPGVIETAPSTRGYTGGFGTDLMLKDLGLATDAAKAARQPVYLGALAQQLYQTMSTKGAGRLDFSAVIKLYRQDGKDGGAS

SEQ ID NO: 27780 - protein, 405 aa, Burkholderia fungorum LB400
MSTDRHVIVGAGHAARRAAETLRERDPGARIVMIGAEPHAPYDRPVLSKDALLAEGGEQKAFIRGLEWYAAHGIELRLGTTVESIDRTRNQVRLHDGSSIGYDRLLLATGSRVREFAGPMDERVRLYYVRTLADSLALRAALAPGRKVAILGGGFIGLEVAAAVTQVGCEATVIEPAATLLQRSLPPAASRFVASLHARRGVTLRLGETPLRIGYENRRALIETDRGTLAADLVVVGIGVLPNVELAREAGLQVDNGIVVDAQCRTSDPRIFAAGEVTMHFNPLLGRQARIESWQVAENQPVIAAANMLGDTQEYAEWPWLWSDQFDCNIQSLGMIDASHTLIERGDAHNGPFCVLALDAGRRLRAVVAINAGREMGACKRLVASGKVLDPALLADTAVALRSLL

SEQ ID NO: 27781 - protein, 431 aa, Burkholderia fungorum LB400
MLPVAVAGEGIEIIDSTGKRYIDASGGAAVSCLGHSNQRVIDAIKRQSQQLPYAHTSFFTTEPAEALADRLVASAPQGLEHVYFVSGGSEAIEAALKLARQYFVEKGEPRRRHFIARRQSYHGNTLGALAIGGNAWRREPFLPILIEAHHVSPCYAYREQRADETEEAFAQRLADELERKILELGADTVAAFIAETVVGATAGAVPPVREYFRKIRAVCDRYGVLLILDEIMSGMGRTGYLYACEEDGVAPDILTIAKGLGAGYQPIGATLVSERIYQAIVGGSGFFQHGHTYIGHATACAAALEVQRVIEEDNLLPNVLARGEQLRVRLREHYAQHPHIGDVRGRGLFVGVELVRDRAGKTPFDAALKLHAAIRREAFARGLMVYPMGGTVDGKIGDHVLLAPPFICTARDIDEIVSRLTDAIDGALAAV

SEQ ID NO: 27782 - protein, 340 aa, Burkholderia fungorum LB400
MTLGDTIKGMVGMDPTGHADPDMKAVLDALRSLDPKPIEDCTVAEARQQPTPADAVRKLMSDPAFSARPSLELEAVRTEDIMIPGATGSNPARVYTPQGEGPFPLILYFHGGGWVLADLDTYDATPRSIAAQSRAIVVSAHYRQAPEHRLPAAHEDAFAAWRWVVEQAPKLCGDAGKIAVMGESAGANLAINVAIHARDTGVRMPMHQALIYPVASNNIVSISYEENRNARPLNKPMMLWFLHNVINSESDLTSSLIDVVSADLSRLPPAVVVTAGIDPLRSDGEKLAQKLHSAGVPVEHRNYRGATHEFFGMAAVVQAARDAQAFVSLAQRQAFGGAPL

SEQ ID NO: 27783 - protein, 339 aa, Burkholderia fungorum LB400
MDTRSELQATIKAMVQPGKGLLAADESGPTIAKRFKTIGLESSEENRRAYRNLLLTTPGLGEFVSGVILYEETLGQKADDGTPFPQLAAKNGIVPGIKVDLGKIALALAPGDEITEGLDGLARRFVDYKRQGARFAKWRAVYNITASLPSRLAIEANADSLARYAAISQEAGIVPIVEPEVLMDGEHTIERSAEVTEAVLHAVFHALHRHRVVLEHILLKPSMVIAGSEHAQQSSTADIAAYTVRVLKRTVPSAVPGIVFLSGGQSPEEATANLDAMNRLGALPWNLSFSYGRALQEPPLQAWKGERSHVEQAQQALLKRARLNSAAALGKYEAAQEKS

SEQ ID NO: 27784 - protein, 335 aa, Burkholderia fungorum LB400
MGADMVRRLTKGGQQCIAYDVQPAAVEKLKQDGVAGAASLEDLVAQLDKPRAVWLMVPAAVVDMTLEKLVPLLEPGDIVIDGGNSYYHDDIRRGAELAKRQLHYVDVGTSGGVAGRERGYCLMIGGEPEVVKRLEPVFSTLAPGAGTAPATPGRVSGSSTADQGFLHCGPLGAGHFVKMVHNGIEYGMMAAYAEGLNILRHANAGKHAREADAETTPLRRPELYQYELNLADVTEVWRRGSVIGSWLLDLIAGSLVSDADLKNYAGRVSDSGEGRWTVAAAIDEGVPTPVLSAALFARFSSRGEADFANRVLSAMRHDFGGHVEKAATPADGPKG

SEQ ID NO: 27785 - protein, 472 aa, Burkholderia fungorum LB400
MEAYMSPIAARLERLPFSRFHFKLLIMGGLGFMFEAIDAAIIAFILPVVRTKWHLTSFETGLLGSSTYVGFLVGALFAGLLGDRFGRRVVMMWALTFFCVLTFVNAFVNDWHTFALLRAIAGIGMGAEGAIIAPFLVEFVSNRYRGAFTGALAGFFSFGFVAAALIGYFVIPLNPEGWRIALVIVSLPVIVLLWWRRSLHESPRWLETRGRHEEAAAVVTDIERQIERSGVTLPPVVPVAGDATLHEYSGSFFGNLKLLWKPPLAKTTLMTWCLWLSVTFCSYAFFVWIPGLLVQHGMTITKSFSVSIAIYLAQIPGYYSSAYFCEKLGRKTTIVTYMGLACASGIWLAFAGSDLTIVLASIAMSFSMNGVNAGEYAYTPEVFPTHLRATGMGTASAFGRIGAICSPMLVGYVYPIWGFAGVFGMTTVILLVGALAVLILGVSTSGKTLEQITADEYSLADDLPGASLKTAK

SEQ ID NO: 27786 - protein, 477 aa, Burkholderia fungorum LB400
MSQYRSFINGEWLGTTSTLPNLNPSDLSDVVGEALLADDALVADAIAAARHAFRSWSLTTPQQRADILDAAGTRILQRKEELGTLLAREEGKRLPEAIGEVGRAGNIFKFFAGEALRIGGEVVSSVRPGMTVEVTREPLGVIGMITPWNFPIAIPAWKIAPALAYGNTVVIKPAEAVPACATELVKILEESGLPAGVVNLLLGPGRVVGEALVASPDIDAISFTGSESTGRAIAVKCVTSGKKVQLEMGGKNPLVVIDDADLDVAVEAALDGSFFSTGQRCTASSRLIVTSAIHGQFVAALQRKASELVVGHALDKATQIGPVLDDRQLQQNLKYLKIAAEEGGQVLGGERVERPTRGYFMRPALVIGTDNTMRINREEVFGPVASVIKVADYEEALAVSNDTPYGLAAGICTTSLKYASHFRRHAEAGMVMVNAPTAGVDYHVPFGGRKRSSYGPREQGTYAREFYTVVKTAYVKA

SEQ ID NO: 27787 - protein, 492 aa, Burkholderia fungorum LB400
MDSFNPDDVAIRSGHYIGGEYVEAGGRRIEVARPSDGVVYATVPLADAGMVDRAVENAWQAFRHSGWARMAPRERAKILRRFAELVEADAPTLGRLEALGSTRPIAQAIGWDVPFTAEGIRFYAEFADKLGGDVAATDHDHLGMTIAEPYGVIGAIAPWNFPLVMASWKIAPALAAGNAVVLKPSEMTPFSVLRLAELAVQAGVPAGIFNVIQGDGRVTGDELVRHPKISKVTFTGSTRTGASIMAACANSGTRPVTLELGGKSPQIVFADAPRLDDVARRIAGAITGNAGQVCVAGSRLLVERSLAEPLAERIGKIFAELKPGATWAAGTTLSPIISAPQAARIEGIVGRTLEAGATLRYGGVRADVGSNGAFYTPTLLTNVTAHSEAVREEIFGPVLTLQTFDTEEEALALAQHPEYGLAAGVHTADLGRALRFVRGLEAGTVWVNRYGRTSDFMIPTGGYKRSGIGKDLGRQAYEANLRFKSVLIDLRP

SEQ ID NO: 27788 - protein, 309 aa, Burkholderia fungorum LB400
MLPAYISHRDCVKHEMGPMHPESPDRIGAIHDMLLIKGLLDCMQTYEAPLATEEQLAQAHSLPYIRSIAGMAPLEGYVRVDPDTSMNPYTYQAALRAAGAAVLATDLVLAGEACCAFCNIRPPGHHAKYAAAGGFCFFNNVAVGIRHALNVHGLTRVALIDFDVHHGDGSEDILHADARVLMCSIFEDKLYPFCGNEPRGSNMVNVPLPTRSYGDVFRAAVTEKWLPALEAFRPEMIFISAGFDGHREDDMGNLGLVEADYAWVTGRLVDIARRHSGGRIVSCLEGGYELSSLARGVAAHVRELIGMDC

SEQ ID NO: 27789 - protein, 297 aa, Burkholderia fungorum LB400
MTRALLGFCGLGKMGEPMAQRLANAGHPLRVWNRSGDKATALQASAENCIACDSPANLAAGAEIIMLCLADAAAVEAVAFGADGLTRLARPGTTLVDHSTLAPSQTRVFAQRWHERTGGRWIDAPVSGGTAGAAAGTLAIMAGGDAALIDTLTPVLRAYAARVTRMGDSGAGQSTKLANQTIVMTTIAALAEATRLARHAGIDATRIPAALEGGWADSVLLQTLTPRMIAPPAHASGTIRTMLKDLDAVESLARESGAAMPVAALVRRWLSEAVAQGLGDADISQIVTVEMHTANVE

SEQ ID NO: 27790 - protein, 506 aa, Burkholderia fungorum LB400
MNHAEMQFLTTEFPYKKQYANFIGGEWVKPVGGEYFDNVSPITGEAFTSIPRSREADVELALDAAHRAKTAWGKTSAADRANILNRIADRMEANLQRLAVAETIDNGKPLRETTAADIPLAIDHFRYFAGAVRAQEGSLSEIDHDTVAYHFHEPLGVVGQIIPWNFPILMAVWKLAPALAAGNCVVLKPAEQTPASILVLVELIQDLLPPGVLNVVNGFGLEAGKPLASSKRIAKIAFTGETTTGRLIMQYASQNIIPVTLELGGKSPNIFFADVMNEDDSFFDKALEGFAMFALNQGEVCTCPSRVLIDEKIYDRFMERALKRVAAITQGHPLDTKTMIGAQASQEQLEKILSYVDLGKQEGAECLIGGERNALGGELSKGYYVKPTVFRGNNKMRIFQEEIFGPVVSVTTFRNEEEALEIANDTLYGLGAGVWTRDGTRAYRFGRQIQAGRVWTNCYHAYPAHAAFGGYKQSGIGRENHKMMLDHYQQTKNLLVSYSDKPLGFF

SEQ ID NO: 27791 - protein, 292 aa, Burkholderia fungorum LB400
MIAPLTQAVRGQPVPSIAEPVIEVIDVTKRYGRNIVHQHLNLEVRRGEIMAIVGGSGSGKTTLVRQILGLEHPSSGTIKLFGEDLATISPETALLMRSRSGMLFQRGALFSSLSVFDNIAQPVRELGKVPEDLLRDIVMLKLEMVGLPCKHASKMPSALSGGMIKRVGIARAIALEPELLFLDEPTAGLDPQASDEFVELISALHRALGLTVVMVTHDLDTMIALSTRVAVLADRRVLVAAPVEEAAAVDHPFIREYFLGLRGRRALQALPPERRAKLPRAALEPASSELPL

SEQ ID NO: 27792 - protein, 248 aa, Burkholderia fungorum LB400
MYKLVLIRHGESTWNKENRFTGWVDVDLTEQGNNEAQQAGVLLKDSGYTFDIAYTSVLKRAIRTLWHVQDKMDLMYLPVVHSWRLNERHYGALSGLNKAETAARFGDEQVLVWRRSYDTPPPALEPTDERAPYNDPRYAKVPREQLPLTECLKDTVARVLPLWNESIAPAIKSGRQVLIAAHGNSIRALVKYLDDISDNDIVGLNIPNGVPLVYELDENLRPIKHYYLGDQEAIAKAQAAVARQGKAG

SEQ ID NO: 27793 - protein, 454 aa, Burkholderia fungorum LB400
MSAKPAAAATNVIEVERVLAETHHPAFQLMLLVLCGLCLVIDGFDAQAMGYVAPSVIGEWHVSKAALGPVFSASLFGMLLGALGLSVLADRVGRRPVLIGSTFFFALAMLTTPFVTTIPALIALRFVTGLGLGCIMPNAMALVGEFSTPVHRVKRMMLVSCGFTLGAALGGFISAALIPAYGWRSVFWVGGAAPLLLALAMLVALPESLQFLVLKGHNERALRWLAKFNPMLPIDANTRLVVREKGNDGAPVAELFRAGRGPVTLILWAISFMNLIDLYFLSNWLPTVMRDAGYSPSTAVLVGTVLQTGGVVGTLLLGWFIERFGFVRVLFVCFAGAALAVSTIGTVAHMLPWLLIVVFAGGFCVVGGQPAVNALAGHFYPTALRSTGIGWSLGIGRIGSVIGPLIGGQLIALNWSNASLFHAAAVPVLCSALLVIGLAAATRQRGRPSEPRTA

SEQ ID NO: 27794 - protein, 311 aa, Burkholderia fungorum LB400
MGMTAVYGPPADRQEMIRLIHAAHDRGVTLFDTAEAYGPFANEELVGEALQPIRDQVVIATKFGFDIDPETGKRGAGTNSRPEHIKLAVEKMLRRLRTDRIDLLYQHRVDPAVPIEDVAGAVKELIAEGKVKHFGLSEAGVKTIRRAHAVQTVTAVQSEYSLFWRGPELELLPVLEELGIGFVPFSPLGAGFLTGKIDENTTFDPTDFRNNVPRFSPEARRANMALVEVVKSVADRKGTTPAQIALAWLLAQKPWIVPIPGTTKLHRLEENLGAIDVELTADDLGVIDEEVSKIQVRGERLPEAALKMTGH

SEQ ID NO: 27795 - protein, 329 aa, Burkholderia fungorum LB400
MKTRKLGNSQLEVSAIGLGCMGLSHGYGPAMDRPAAIALIRAAVDRGVTFFDTAEVYGPWLNEEVVGEALAPTRDKVVIATKFGFTFGDDNRQQILNSRPDHIRWAVEGSLKRLRTDVIDLLYQHRVDPEVPIEDVAGTVRDLIAEGKVKHFGLSEAGAQTICRAHAVQPVTAVQSEYSLWWREPETEILPTLEELGIGFVPFSPLGKGFLTGAIKEGTTFGSDDFRSIVPRFSQEALQANQTLVDLLGQIAMDKGVTSAQIALAWLLAQKPWIVPIPGTTKLHRLEENLGAASVELSGDDLRTITRALEQVEVQGDRYPAALQARVGR

SEQ ID NO: 27796 - protein, 405 aa, Burkholderia fungorum LB400
MCPFYADTALNAELWDVEGRRYIDFAAGIAVLNTGHRHPKVMAAVREQLDRFTHTCWQVVPYPSYVELAEQLNRLAPGDFQKKASLFSTGAEAVENAIKIARAFTGRAAVIAFSGSFHGRTMMGMALTGKVAPYKVGFGPFPGEVYHAPYPNTLHGVTTTNALDSVRALFKTDVDPLRVAAIIFEPVQGEGGFYEAPADFVKGLRDICDQHGILLIADEVQTGFARTGKLFAMQHHAVAADLTTVAKSLAGGLPLSGVIGRADVMDAAAPGGLGGTYAGNPLSVAAALAVLDVIESENLCERATQLGNRLKSHLTSMRESLPHIAEIRGPGAMIAAEFFEPGTLIPDADFAKRFQARALELGLILLVCGVHSNVIRFLFPLTIEEAVFEEALVLIETAMKDAAAA

SEQ ID NO: 27797 - protein, 485 aa, Burkholderia fungorum LB400
MRIDHLINGKSGAAKDYFETVNPATQEVLAEVARGGAEEVDAAVRAAKDAFPAWAARPAAERAKLVRKLGELIAKNVPEISETETKDTGQTISQTRKQLVPRAADNFSYFAEMCTRVDGHTYPTDTHLNYTLFHPVGVCALISPWNVPFMTATWKVAPCLAFGNTAVLKMSELSPLTAAMLGNLALEAGIPAGVLNVVHGFGKETGEPLVAHPDVHAVSFTGSTATGNRIVQTAGLKKFSMELGGKSPFVIFDDADFERALDAAVFMIFSNNGERCTAGSRILVQRGIYARFAERFIERAKRLSVGDPLSDSTIVGPMISQGHLAKVRSYIELGPKEGATLACGGLDLPELPDALRKGNFVQPTVFVDVDNRMRIAQEEIFGPVACLIPFDDEADAIELANDISYGLSSYIWTENTGRALRVAAAVAAGMCFVNSQNVRDLRQPFGGTKASGVGREGGTWSYEVFLEPKNVCVSLGSHHIPRWGV

SEQ ID NO: 27798 - protein, 440 aa, Burkholderia fungorum LB400
MWRKNFLLGAATASYQIEGAVNEDGRLPSIWDTFSAIPGKVLAGDTGAVACDHYHRWEADVDMLAGLGFEGYRLSIAWPRVMDTAGVPNRKGLEFYKRLLARLKEKGIATFVTLYHWDLPQHLEDRGGWLNRDTAYRFADYADLMSRELAGSVDGWMTLNEPWCSAYLGYGNGHHAPGLADARYATQAMHHLLLAHGLAMPVLRANDPASQKGVVANIGRGTANSGSAADQRAAHLFEVQHNAWILDPLLEGRYPRDLFELWPGTEPLVLDGDMQTVAAPLDFLGINYYFRTNVASDGAHGFREVPLQGVERTQMGWEVYPDGLRDLLIGFKATYRNLPPIYITENGMASDDKVIDGRVDDMQRISFLKRHLAAVDEAIKAGVEIRGYFLWSLMDNFEWAFGYERRFGVVHVDYATQKRTVKRSAELVSKFLKERKARRE

SEQ ID NO: 27799 - protein, 489 aa, Burkholderia fungorum LB400
MPEVARFLDAGPLGGVIDGRDEQAADGATFETLDPGTGEHLATVAAMGPADVDRAVDAARRAFARSGWATMHPNDRAIWLHRLADEVERRKAIIGQIEALDAGKIEQQAQGDVQSFVDTLRYFNELALNTERRSALPVSGYEAWTTRQPWGACGFIVPWNFPMVLIGWNISPALAAGNTVVIKPAEDTPLSAIYLARLAREIGFPDGVINVVTGLGEIAGAALSRHPGLRRMSFTGSPEVGRMVAEACGRNLVPCKLELGGKGAAVIFDDVNIEETADKLARAITFHTGQVCCDATRWLVHESIFERFVDASVAALQRTKIGYQLDPGAEMGPVVSAKQRERVLGYLERGQRDGARAVLKGGAVDVAGHDGFYVSPALLAGSLENVAAREEIFGPVAFLAPFRDEAQAVELANDTDYGLANSVWSHDPRRASRVAEAMVAGNSWINAHNLFPLGVPYAGVNRSGMGGGVNSVETLFDYWRSQSMVRPTR

SEQ ID NO: 27800 - protein, 483 aa, Burkholderia fungorum LB400
METETDLRRHDLLIDGKRLPPGTGEYSVDIDPATEEPIALVAQGSAADVDAAVHAARAALKVWNAIRSAERGRILMRLAGLMRANLEELAALESLDAGKPIAAVMRQDIPAAIDTLEYYAGWCDKINGQVVPVRPDALTYTLREPVGVVAAIVPWNFPLMIGMWKIAPALACGCTLIVKPAEITPLSALRIGELALEAGVPPGVLNIVTGKGRVVGDALVAHPGVDKVTFTGSPSVGRGILQGAAGNFKRVTLELGGKSANLIFPDANLDNAVRAAAAGIFFNTGQVCSAGSRILAHRDVYDEVVERLAARARSIKVGDPSSRETSMGPLISAAQMKTVLGYVETGRAEGASLVTGGARVGERGFFVEPTVFADVEHEMRISQEEIFGPVVSVIRFDDEADAIRIANGTLYSLAAGVWSADIGRVHRVARDLRAGTVWINTYGYTDVRLPWGGSGDSGFGREHGDVAIENFTEPKAVWLAIDQ

SEQ ID NO: 27801 - protein, 222 aa, Burkholderia fungorum LB400
MNPIGWREYESAPQANPATLEALRELAVSLLSDNMARASGMVGLRPYHQPRAMAGTAVTVHTRPGDNLAIHRAFDFCRPGDVLVIDGAGELTQALMGEIMASFAASLGVQGLVIDGAIRDVGALRQRDFPVYARGVTHRGPYKNGPGEINVPVTVGGTVVHPGDIIVGDEDGLLAIAPADAEAVIAGARRQHAKEMAALKSIADGGFDRSWVVPHRQRMMNN

SEQ ID NO: 27802 - protein, 315 aa, Burkholderia fungorum LB400
MKYKDYYEILGLERSASQDDIKRSYRKLARKYHPDVSKHADAEERFKELGEAYEVLKDPEKRAAYDRMGSDWRNGQDFQPPPNWDEGFEFSGAGSGPGEQADFHDIFEKMFGGARGAHPHARQRSFDARGEDHHAKVLIDLEDAYRGAQRAISLQMPVVDAQGHVSLETRTLNVTIPKGIRAGQHLRLSGQGAAGATPETAGDLYLEIAFRDHPRFQVDGRDVSLELPVAPWEAALGAKVTVPTPDGSVEMTVPAGSASGRRLRLKGKGIPANPPGDLYVILNIVLPPADTESAKAAYDAMRQAFNFDPRAHFYR

SEQ ID NO: 27803 - protein, 239 aa, Burkholderia fungorum LB400
MRDFLIAPSLLSADFARLADEIRDVTAAGADWIHLDVMDNHYVPNLTVGPLVCAAIRPHTSVPIDVHLMTMPVDSLVAGFAEAGANTISFHPEASLHVHRTIELIKSSGARAGLALNPATPLAVLDHVIERLDVVLVMSVNPGFGGQAFIPETLDKLRALRERVDATMQRTGRLLLIEVDGGVKAANIARIAASGADVFVAGSAVFGADDYAQAIGEMRDELERVSDESEGAGVLAVVR

SEQ ID NO: 27804 - protein, 461 aa, Burkholderia fungorum LB400
MQADRTFNIATLIEEQKTGRFAVGLLFWCFLIMLMDGYDQTAVSFAAPAIIKDWHVARGGFGPVFGAGLFGTLVGSFIFGYLGDRLGRKKAIVIGSLFFGVLTWASVWATSLQELMLLRFLAGIGMGGVVPNSVALVAEYAPKRLRATWVTLMFSGFSIGAGSGGLVSSALIHRFGWPVMFAVGGGGSLLVAVLLIFTLPESARLLVVRQRGEETVRALVARLRPDLNIPADAQFVPGEVREKQRFVFRLIFSDGLASITLLLWIVFIANSMALYFLQNWLPILIEGMGVDPRGAGLITTMFSAGGVIGGLILCRFVDRHGVLAIISLPAIGFPVVALLGHGSSQTWLMVAVFAAGFCVVGAQYGLYAVAGMIYPTSFRSAGVGSAISVGKIGSVSGPVVGGLLLSMHLPITQLFYSASLLFVVAAVFSTVLALLYRARFGAQHAAQAAMEPMRRSLARDS

SEQ ID NO: 27805 - protein, 490 aa, Burkholderia fungorum LB400
MWRARAQEIRPEGRAFIDGNYVGALSGRTFATVNPATGQVIAQVAECGEEDVNLAVASARKAFESGVWSRRAPAERKAVMLRFAQLMMEHREELALLESLDVGKPVANAYNGDIVSSATCIQWYGEAIDKLYGETAPAAPDMTTMIVREPLGVVAAVVPWNYPLSMASWKLGPALAAGNSVVLKPAEQSPLSAIRIAALAMEAGLPAGVLNVLPGYGETAGRALGLHMDVDAVGFTGSTAVGKLFMQYSGQSNIKRVGLECGGKSPHIVLDDCADLDAAARAVAAGIFGNSGQVCNAGSRLIVQAAVRDELLEKVAAIARELVPGDPLDPATKMGAIVSDVQHASIMSYIDAGRADGARVVAGGRAARPESGGYFIEPTVFDGVNNDMRIAREEIFGPVLSAITVDSPEEAVRVANDTIYGLAAAVWTSNVTRAQQVSRQLKAGVVWVNCFDRGTMSSPFGGFKQSGFGRDKSMHAFDKYMDWKAIWIAG

SEQ ID NO: 27806 - protein, 172 aa, Burkholderia fungorum LB400
MGFSPTPALAEVRQYKLSRTTETRNTCPYCSVGCGILMYGLGDNAKNAKSSIIHIEGDPDHPVNRGTLCPKGASLIDFIHSPSRLKYPEYRAAGSNEWKRISWEDALDRIAKLMKEDRDANFVETTEDGKKVNRWLTTGMLAASAGSNEVGYLTHKAVRSLGMLAFDNQARV

SEQ ID NO: 27807 - protein, 485 aa, Burkholderia fungorum LB400
MSESATVFKNLIAGEWTESVSGKTFANINPADTRDVVGQFQASVVADAQAAIQAASSAFAQWRRTPVTARARIVNKAADWLESHADTFAQELTREEGKPLAQSRDEILRSAQVLRFYAVEAQSFTGETFPSDDPEQHVYTQREPLGVVTVITPWNFPISIPARKIAPALMAGNTVIFKPSSDAPLIGYRLAEAFAQAGIPAGVLNFITGRASDIGAAITESPVVRAISFTGSTAAGEHIHRSVPITTRTQMELGGKNPLIVMDDADLDRAVDLAVKGGLSLSGQACTGTSRILVMESVRETFTAKLVERVKSLKIGSGVTPGMDLGPLANRKQLESVLGYVASGKEQSTHLIGGEQLTGEGFEHGYYVTPAVFSDVPESARIYREEIFGPVLAITSVTGYDDAIAKANDTEYGLSAAIATSNPRYMHRFADEIEAGTVKINRTTTGNVINAPFGGLKRSSTSTFRESGRAGLEFYTQIKTVYRGL

SEQ ID NO: 27808 - protein, 422 aa, Burkholderia fungorum LB400
MAEAPSTHRFQSLAKSAPVRRLADIEASDVPRFTTGVSEFDRVLGGGLVPGGVVLIGGDPGIGKSTLLLQSLAEIAADKRALYISGEESAAQIALRAQRLSLLEPGSRASELQLLAEIQLEKIQATIAEQRPDVAVIDSIQTVYSDALTSAPGSVAQVRECAAQLTRIAKQSGTTIIMVGHVTKEGALAGPRVLEHIVDTVLYFEGDTHSSYRLVRAIKNRFGAVNELGVFAMTERGLRGVANPSALFLSQHEQSVAGSCVLVTQEGTRPLLVEVQALVDAANAPNPRRLAVGLEQNRLAMLLAVLHRHAGIACFDQDVFLNAVGGVKITEPAADLAVLLAIHSSMRNKPLPKGLVVFGEVGLAGEIRPSPRGQERLKEAAKLGFSVAVIPRANAPKQPIEGLQVVAVERIEQAIDRVRTLE

SEQ ID NO: 27809 - protein, 164 aa, Burkholderia fungorum LB400
MSFATADLCDAHEDQLALGTLRVLEPVFHLFSRAGCFSGEAVTLKVFEDNALVRATLEEKGAGRVLVVDGGGSQRCALVGGNLAQIAQQNGWAGIVLNGCVRDTLELNEVNVGIAALATCPRRGQKLGTGERGVAVQLPGALVRPGEWIYADSDGVLVASAALK

SEQ ID NO: 27810 - protein, 300 aa, Burkholderia fungorum LB400
MAGVLALPAVAFAQSQAYTNGTVNVRAGPASDYPVVTQLPGGVPVSVMGCISTYQWCDVAAPNLRGWVYAGRLSYPYQGSNVPVMTYGTVIGLPIVTFSIGTYWGNYYRGRPWYGQQGRWAHHPPPPAPRPGAGGPPGGPPPGHGGGRPPGGQPGNVGGRPPGGQSGNVGGRPPGGQPGNAGGRPPGGQPGNVGGRPPGGQPGNVGGRPPGGQPGNVGGRPPGGQPGNVGGRPPSGQPGNAGGRPPGGQPGNVGGRPPGGQPGNAGGRPPGGQPPQGGGGRPPGGENGGGGGGRPPDQHG

SEQ ID NO: 27811 - protein, 249 aa, Burkholderia fungorum LB400
MQALPAVLSPGETAFFFDFDGTLVELAPTPDGVLVQPRVIDLLSELRSLTNGAVAVVSGRGIDSIDSFLGIPDLPIAGLHGAERRDANGDTQRIGFHDERLLRMEQVLAQVVNENPGMLLEIKGAAVALHYRNAPDREPVAREATSRLVADYAGAYVLQPGKMVYEIKPKDVDKGRALRAFLDEPPFVGRQPVFAGDDLTDEKGFAVVNERGGLSIKVGPGETMARTRIDSVPALLDWLASIVAAARAA

SEQ ID NO: 27812 - protein, 262 aa, Burkholderia fungorum LB400
MKARLDISDITIAGHAQDITLRSFHPFAHSAMPIVLYFHGGGFVKGSLDETSKPATLIAAQTPAWVIAVGYSLAPEFPFPAATEDAHLALEWAVGNARGYRADPNRIAAVGHDAGGNIAAGLAAIARDRGVRRLSAQALLAPLLDPSMTRLMEGQCPGRSDLAPEDCARSYRAYLPSANHRIHPYAAPLESRRLATLPPTLIATAEQDLVRGDGETYARELITAGVPVEMTRHGGVCHGELISHSPALDGVVEFLRKRLARD

SEQ ID NO: 27813 - protein, 395 aa, Burkholderia fungorum LB400
MESLKTGTDTLFLLLGAGMVLAMHAGFAFLELGTVRKKNQVNALVKILVDFSVSTIAYFFIGYAIAYGVQFFGSAESLAAHNGYALVRFFFLLTFAAAIPAIVSGGIAERSKFNPQLFATFVLVGFIYPFFEGIAWNGRFGIQNWLAEMFGAQFHDFAGSVVVHAFGGWVALPAVLLLGARHGRYHRDGGIAAHPPSNIPFLALGAWVLAVGWFGFNVMSAQTVDKISGLVAVNSLMAMVGGTLTAWLAGRNDPGFSYNGPLAGLVAVCAGSDIMHPLGALVTGGIAGVLFVYMFTCVQNRWRIDDVLGVWPLHGLCGAWGGLAAGIFGLRALGGMGGVSFGAQLVGTLGGIVVATLGGTLVYGAIRLTVGLRLDQEDEYNGADLSIHKISATPE

SEQ ID NO: 27814 - protein, 476 aa, Burkholderia fungorum LB400
MSKEFDVVVIGAGPGGYIAAIRAAQLGKTVACIEKWKNPAGALKLGGTCLNVGCIPSKALLASSEEFENASHHLADHGISVENVKVDIAKMMARKEGIVEKMTKGIEFLFRKNKITWLKGHGKFTGKTDAGVQIEVSGEGETETVTAKNVIIATGSKARHLPNIPVDNRIVADNEGALSFESTPKKLAVIGAGVIGLELGSVWRRLGAEVTVLEALPEFLGAADQALAKEAAKQFKKQGLDIHVGVKVGEVKTTDSGVTIAYTDKDGNAQTLEADRLIVSIGRVPNTDNLGLEAIGLKANERGFIDVDEHCATAVPNVYAIGDVVRGPMLAHKAEDEGVLVAEIIDGQKPHIDYNCIPWVIYTEPEIAWVGKTEQQLKAEGREIKTGQFPFMANGRALGINKADGFVKMIADAKTDELLGVHIISANASDLIAEAVVAMEFKAASEDIGRICHPHPSLSEVMREAALAVDKRALNM

SEQ ID NO: 27815 - protein, 337 aa, Burkholderia fungorum LB400
MKAAVVHEFGAPLRIEEVPVPQVGRGQILVNIKASGVCHTDLHAADGDWPVKPTLPFIPGHEGVGYVAAVGEGVKHVKEGDRVGVPWLYTACGHCEHCLGGWETLCQEQQNTGYSVNGAYAEYVVADPNFVGHLPAAVSFEDIAPILCAGVTVYKGIRMTDARPGQWITISGIGGLGHVAVQYAIAMGLRVVAVDISEDKLALARELGATLAFNASECDPAAAIQKEIGGTHGVLVTAVSRSAFAQALGMVRRGGTVALNGLPPGDFPLPIFSTVLNGITVRGSIVGTRQDLQESLEFAAQGRVRARIHLDRLDNINHVLAELKSGKVDGRIVLNLD

SEQ ID NO: 27816 - protein, 481 aa, Burkholderia fungorum LB400
MAIPSYTDTRLLINGEWCDAASGKTLDVINPATGQAIGKVAHAGIADLDRALAAAQRGFEAWRKVPANERATTMRRAAALVRERASDIGRLMTQEQGKPFAEARIEVLAAADIIEWFADEGRRVYGRIVPSRNLAAQQLVLKEPIGPVAAFTPWNFPVNQVVRKLSAALACGCSFLVKAPEETPASPAALLQAFVEAGVPAGTVGLVFGDPAEISGYLIPHPVIRKVTFTGSTPVGKQLAALAGAHMKRATMELGGHAPVIVAEDADVALAVKAAGGAKFRNAGQVCISPTRFLVHNSIREEFAAALVKHAEGLKLGDGLAEGTTLGPLANARRLSAMSKVLDDARKTGAKVETGGERVGSEGNFFAPTVLTNVSLEADVFNNEPFGPIAAIRGFDKLEEAIAEANRLPYGLAGYAFTKSFSNVHLLSQQVEVGMLWINQPATPSPEMPFGGVKDSGYGSEGGPEAMEGYLVTKAVSVMAV

SEQ ID NO: 27817 - protein, 404 aa, Burkholderia fungorum LB400
MGIGCAPTLDLTQMMAYKASTVEKMSNSIHKLLRKQGVTLIHGDALLAAAGQVIVRKTGGVQQTLSGTALVIATGSVPIPLPFAAFDHMRILDSADALSLGKVPRHLAIIGAGAVGVELGSIWQRLGSRITLIERCDRICHWLDRDVTATLERSLRQRGIDIRVSSDVVGLDKHSDSVSVQLRAAASGKITHIDADRVLVAIGRRPSTAGMNLASVGMQTGYKSTLSQQGPATPVTSMTNGSGIWVIGDAGPGPMLMSKAEEEAIACAERIAGLPGFVSYPSIPYVLHTSPEVAMIGRTEDELRGTGAAYRVGYYPLAANPRAAICGTSEGFVKLLVDADTNLIAGAHLIGPGAADLISQVAIAMEASMICEDFARICHPYPVWSEALRQAAMAAGGWMMHVAI

SEQ ID NO: 27818 - protein, 506 aa, Burkholderia fungorum LB400
MNHADMQFLDVEFPYARQYGNFIGGEWVPPVRGEYFDNVSPITGEPFTSIPRSTEEDIELALDAAHRARKAWADTAPALRANVLNRIADRMEQNLSRIAFSESIDNGKPIRETLAADIPLAIDHFRYFASCIRAQEGTLSEIDHDTVAYHFHEPLGVVGQIIPWNFPILMAVWKLAPALAAGNCVVLKPAEQTPASILVLIELIQDLLPPGVLNVVNGFGLEAGKPLASSKRIAKIAFTGETSTGRLIMQYASQNIIPVTLELGGKSPNIFFADVVDQDDGYFDKALEGFAMFALNQGEVCTCPSRVLIDEKIYDRFMERALKRVAAIAQGHPLDPRTMIGAQASQEQLEKILSYVDLGKQEGAECLIGGERNTLGGELSKGYYVKPTVFRGNNKMRIFQEEIFGPVVSVTTFRTEEEALEIANDSLYGLGAGVWTRDGTRAYRFGRQIQAGRVWTNCYHAYPAHAAFGGYKQSGIGRETHKMMLDHYQQTKNLLVSYSEQPLGFF

SEQ ID NO: 27819 - protein, 464 aa, Burkholderia fungorum LB400
MNDELIAARIDRLPVSRFHRRLLLLVSLPFFFDISDIFTFSYAAPALVKEWGLTMSSIAMLTSAGFFGMFLGATLGGMLSDKIGRKRALICYVIAYSVFSLANALAPDIPMLMITRVLTGVGISSATAVVMAYIAELFPAKTRGTWQSWAMVIALMGIPITSWVARLVVPSGPDGWRWIFVWGALGIVFLVFTKHFPESPRWLARQGRMEEADRTLSLIEAEVVRTTGPLPEAVAINRPAEVRAPWTSMFKGQYIGRTMTLWAIWIFQTLGFYGFQAWVPTLLVQHGITIVHSLTYITLINIGAVPGALIAVFLADRFERKFSIAGAAALIAVFGLLYGLSFQPVLIVSFGFLVGMLIQTFAALCYAYTPEQYPTDIRNTGAGFAYGMGRLANVGNSFIVAGIFMNFGYVWVFVYIAGAWLATAAVTLLFGARTTGRRLESINPVLAQAADNPLDAPILRPGDR

SEQ ID NO: 27820 - protein, 460 aa, Burkholderia fungorum LB400
MGDRSSAGVSGPVTRGSIIARLERLPRNAMQVRARILIGLATFFDGFDVIAIAATLPILIAKWHLTPWEIGFLIGSGSVGQLIGAFVFPWYAERGGRVKAIALSSGIIGITSIACGFAPTFAAFVVLRVIQGLGLGGELPVAATYINEISRAHGRGRFVLLYEIVFPVGLLASNALGAWIVPRFGWQAMYFIGGMPLILFFVLRKLVPESPRWLAERERMADADTAVHAFERAVKGPLPPVTHSAEFEAMANRHPKRRMSDLFGPAYLKRTLAVAMLWITCGFIQYGLSTWLPTIYRTIYHAPLQLALNLAVAASVLGVVGSLTCALLVDKVGRKPIINLSFVACALSLLLAGVFHDSSVYVVATFCAFSLGFLACGFITAYVYTPELYPTSIRAMGCGVGGAWLKVAAIFAPAIVSKTMIGGNLQVAFYILAAVPFLAAVTVHFLGIETKGKVLEQLEA

SEQ ID NO: 27821 - protein, 512 aa, Debaryomyces occidentalis
MRFSTEGFTSKVVAAILAFSRLVSAQPIIFDKRDVGSSADKWKDQSIYQIVTDRFARSDGSTTADCLVSDRKYCGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQSYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVSAGDFGSLSVSISGGMPQVYAPSSVLSGSGICNQ

SEQ ID NO: 27822 - protein, 302 aa, Enterococcus faecium
MFLKKSMLIPEEVGSGHVRVEIKAFSVNPYDVALRLGEMKEIRTLKFPYVPGNDGAGIVTEIGSDVTTVHVGDRVAVHAVGGTYGEEVVLPSAKVAKIPDKMSWEEAAGMVTPGITAYNLINHLTEIQPTDTVMILGASGAVGSSLIQLLHEKGIRILTSASSKNEEKVKKLGASAFAAYDKTNPGLQFADQADLVIDATKGSIKGETGIQIMKPGGRYVALNDLPDLDLRQKKEGFYESFVPRKEYLDAEAFAGIIKAYQKGAFHVFISMNLSASLKHVIQAHQLVEGHPPAGKIILSFEK

SEQ ID NO: 27823 - protein, 440 aa, Enterococcus faecium
MKTYDAIIIGSGVSGLSAAYGLKEAGKTVLVVEEDLWGGTCPNRGCDPKKVLLSAVEARNRVKQLSGKGFNEIPTANWEELQKFKRTFTDPVPESRKKQLAEAEIDHLSGTARFLDDSSIEVNEEVFHADYLVLATGQRPTILPVEGKEYLKTSADFLSLPVLPKEIIFIGGGYIAFELATIANAAGSKVTIVHHNQRPLKEFEASLVEEAVHQMEASGIQFAFGVETQKIISEGTRYRLVGKETELVADMIFCATGRQPNTESLALEQANIVFDKHGIAVNDYLQTSNPKIFACGDIVSRKTPKLTPVATFEGNYVAKRITDATSEPIKYPIIPTIVYASPKLAEVGVTKSHASSSDQVVEMDLTSWFTYHRVNEPVAKAELTFDQQNYLIGAAVISEQADELIDDLTLVINQKLTKKELDSYIMGYPTLASDLSYLLK

SEQ ID NO: 27824 - protein, 468 aa, Enterococcus faecium
MVVGDFAVELDTVVIGAGPGGYVAAIRAAEMGQKVAIIEREYIGGVCLNVGCIPSKALIAAGHHYQESLDSEMFGVTSENVKLDFAKTQEWKENKVVHTLTSGVGFLLKKHKVETIEGEAFFVDDHTLRVIHPDSAQTYSFNNAIIATGSRPIEIPGFKFGGRVLDSTGGLALKEVPKKFVIIGGGVIGAELGGAYANLGAEVTILEGSPQILPTYEKDLVKLVEDDFKKKGVTVVTNAMAKEAVDNGDSVTVKYAVDGKEESVTADYVMVTVGRRPNTDDMGLEQAGVEVGERGLITVDKQGRTNVPNIYAIGDIVPGAALAHKASYEAKIAAEAISGKKVAVDYKAMPAVAFTDPELASVGMTIKEAKDAGIEAKAYKFPFSGNGRALSLGKTEGFIRLVTTIEDNVLIGAQIGGVGASDMVSELALAIESGMNAEDIALTIHPHPSLGEIVMDASELALGLPIHI

SEQ ID NO: 27825 - protein, 230 aa, Enterococcus faecium
MTAIYNSVTELIGKTPIVKLNKIVPEDSADVFVKLEFFNPGGSVKDRIALSMIEKAEHDGLLKPGDTIIEPTSGNTGIGLSMVGVAKGYKVIIVMPETMSIERRLLMKGYGAELILTPGADGISGSIREAERLAKENGYFLPLQFENEANPLVHEKTTGPEIHQAFGVNGLDAFVAGIGTGGTITGAGRELKRVYPKSRINRGRTSRICYFRRERSGTSQNPRNRYRFCS

SEQ ID NO: 27826 - protein, 116 aa, Enterococcus faecium
MCIRKVELIGVEPAESAILEGKEAGPHKIQGIGTGFVPKTLDTSVYDKVLSISGDEAMETAREVGRKEGILVGISSGAAIAAALKVAKELRKGKKVLAVVPDNGERYLSTALYQEI

SEQ ID NO: 27827 - protein, 450 aa, Enterococcus faecium
MKVVVIGCTHAGTAAVKSILKNHPEAEVTVYERNDNISFLSCGIALYVGGVVKDPAGLFYSNPEELSSLGATVKMEHDVTDVDTENKTVTAKDLKTGETETVSYDKLVMTTGSWPIIPPISGIDAKNVLLCKNYNQANEIIAQAKEAKRVVIVGGGYIGIELVEAFVESGKQVTLIDGLDRILNKYLDKPFTDILEKELTDRGVTLALGENVTEFITDEEGKVKQVATPTDTFDTDMVILCVGFRPNTKLIEGKVDTLPNGAIKVNEYMQTSNPDIFAAGDSAVVNYNPSGTQNYIPLATNAVRQGLLVGNNLTDHKMAYRGTQGTSGLYLFGWTIGSTGVTKESATLNDLEVQATVFEDNYRPEFMPTTEKVMMELVYEKGTNRIVGAQFMSKYDITQSANTMSLAVQNKMTVEDLALSDFFFQPHFDRPWNYLNLLAQAALGEIETAQ

SEQ ID NO: 27828 - protein, 432 aa, Enterococcus faecium
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALASILKARGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKNK

SEQ ID NO: 27829 - protein, 251 aa, Enterococcus faecium
MRKPIIAGNWKMNKTASEAKEFAEAVKNKIPSNDKVDSVIGSPALFLQELMTSAEGTELKISAQNCYWENSGAFTGETSPAALADLGVHYVIIGHSERREYFHETDEDINKKAKAIFANGMTPILCCGESLETYEAGKTAEWIEGQITAGLADLSAEQVSNMVIAYEPIWAIGTGKSADAQIADEICGVVRQTVEKLYGKEVSEAVRIQYGGSVKPENIAEYMAKENVDGALVGGASLQADSFLSLLDAVK

SEQ ID NO: 27830 - protein, 397 aa, Enterococcus faecium
MKETGHNTFRTSIQWSHLIPEGTGEINQKAVSFYRDYFTELLDNGIEPFVNLYHFDMPLPLQEKGGWLSRETVDAYVSYAAACFELFGDLVKKWFTHNEPIVPVEGGYLYQFHYPNHINMKEAVQVGYHENLASAKVIKAYHEGGHDGEIGIILNLTPSYPRDETNPEDVKAAKIADAFFNRSFLDPAVKGEFPQELIEIVKELAIMPEIHEGDLELIRENTIDLLGINYYQPRRIKAKETPINHEHSPMPDDYFDNYDMPNKKMNPYRGWEIYEKGIYDILTNTRENYGNIKCYISENGMGVEGEERFVNSEGIIEDDYRIEFVTDHLKYVHQAIQEGTNCVGYHMWTCMDNWSWTNAYKNRYGFIAVDLAQDGKRTIKKSGRWFKTVSEKNGFDA

SEQ ID NO: 27831 - protein, 305 aa, Enterococcus faecium
MIISTITEAIGSTPLYRFDNQHYSMPKGSAIYAKLEYLNPGGSIKDRLGSYLIKEGFAQGKINEKTTIIEPTAGNTGIGIALAALTYKLRTVFVVPEKFSLEKQQLMKALGAKIIHSPSEQGIIGAISKSKKLAEEISNSYLPLQFENKDNPAAYYHTLGPEIFHEIKENIHSFVAGIGSGGTFAGTSTFLKEKYPDIRIIGVEPEGSVLNGGDPAPHEIEGIGVEFIPPFLSPLSINQIETISDVEGFNYTRQLAREQGLLVGSSSGAAFAAALREIRRLPPGHRVVTIFPDAADRYLSKNIYL

SEQ ID NO: 27832 - protein, 388 aa, Enterococcus faecium
MATKRDYYEVLGLSKGASEDEIKKAYRKLSKKYHPDINKEPDAEEKFKEVSEAYEILSDPQKRAAYDQYGHAGTDPNYGAGGAGGGFGGFGGFSGGGFGGFEDIFDSFFGGGGRSVDPNAPRQGADLQYTVDLSFEEAIFGVEKEIKYNREEICHTCGGNGAKPGTQPTTCHKCHGAGTINVERQTPLGRVMSRQTCDVCHGTGKEIKEPCPTCHGSGHEKKAHSVKVNVPAGVEEGQQMRLAGQGEAGENGGPFGDLYVVFRVEESDIFDREGSEIYYELPLSFVQAALGDEVQVPTVHGDVKLKIPAGTQTGTNFRLRGKGAPKLRGGATGDQHVKVKLITPKNLNEQQREALRAFAEAGGIKVEEQQEDGFFDKFKDAFGGKKRK

SEQ ID NO: 27833 - protein, 245 aa, Enterococcus faecium
MAEKILVEHLVKKYGDNTVLNDINVSINEGDVVCIIGPSGSGKSTFLRCLNRLEEPSDGEIIIDGAHLMDKSTDINLVRQHIGMVFQHFNLFPHLSILENIILAPMDLKKESREEAEKKAIKLLQTVGLEDKKDMYPEMLSGGQKQRVAIARALAMNPDIMLFDEPTSALDPEMVGDVLNVMKKLAEQGMTMVIVTHEMGFAKEVANRVMFIDDGNFLEDGTPQQIFENPQNERTKDFLNKVLNI

SEQ ID NO: 27834 - protein, 281 aa, Enterococcus faecium
MLINEQLVKRVITPRPKISHKGTFGRIVLIGGNEQYGGAIIMSALAAVHSGAGLTTVVTDEKNRSALHSHLPEAMIVVWTDTDQFLSVIKQADVLLIGPGLGTSSKSLERFKQVLENQSKEQWLVIDGSALSLLAANHLLLPYPEQTVLTPHQMEWQRLSSLPIQEQRDKENKKKQQEIGAVLVLKSHETKIYGHQHFYTNPLGSAAMATGGMGDTLAGMITGFLAQFPQNDQTIAAAIYLHSFIGDQLAKEQYIVLPTQISEALPKWMNYFCKKSMENEA

SEQ ID NO: 27835 - protein, 162 aa, Enterococcus faecium
MILEYSDQLWVPQIKSWRLNERHYGKLQGLNKKETAEKYGDEQVHIWRRSYDTLPPLMEETDEGSAANDRRYAMLDKRDIPGGENLKVTLERALPFWQDEIAPALLDNKTVLVAAHGNSLRALAKHIEGISDEDIMDLEIPTGQPLVYELNDDLTVAKKYYL

SEQ ID NO: 27836 - protein, 397 aa, Enterococcus faecium
MTTYQRKVLLSTSAGIALENMDIMFLAFSLSSMITSFHISGTQAGFISTITNLGMLIGGIFFGIIADKYGRVKVFSQTVLLFSIASLLMYFASNIYLVYLFRFIAGVGAGGEYGACMSLISESFSKKQIGRASSVAGIGAQVGAALAAILAAVIIPTFGWKMLYVVGVLPVLMVLFIRRGLTEPKEFKSVQSAEKKTKLSRLFESKHLAWQTCGLSIMVTVQIAGYFGLMNWLPSIMQNRLGLSVSGSSLWMVSTILGMSLGMMTFGIIMDKLGPKLAFSLFLICSSLSVYLLVLAHSQWSLVAAAVIVGYFINGMYGGYGAVISSLYPTEIRATANNFIMNLGRAVGGFSSIVIGFLMDHYSLTAVILFLSGIYLVSLLVLTTLTGVTALRESLQH

SEQ ID NO: 27837 - protein, 473 aa, Enterococcus faecium
MSKQQIGVVGMAVMGKNLALNIESRGYSVALFNRTGAKTTAVVEEHPDKNFKATYTIEEFVESIEKPRRILLMVKAGPATDATIQELLPHLDKGDILIDGGNTFFKDTMRRNEELANSGINFIGTGVSGGEEGALKGPSIMPGGQKEAYALVAPILEQISAKAEDGAPCVTYIGPNGAGHYVKMVHNGIEYGDMQLIAESYDLMKNILNLSVEEMADIFKEWNQGELDSYLIEITADILTRKDDEGTGKPVVDVILDAAGNKGTGKWTSQSALDLGVPLPLITESVFARYISAYKEERVQASKILSRTNDFEFTGDKKELVEKIREALYFSKIMSYAQGFAQLRVASKEFDWDLPFGEIAKIWRAGCIIRARFLQKITDAYDKNPEIENLLLDDYFVEITKKYQQSVRDVVALAVQAGVPVPTFSSAIAYFDSYRAERLPANIIQAQRDYFGAHTYERVDKEGIFHYSWYHEE

SEQ ID NO: 27838 - protein, 460 aa, Enterococcus faecium
MAGVTTFFAMSYILFVNPTILSASGMPFQAVFLATIIASIIGTLVMGLFANVPYAQAPGMGLNAFFTFTVVFGLGYSWQQALAMVFICGLINIFITVTNIRKMIIRAIPESLQHAIGGGIGIFVAYVGIKNAGFLSFSADQSAISSSVVEGGKATNVTINGGIVPALANFDNAPILLAVIGLVLTAILVVKNVRGAILIGIVATTVLGIFMGVVDLSSIDWQTNSLGNSFKELGTTFGAAFGSEGMQSLFSDSSKIPQVLMTIIAFSLSDTFDTIGTFIGTGRRTGIFSKEDEIALEDGRGFKTKMDKALFADAIATSVGAIFGTSNTTTYVESAAGIGAGGRTGLTSVVVAVLFALSSLFSPLIAIVPNQATAPALILVGVMMMASFADIKWLDMEEALPAFFASIFMGLCYSISYGIAAGFIFYTIVKVIKGKYNQVSVALWIVDILFIINFIILATI

SEQ ID NO: 27839 - protein, 448 aa, Enterococcus faecium
MAHIHFDYSKVAPFVNEQELGYMQSQVTAAHNELREGTGAGSDFRGWIDLPTNYDKEEFARIKEAAKKIQSDSEVLVVIGIGGSYLGARAAIDFLNHTFFNLLDSNTRKAPQIFFAGNSISSTYIADLIEVIGDRDFSVNVISKSGTTTEPAIAFRVFKELLVKKYGQEEANKRIYATTDKAKGAVKVEADAEGWETFVIPDDIGGRFSVLTAVGLLPIAVSGADIDALMQGAADASKAYSSDKLEENEAYQYAAMRNILYRKGKVTELLINYEPGMQYFSEWWKQLYGESEGKDQKGIYPSSANFSTDLHSLGQFIQEGRRNIFETVVKVEKPRKSITIPEQAEDLDGLGYLQGKEVDFVNTKAFEGTLLAHTDGDVPNLLVKIPEMDAYTLGYTMYFFEIAVGISGYLNGINPFDQPGVEAYKKNMFALLGKPGFEDLAKELNERL

SEQ ID NO: 27840 - protein, 325 aa, Enterococcus faecium
MKVFDYEDIQLIPNKCIVNSRSECDTTVTLGKHTFKMPVVPANMQTIIDETIAEFLAENGYFYIMHRFDEAARIPFIKKMKKRGLITSISVGVKKEEYSFIEKLAEESLNPDYITIDIAHGHANSVIDMIQHIKKYLPETFVIAGNVGTPEAVRELENAGADATKVGIGPGKVCITKIKTGFGTGGWQLAALRWCAKAARKPIIADGGIRTHGDIAKSVRFGATMVMIGSLFAGHEESPGETKVENGIVYKEYFGSASEFQKGEKRNVEGKKIWIQHKGSLKDTLVEMQQDLQSSISYAGGRDLEAIRKVDYVIVKNSIFNGDTI

SEQ ID NO: 27841 - protein, 409 aa, Enterococcus faecium
MAGPSVLIAFLIGGLILYIVMKGLGKIVLSGGDTHHGLSGLIRPYLGAHSADFTDWVYWSMWIINIIAEAVAAASFLQLWFPHIPAWVFVFMLAVLTTIINLYSVRLFAETEYWLAFAKISVIILLIIFATYLVGQQMLGTGVFPTLQQLTDHGGFTPHGMKGIISSLLVVIYSYGGSELIAITVSEADDPKRAIPKAIKGVMGRIISFYIIPLFLLLILFPWNTLAGTNVSPFVMVFEKMNIPFAADIVNFVIVLALFSSINSGVYASSRILFFRLKDRKGSSRKLAVLNKHQVPQRAVLFCTSVLYLGVALSYFVGDKLFGYLAGSLSYTVLLIWIIISAASFVLALRKGTLWDKGISFFALAVLGLIFLGILFTNSIGVTVLTGLLYLFIYFSYQKKNDAFVLTNE

SEQ ID NO: 27842 - protein, 202 aa, Enterococcus faecium
MEQLLPNQLEGAYDRDGKGLSVADAMPGGKQRFAIIGSEEFDWTIDQEKYIYPNHRGIDHYDRFKEDLALFAEMGFKCYRFSIAWTRIFPNGDEGTPNEAGLEFYDQLIDECLKYDIEPVITISHYEMPLHLAKEYGGWKNRKLIDFYERFAQTVLERYSSKVKYWMTFNEINSAFHFPALSQGLVKSNGARRVPKYFPSMA

SEQ ID NO: 27843 - protein, 295 aa, Enterococcus faecium
MKLGFIGTGVMGSAVARHLLEAGHEVAVYNRTKAKADPLVTEGAIWADTPKAVAEQSNILFTMVGYPKDVEEIYYGQSGIFSADISGHILVDLTTSTPSLAEKIAKTAKEKGADALDAPVSGGDLGAKNGTLTIMVGGEEAVYDQVLPLFKEFGTTFTLHGSAGKGQHTKMANQIMIAGTMTGMTEMLVYAQKNGLDLKKVIETLSGGSAANWSLSNYSPRILKEDYTPGFFVKHFIKDLKIALEEAEKMDLVLPATTQALKLYEELADKGFENDGTQALIKLWWPEGKIPEKKS

SEQ ID NO: 27844 - protein, 423 aa, Enterococcus faecium
MVEEIEQDTTDRRTRTSLTGEKAKPTKIADVVPKKEPRIKTKLEELNRVLGGGVVPGSMVLIGGDPGIGKSTLLLQVSQQLAAIGGKVLYVSGEESAEQIKLRAERLGSINTEFYLYAETDMNEISRAIEHISPDYVIIDSIQTMTQPDITSVAGSVSQVRETTAELLKIAKTNGIAIFIVGHVTKEGSIAGPRMLEHMVDTVLYFEGEQHHSFRILRAVKNRFGSTNEIGIFEMHEHGLEEVANPSQIFLEERLDGATGSAIVVAMEGTRPILVEIQALVTPTMFGNAKRTTTGLDFNRVSLIMAVLEKRAGLLLQNQDAYLKAAGGVKLNEPAIDLAIAVSIASSYKEKGTQPTECFIGEIGLTGEIRRVSHIEQRVKEVQKLGFTKVYLPKNNLGNWEAPKGIEIVGVATLAETLKRVFR

SEQ ID NO: 27845 - protein, 181 aa, Enterococcus faecium
MLEKDIERILISQEEIQVRCKELGKELTEIYQNTNPLVVGVLKGAVPFMADIVRSIDTYLELDFMDVSSYGNATVSSGEVKIVKDLDTNVEGRDLLIVEDIIDSGRTLAYLVDLFKYRKAKSVKIVTLLDKPEGRVVNIEADYVGFNVPNEFVVGYGLDYAEAYRNLPYIGVLKPSVYQSN

SEQ ID NO: 27846 - protein, 466 aa, Enterococcus faecium
MKKEKKVSSSFIYFFGAFGGILFGYDIGVMTGALPFLQHDWGLAGKASLIGWITSSVMLGAILGGSLSGLLSDKLGRRKMILLSALIFMAGSVLSASAPHNGSYFLIAARILLGLAVGAASALVPAYMSEMAPARLRGRLSGINQVMIASGMLLSYVADYLLKGLPETMAWRVMLGLAAVPALILFFGVLALPESPRFLMQSGRLEEAKRVLNYIRTPKEAEQEFEQIQLNVKQEKTTGTSWHTLFLEKYRSLVIAGIGVAVFQQFQGANAIFYYIPLIVEKATGHAASDALMWPIIQGIILVAGSLLFLVIADKFNRRTLLKIGGSVMGLSFILPAVLGTVLDAHTNSLLILLFLCIYVAFYSCTWAPLTWVIVGEIFPLAVRGRASGLASSFNWIGSFLVGLLFPVMTASMSQEIVFGIFGIICFLGVLFIQEIVPETRGKSLEEIEQSASKKTYPKRISIHHS

SEQ ID NO: 27847 - protein, 490 aa, Enterococcus faecium
MNNTYPDDSLTLHTDLYQINMMQTYWELGRADLHAVFECYFREMPFNHGYAVFAGLERLVNYLENLTFNDSDIAYLRGLEVYPEGFLEYLQNFEFKATVRSAREGELVFANEPLIQVEGPLAHCQLVETALLNMVNFQTLIATKAARIKSVIGEDPLLEFGTRRAQELDAAVWGTRAAYIGGADATSNVRAGKIFGIPASGTHAHSLVQSYGNDYEAFMAYAKTHKDCVFLVDTYDTLKSGVPSAIRVAKELGDKINFQGVRIDSGDMAYISKRVREQLDAAGFTEAKIYASNDLDEATILNLKMQKAKIDVWGVGTKLITAYDQPALGAVFKLVSIEDDEGKMMDTIKLSSNAEKVTTPGKKQVWRITRNFDGKSEGDYVTLWDEDPREEEAIFMFHPVHTFINKTVRDFTARPVLQDIFIEGKRVYELPALNEIKEYTKENLDSLWEEYKRDLNPQKYPVDLSTECWNHKMAIMERMKKSVAELHTEA

SEQ ID NO: 27848 - protein, 327 aa, Enterococcus faecium
MRAISIKHPGSVDVLEQIEVPVPKPKQGELLIKVHTAAVNRTDIMKRESVSLKPPYPILGVEVAGEVVENKSDISTFTPGTKVYGLVNLGGYAEYAVMPADRAILLPDTLDYVSAAGISEVFLTAYQTLYWLGKLQEGETVLIHAGASGVGTAAIQLARQLSHAKIIVTAGSEEKLAFCKELGADELINYKKQDFQEEVRKITEGRGVDVILDFIGASYWEKNLASIAVDGRWVLIGMLGGTIVPEIDLGVLIGKRVQLLGTLLTPRSDQYKAELAQTFMQKAGPFLENGKIRPIIDRTFQFSAVKQAHEYMEANKNIGKIILKITE

SEQ ID NO: 27849 - protein, 443 aa, Enterococcus faecium
MMEKYQNIVIGFGKGGKTLAKALASKGESVLVVEKSTRMYGGTCINIGCIPSKSLIFNGERGIDFTEAVARKEKLTGMLRAKNYHMISDEATGTVMDGTARFLSNHQIEVTNNGEKVIVEGERIFINTGSEPIILPIKGLNTSRYLIDSTQAMDQEQLPEKLVIIGAGYIGLEFASMFNEYGSKVVVLDAHSEFLPREDEDIAQMILEDMTNAGIEFHLGVSVDQVADQESTAAVTFTEDGQEVTIQASKVLAATGRKPSTASLGLENTDVKLTDRGAIAVDEYLRTDADNIWAIGDVKGGLQFTYISLDDYRIIMDQLKGENKRTTNNRKAVPYSVFITPTLSNVGLTEKQAKAQGVNYKLFKYMTSGVPKAQVLEDPKGVFKVLVDPETDLILGASIYAEDSHEVINLISLAMNGKLPYTLLRDQIYSHPTMSEALNDVLK

SEQ ID NO: 27850 - protein, 456 aa, Enterococcus faecium
MEEEKLTRSLSARHIQMIALGGTIGVGLFMGASSTIRWTGPSVMGAYAIAGFFLYLIMRALGEMLYVDPSTGSFANYASEYIHPVAGYLTAWSNIFQYIVVGISEVIAVGSYMNYWWPDLPAIIPGIIVVLFLMLANLISVKAFGELEFWFSIIKVITIILMIIAGLGVILFGFGNHGQAVGISNLWKNGGFFTGGVKGFFFALSIVVASYQGIELIGMTAGEAENPKKTIIEAVQSTIGRILIFYIGAIFIIVSIYPWNQLSEIGSPFVQTFSKVGITFAAGLINFVVITAALSGCNSGIFSASRMVYTLAINGKMSKKFLKLSRHGAPFYPVVAISGGILIGLILNYLLPMFINQSENIFVFVYSSSILPGMVPWVVILISEIRFKKKHADKMHDHPFKMPLSPYTNYVTLAFLAIVLIFMFINPETRISLIIGLVFLLYMTIHYFVREKRTGK

SEQ ID NO: 27851 - protein, 300 aa, Enterococcus faecium
MEIGVIGLGKMGLNLALNLKEHHHKVQGLDISSTAVSQARENDIPAYQEISEFLATFEQKKIIWLMLPAGEITENMLRKLFPKLGPGDIIIEGGNSYYKDSIRRAEEFQKNEIGYLDCGTSGGIEGARHQACLMIGGDKETFLSVEQLFKDVAIERGYLYAGASGSGHFLKMIHNGIEYGMMQAIGEGFQLVQKSEYAFDLEQVARVWNHGSVIRGWLMEIMEDQLNEHPNLSNYRGIVSASGEAKWTVETALEMAVPVPVIATSLFMRNLSQEEDSFSAKVVSALRNGFGGHEIVEKGE

SEQ ID NO: 27852 - protein, 445 aa, Enterococcus faecium
MYDILTFGASIDELNTEAIQQAIDAAASDGGGTVVVPAGEFLTGALFLKSNVELHLSAGAVLKFSDDPKDYPVVHSRWEGVHRKVYASCIYAQNVENISVTGFGTLDGNGKKWWHTFRNEPDNLAYPRPKLMSFHNCHRITVKDIKLIQSPSWTINPILCSNATFDNLTILNPADSPNTDGIDPESCKNVRISNCHIDVGDDCIAIKAGTEDTYERIACENITITNCTMVHGHGGVVLGSEMSGSIRNITISNCIFQETDRGIRLKSRRGRGGIVEDIRVSNIVMDNVMCPFILNLYYFCGPRGKEPYVWEKKAYPIDERTPAFRRIHFSNITARNVHASAGFIYGLAEQFIQEITFDNIDVSMAQDAVPGVPAMMTGIEEMSRQGFYIGFAGKVSFNQMSIENHEGPAFLLENTKEISIEKFQSNQSENMDELVVRKNFAYAVE

SEQ ID NO: 27853 - protein, 325 aa, Enterococcus faecium
MKKFAITALGRACIDLNSVEINQPMEETKTFKKYVGGSPANIAIGLAKLGETVGFIGKLSNDQHGRFIKDFMSKAGVDSSQMIFDQEGHKSGLAFTEIKSPSECSILMYREDVADLYLTPDEVSEEYIEASEMLLISGTALAQSPSREAALLAVEYAHKHDVKVIFELDYRPYTWGSTAETAVYYTLLAQKAHIVIGTRDEFDVLENSVGGNNQQTVERLFQYTPELILIKHGVDGSFAYEKDGTITRGYAYKAQVLKTFGAGDSYAAAFLFALMQGKMIENALQYASASSALVVSRHSSSEAMPSVSEIEAVIAEQSWGEKVHA

SEQ ID NO: 27854 - protein, 464 aa, Magnetococcus sp. MC-1
MTSESQPQVTQTRKFFGTDGIRGMANIHPMTPDLVLKLGRAAGHVFRVGDKRHTVIIGKDTRLSGYMFESALLAGLTSMGIHCLQVGPLPTPAIAFLTRALRADAGIMISASHNPFHDNGIKFFGPNGMKLPDELELEIERVLLSDEDLPMPTPHHLGRAHRIDDALGRYIEFAKTSFPKDLRLDGLRVVVDCAHGAAYKVAPAVLWELGAEVVTLGNHPNGTNINDGVGSLYPQEMVKRVQEVRADVGIAFDGDADRVVICDERGEILDGDVILAMSALEMKRKGVLRGDGVVATVMSNLGLERALAAEGLTLARTKVGDRYVLEHMLAHGFNLGGEQSGHLIFLDHNTTGDGLISALSVLALMTTQAQPLSKLANVMQRVPQVLQNVTIARGSDPMDDSRVVAAIAEAEAQLGTRGRILVRKSGTEPKVRVMVEGDDTAHITALASGVCEAIKRASNGFGEG

SEQ ID NO: 27855 - protein, 402 aa, Magnetococcus sp. MC-1
MNGPSMEEFHRIKRLPPYVFAVVNELKYKARNRGEDIIDFGMGNPDQPTPKHITDKLIEAVQDGRNHRYSLSRGIGGLRRAVCAYYKRRFGVDLDPESEAIVTIGSKEGLSSLAMAITEPGMNVIVPSPTYPIHEYSFLIAGAHIQRVKISRDNDFIEDMKVAVRNHWPRAQVLVVNFPSNPTAQVVELDFYQKVIDFAKEHNIWVISDVAYAEICFDGYKAPSILQIPGAKDIAVEFYSLSKTYNMPGWRVGFCVGNPHLIKALSRIKSYLDYGMFQPIQIAATVALNGPQDCVAEINEIYRQRRNVLIDGLARAGWAIERPKASMFVWAEIPDEFKAMGSLEFSKLLLKEAKVAVSPGVGFGVYGDDHVRIALIENEHRTRQALRSMRRFLSAGSDVAGD

SEQ ID NO: 27856 - protein, 207 aa, Magnetococcus sp. MC-1
MSLHACWSCKGPVEASAFCPTCGAIQPPQRDQSLFEFLGLPPSYGVDPQALEAACLRLQQQFHPDKFATQADTARRYAMEYATRLNEAKQILSAPLQRAIYLLEQLGGTASHASGGGQDPMFLMEVMELRERLEELDAESETVWDKLEALKHEVTALAEEEIAALSSGFAKQDGDPEWWVVLARHIDRLRYHTKFLEEVDRFEERLF

SEQ ID NO: 27857 - protein, 129 aa, Magnetococcus sp. MC-1
MEKLPDLATLKYNEQGLIPAIAQQYDTGEVLMMAWMNQTSLAETLSTGVACYWSRSRNRFWRKGESSGQVQTVKAVRLDCDKDTLLLLVDQQGVACHTGRHNCFYLEAQDGSWKTITDPEIDPEELYGK

SEQ ID NO: 27858 - protein, 278 aa, Magnetococcus sp. MC-1
MVAFQGAHGAYSEQACREKLPGYQSRPYKTFEDIFIAVEQGDAELGMLPVENSMAGVVSDSYDLLAVHNLHIIGEYYLPVRHCLMAHQGVNVERIHTVYSHPQALAQCHSFIKRHGWNRVAVYDTAGAAAALKEEHREGEAAIASALAAELYGLDLLAEQIQDSANNTTRFLIIAKDGIIPMPNVGCKISLLFEVRHIPAALYKCLGGFATNGINLTRLESRPVAGRDWSYHFYLDFQGRMDQVNVQQALEELKFYTHNMKVLGCYPESLRPESQGAL

SEQ ID NO: 27859 - protein, 255 aa, Magnetococcus sp. MC-1
MRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVASTAQAQEAHAFIRGLLAKELGANVADAVRILYGGSMKPDNAKELLGQADVDGGLIGGAALKANDFLAIMDGLTA

SEQ ID NO: 27860 - protein, 232 aa, Magnetococcus sp. MC-1
MMRLIKPSALAFCLVVAMTPGFGMAGKLESSKDRLSYALGADLADSMTENGFDVDPDILIMGLRDKLAGQALQMSPEEMQKAMKEEILRRRALVTEKKDSLKKDNLKEAEAFLKENGRKPGVRTTMSGLQYKELKAGTGAKPANRTAKVKVHYEGRLLDGTIFDSSYKRNEPVEFTLSQVVMGWTEGLQLMKTGSIYELYLPPHLAYGEAGRPPVIAPNKLLIFKVELLEVK

SEQ ID NO: 27861 - protein, 208 aa, Magnetococcus sp. MC-1
MGPPGAGKGTQARKISEKYGIPQLSTGDMLRAAVAAGSEVGLRAKAAMESGSLVTDEIVLGIIQDRTDEADCDQGYLLDGFPRTLAQAEGLDAMLAKRNQSIDVVIDIKVEDEPLVARITGRSSCEKCGEGYHDSFKPSAQPNVCDKCSGTLKRRADDNADTVRNRLEVYHKQTAPLIGYYDAKGLLKEVDGMQEMGKVLEDLCAILG

SEQ ID NO: 27862 - protein, 419 aa, Magnetococcus sp. MC-1
MYWGSKLLKYVGFPTSKVLGPEASAGELQSMIDEAGGLLVKPIFKGGVGKKGKAGLLGIAKDVQTALKEKERLYFAEHQHGNAYAKAEGVTFESFVEAKYEVYFSITDSTKYRAPTVTITHHGGVDIEELPPEKIATVPFDPLTGFKGFVVSNALTRLGAPNEIISPLVQNLPKLWDLYHNYGMTTLELNPIRMMPDASGRLVPVACDFKCSFDGDDPNVERLNLPTDLDMADYSNFEMEVNQLRTYQGQSDVYVINDQGSITAMTFGGGANALVTEQLGDRATISSDFGGNPPYQKMYDISRITMKYWIKQSNVFFIIGGKANNTDIFETFRGMADALREYFGEYGPTPLYVVVGRGGPNLIRGMGYLKDTLDALGLPYRFFGYDSAMSEVVNYAKDIDDWMANGGRQQVADKLGCDA

SEQ ID NO: 27863 - protein, 259 aa, Magnetococcus sp. MC-1
MSRKSALEGHIKDKLQQQDILLMSHIVLGYPSLQANREVIRAMVAGGVDLMELQIPFSEPIADGPTIARANQAALDGGFKVREGLAFIREVVAAFNIPFLIMTYTNILMAYGVERFIDEVADIGVKGLIIPDLPLEQAQAAIEQCRAKGMDWIGLMTPTSVDERLGKIGAAADGFVYCVARRGVTGSKTSFDEHVGAFMHRCRQATPVPLAVGFGVRSAEDVDYLKGKAEIAVVGSAALDLFDQAGAAALEPFFRGLRG

SEQ ID NO: 27864 - protein, 1457 aa, Magnetococcus sp. MC-1
MWPGNPFPLGATWDGRGVNFAIFSEHAERVELCLFGPDGFRETARISLSEYTNQVWHGYLPDVRPGQLYGYRVYGPYQPEHGHRFNHNKLLLDPYAKLLNGQLQWHEALFGYRYDDPLGDLSFSDLDSAPYVPKCVVVDTAFTWGGEQPPNVNWLDSIIYEMHVRGFTMQHPKVPQNQRGTFAGLCAPEVISYLQDLGISSVELLPVHASVDEWHLAQKGLSNYWGYNTLAFFVANPRFASGPDAIREFKTMVQVFHEAGIEVLLDVVYNHTAEGNHEGPTLSFKGIDNKAYYKLEPGYNRYYRDFTGCGNSFNLRHPKVLQLVMDSLRYWAGEMHVDGFRFDLTTTLAREADGHFDRHSGFLDAIAQDPLLSRKKMIAEAWDIGDGGYQVGNFPPGWGEWNDRYRDAIRRYWKGDKGMAGELASRLTGSSDIFNHNGRRPWSSINFVTAHDGFTLRDLVSYNHKHNSDNLEDNRDGRDANDSWNCGVEGASEEPAIRILRLRQMRNFLTSLLLSQGLPMLVAGDERGRSQNGNNNPYCQDNDISWVNWDEHDEEAKELLSFTRFLIKLRREHGVFHRHSFFNGQKITGLEVKDVVWLRPDGREMERCDWDNVHTLCLGMLLSGEAGEKFLSRYGDAQVDDTFLLLLNSHHEPLPFHLPEVEDGSGWTRLLDTMERGGGCDEPQPGIVNSYQMGGRSAVLFVLQRRERAVEVKPKPATSGDEHELLRQLAEAAGIDRGYWTVFGEWFDLPDASLRSFLGAMDLAADNQGQIRASLTRLEEEPWRRAMPPVVMCRYPCTGVDIAIVVGAEMVDEALEWVLVDEAGHIIPGKVVPSDMPLDGERLVDGQHLERRIFHLYQKLEVGYYRFELHGAGLPDGDFASMRLVVAPSRCYLPKALEKNDGRIWGFSPQLYALRSQRNWGIGDFEDLKQLVEITASHGGGIIGLNPLHTLFLTRPEQVSPYSPNSRHYVNPLYIAPEQVPEMESCEEAQIRLNSPGVRRLLNKLRESEMVDYVEVSALKLSIMRLLYGVFRDKHMTPDKSCVTSPRGLQFRAFVKAGGDALMRLAVFNALSVQFAQTGEDVGGWRSWPTPYRRPDSPEVRRFMQEQEEEVFFYLYLYWIADTQLQEAKASAQQQGMPVGLYADMALGVDPDGADFWNEQSAYAGDMRIGAPADLFNPKGQNWGLPPFDPRALRAQGYQPFIDALRNTMRHAGAIRLDHVMSLARLFWVPVGAPATEGGYVRYPVEDLLGLVALESQRNQCTVIGEALGTVPEGFREKLAENGILSYRLLYFERAEEGRFLQPHEFNTRSLVAATTHDLPTFSGFWEGVDLAVKEQLDLYPNEEMAVRFRGERVHDKMKLREALQQVGIPLTEQFEQADATPELIEAVYRMLARTPAHLLMVQLEDVLQQKEQVNLPGTVNEHPNWRRKLPADLEALVQDPRFKGLTKMLNSERPPL

SEQ ID NO: 27865 - protein, 170 aa, Magnetococcus sp. MC-1
MELIEGPMRTYMRNAGPALSPFNAWVLYKGLETLGLRVERHCANAMQVAQALFERADTTHKVRYPGLESHPQHGLACQQMRGFGGVLCLDLEDRARAYAFMDRLQLATITANLGDSKTLVTHPASTTHARVPQKERIEAGIGEGLVRFSIGLEDAQDIVDDLMQALPSVA

SEQ ID NO: 27866 - protein, 4072 aa, Magnetococcus sp. MC-1
MAGDGIMAEDTGNQTPKVQVAADDGEEARQNLDDMTVLQNDNSVNLDAEQQQGHDGSRNQNEDLQSMSTIQMGSRVIPNESVTTDAEIAAVESGTVEVEKTDNEAPVQAESNIADAQGSEGGDFAITPPTAGIASQAGFQFGLPETEAAIPANNESEPNAAVDEPAAIATPEQTAFAPESTTPEVVEEEVAAEEEAVVEEETPDETEVDDTLLADGITLTPEAAAGNEDGWIDINLNVSQEDGAEQLVVKIEGVPEGSEIRSDAADAFLAENPDAENPIVDNGDGTWTITGDFADGLQLLPPADSNEDFTLNVTATTTETSSGLSNTVTADLNVTVASVADAPDLSAADATGNEDATTIPLNIETAITDMDGSESITSVVISGVPDTVTLSAGTDNGDGTWTLEAGDLDGLSATVDGNVSGVFDMGVTVNVLDVDGDSGGDDTTSASTSFTLTVNPDADEVTFTAGSASGAEDSWIDVNSSFAVTDTDGSEAVTGVTITGIPEGATLQMADGTPIEITDGSATLSMDQVTDNGDGSYSLAGLQVMAPADSNENFELGIRVTTTDDNGATTDTEITNGTISVEVASVADAPELSAGDVTGGEDATTIPLDIASAVTDMDGSESITSVVISGVPDTVTLSAGTDNGDGTWTLEAGDLDGLSATVDGNVSGVFDMGVTVNVLDVDGDSGGDDTTSASTSFTLTVNPDADEVTFTAGSASGAEDSWIDVNSSFAVTDTDGSEAVTGVTITGIPEGATLQMADGTPIEITDGSATLSMDQVTDNGDGSYSLAGLQVMAPADSNENFELGIRVTTTDDNGVSTDSEITNGTISVEVASVADAPELSAGDVTGGEDATTIPLDIASAVTDMDGSESITSVVISGVPDTVTLSAGTDNGDGTWTLEAGDLDGLSATVDGNVSGVFDMGVTVNVLDADGDSGGDDTSSASTSFTLTVNPDADEVTFTAGSASGAEDSWIDVNSSFAVTDTDGSEAVTGVTITGIPEGATLQMADGTPIEITDGSATLSMDQVTDNGDGSYSLAGLQVMAPADSNDNFELGIRVTTTDDNGATTDSEITNGTISVEVASVADAPELSAGDVTGGEDATTIPLDIASAVTDMDGSESITSVVISGVPDTVTLSAGTDNGDGTWTLEAGDLDGLSATVDGNVSGVFDMGVTVNVLDADGDSGGDDTSSASTSFTLTVNPDADEVTFTAGSASGAEDSWIDVNSSFAVTDTDGSEAVTGVTITGIPEGATLQMADGTPIEITDGSATLSMDQVTDNGDGSYSLAGLQVMAPADSNDNFELGIRVTTTDDNGATTDSEITTGTISVEVASVADAPELSAGDVTGGEDATTIPLDIASAVTDMDGSESITSVVISGVPDTVTLSAGTDNGDGTWTLEAGDLDGLSATVDGNVSGVFDMGVTVNVLDADGDSGGDDTSSASTSFTLTVNPDADEVTFTAGSASGAEDSWIDVNSSFAVTDTDGSEAVTGVTITGIPEGATLQMADGTPIEITDGSATLSMDQVTDNGDGSYSLAGLQVMAPADSNVDFELGIRVTTIDDNGATTDTEITNGTISVEVTGVADDPSLTVNDTTGTEDQAITLDISGGLADVDGSETLVVTIGGVPAGAQLSAGTDNGDGTWTITSTGDAPVDFSAIQLTDLPEDYSGKFDLDVSWNLNDVGDDGVTVDDSLNGSSSFTVTVNPDADAPDLNVGDVVGQEDATSIPLDIAAAVTDTDGSESITSVVISDVPDTVTLSAGTDNGDGTWTLSVGDLDGLSATVDGDVSGVFNMGVTVHVLDDGANSGGTDTTSVSSQFTLTVNPEADGVEITAGSASGREDQWISVNEPTFALQDTDGSESVTGVTLTGIPDGTEIRLADGTEITVNADGTAVIPMGAVTETATEGTFTIDGLEIKAPSDSNVDFSLGITVETTDSNGVTTDTVLDSGAIHVEVTSVADTPDLVANNVAGNEDAATIPLDIAAAVTDMDGSESITSVVISGVPDTVTLSAGTDNGDGTWTLEAGDLDGLSATVDGDVSGVFDMGVTVNVLDADADGAAGDDTTSRSTSFTLTVNPDSDGVSIVDGSASGLEDQWISVNEPVFTLLDTDGSEHVTGVVITGIPAGAELQMSDGTPINVNNGRATIPMDYVVEGDAENSYTINGLEIKAPADSNVDFELGIRVTTTDSNGVTNDTARTNGTISVEVTGVADDPSLAFNDTTGTEDQAITLDISGGLADVDGSETLVVTIGGVPAGAQLSAGTDNGDGTWTITSTGDAPVDFSAIQLTDLPEDYSGQFGLDVSWNLNDYAEDGVTVDDALSGSSSFTVTVNPDADEVSVTSSASGSEDSWIDVSTSFAITDNDGSESVGSVTFSGLPAGASLQIVDPDSGDIIDLGTSTGTGDSFTIPAEYVVTSDHENFEVVGLQVQAPADSNVDFNMNLNVEVTDDNGITTDTITSTNAVHVEVVGVADGVQNMADAQDVDVREDNWFYLNSSSNGPGISSDLIDTDGSEQIFYQINADSSDVKLQVKVGNNWTTQSTDGDGNWNVSAADVDSGKVRMYGGSNEDSDFTVNVNAYTKDFAEDGSTVDDVSSLQSTSFSVNVQSDADGTKISFSGAGVEDTAITINNSIQLNDTDGSESLQGPVIISGVPEGATLSIVGDNAGFIHDNGDGSYSIDQEALSPTANNAHGDYKWEIPGLTFTPAENDSTDVKLTFTTTTVEATDDGNGYATQLTSKAVTIRVDADADGATINTVDAHGLEDHAISLEPTITLNGDIDGSETILGDVIITSDDPGAAGATMVVNGVTIQSSSHTVTTPVTDGAGNVVLGDNGKPQTTTETTTTWRVPTALLSVTVDGDGNTTGWTFDTMTVTPPENSDADFQLDFALVISDDGQDTAMATGSIHVEVDAVADAPELSVGNVGGTEDTAISLNINAALVDVDGSESMSVVIAGVPSGAMLSAGTDNGDGTWTLEPGDLQGLTITPPAQSNDAMHLTVTATSTESNPTTDQDAGTVDTPSASTSASFSVTVIGDADAAEFGDLSASMVEDQVVAGAPNGSVLLDLTSITLGADADDNSEQLSVVLSIPNDAPAGTYLWAPEADDLSYAGNGNWVVSEDAMGSIRLVTPEDYSGEINVDVAITVTERGFQVDDQGNLMLDGNGERIELTGGDKWTTTEQFHVTVIADADEPHISIQAAGHEDMDGGIPFTISPSVTDGNAHGGAEVITSVTVSDIPANVVLMQDGLPLTPDADGNYVFEPDNLDGLTLVTPTHSNEDFQVTVTATAMDNNGDVESNSVVHTVDVVGVADGVNDLVAGQSADATALVLQIAKGTNSAHAGEFEIFIDGESVGTYQTDVFHNNGNDAWDTLTINDVDFSQVDPNSITFQPTSNQSNILIKGVEIAGHTYDPTNGSGDFSVNGDGDGGDYVRMAGNGKELSLDLSGTDFSDMPLNNDIASDGVHQIPIQIESTMIDQDGSESRYYIVSDVPDGAFLAAGVDSDGNAIHAGINAGEGQWIVTEDQLGALHIVPQGGLVTGDHFDITVTAVTVENDGDVNFDSHVTVSIHIDTDLDQSYNPGPGNGHPNSDVAWDGEVSGVSISSGGVGNEDSSIDMGITATSLQGNAGGNDDNDNQGQGSGNHGSGNDGQGSGNHASGNSGQGSGNHGSGNHGSGNHGSGNSGQGSGNHASGNSGHGSGNHASGNSGHGSGNHSSGNSGHGSGNHASGNSGHGSGNHSSGNSGHGSGNHASGNSGHGSGNHSSGNSGHGSGNHSSGNSGHGSGNHASGNSGHGSGNHASGNSGHGSGNHASGNSGHGSGNGGQCSGGHGQNSGNNAIEPPPAADAGNAQSSSAGSEITSFVIADADLPEGASLSAGIFNPLNGTWVFTAEQVETLEVTPPEDFSGEMNIPMQAITIDVNGQELVQDHIVTVDVNAITDGPNIHISPVGGMEDSAIEIQVTLNMPDADGSETLSGVVIVEGVPEGATLSLGEQNPDTGNWEIPVAELTVTGSAEDGTATSWRTDGLTLTPPEDGNTNFNLTFKATGGEGGVDGAEDITVSATVNVNVVADADDVLLTVQDQVVTGLEDTGFELE

SEQ ID NO: 27867 - protein, 433 aa, Magnetococcus sp. MC-1
MDQRGGTMSRSASLFQQAAGLIPGGVNSPVRAFKSVGGIPPFIREAAGAMMTDEDGKSYIDYVGSWGPMILGHAPKEVVAAIQQAAVRGCSFGAPTSNEILLAQKLIELVPSLEMVRLVNSGTEATMSALRLARAATGRDAILKFDGCYHGHADSLLVAAGSGLATFGVPSSPGVTRGTAKDTLTVPFNDLAAVEACFAQHPEGIAAVIVEPVAGNMGCVLPRPGYLKGLRDICTKYGTILIFDEVMTGFRVDLRCAQGFYDVTPDLTCLGKVIGGGLPVGAYGGKMELMNQVSPAGPVYQAGTLSGNPLATAAGLATLEAISQPGFYETLTSRTQRLTVGIGKALDEAGIPHVSYHIGSMFGLFFTDAREVYNFADAAKNDHNRFKDWFHCMLEEGVYFAPSPYEAGFVSIAHDEAIIDLTIEKARKVAKTL

SEQ ID NO: 27868 - protein, 453 aa, Magnetococcus sp. MC-1
MDTFRLNFSHGSHEDHRRRHGWIRSVEEELGRPLGIMMDLQGPKLRIGTFENSEVELVRGQKFALYKEERTGDINGVTLPHNELFQVMRPGLELLLNDGRINLRVMEVEDFGVCCEVRVGGILSDRKGLNVPAAMLPVKALTDKDLEDLEFGLELGIDWCALSFVQRPEDLREARKLIHGRAALLAKIEKPQAVDNLEEIVKVADGVMVARGDLGVEYTPERVPAVQKRLIRMCREQCKPVIVATQMLESMIDAPIPTRAEASDVANAIYDGADAVMLSAETAVGSYACNAVSVMDRIARVTEADPDCLQRNLHTPLTFDNSDNDAISKAARDVAMSRGCQAIVAFTKTGSTALRVSRTRASVPILGLTPDIRVARRLTMVWGVHSVNTSDVSNFAEMVGKATRICRREELANTDDRIVVIAGVPFGQEGTTNILRIARIGEAERPLDDGPLD

SEQ ID NO: 27869 - protein, 429 aa, Magnetococcus sp. MC-1
MSSIVEIHGREVIDSRGNPTVEVDVYTEDGGFGRAAVPSGASTGSREAVELRDGDKSRFLGKGVRKAVDAVNTVLAEVVLGMEVADQKGIDAAMIALDGTHNKSRLGANAILGISMAVAKAAADECDLPLYRYLGGTNTSLLPVPMMNIINGGAHADNNVDIQEFMIMPVAATSCTEAIRMGAEVFHSLKKVLKSKGLNTAVGDEGGFAPNLGSNEEALKVIVEAIEAAGYKPGEDIKLALDCASSEFYNKETGNYDLTGEGRVLTKQELVAFYEDLVAKYPIISIEDGFDESDWDGWKLMTEALGNKIQLVGDDLFVTNSKILAEGISKGIANSILVKVNQIGTLTETFEAVEMAQRAGYTAVISHRSGETEDATIADIAVALNAGQIKTGSMSRSDRIAKYNQLIRIEEELGGMARFEGMKVFYNLR

SEQ ID NO: 27870 - protein, 368 aa, Magnetococcus sp. MC-1
MSHDPIDLNPSTLVELRDGIDAIDDRIHDLLMKRAELVMRVGELKGKGPAGTPFYRPEREAQIHRRLEGRHGGPLPVEAVHRIFREIISASLNLEKQLSVAYLGPEATFTHEAALKQFGSAFTMFSTRTITEVFHEVEIGRANFGVVPVENSLEGVVIHTLDRFVRSPLNICGEVLMPVELNLLARGGVLGEVRVIYGHFSALDQCAQWLSHYLPQVKRVEVASTAEAAERARREEGAGAICGPFAANRYGLVVIAEHIEDQARLENRFLVVGRESPAPSGADKTSIMVSFLDDPGFLHRILGVFAERGINLSRIESRPTQERAWDYLFFIDMEGHRQDEGVSAALEALGALSGVSVKILGSYPQHAL

SEQ ID NO: 27871 - protein, 192 aa, Magnetococcus sp. MC-1
MTVTQNAEAKANLDHLEPFIDRAHIALRVAELGVQIRGDMVGKDPVFLVVLKGGFVFAADLMRALDHTVPVAFTNARPCAHLPIFSREDEDLLRGKDIWVVDALLDQGHSAMRLMQGLQPLQPTSIQFAVLLHKTVERAEKIPVRYVGFEVPDTRLVGYGLDENQQFRGMRNLYAWWPYAQAIRADEPEEFL

SEQ ID NO: 27872 - protein, 327 aa, Magnetococcus sp. MC-1
MVNRMRDATICVYLGEEIAQYGFPDGHPWTTTRMDAFWQEATRQSLSSKVVIADPVMAQPEQLHSFHTPQYVELVKRCSDAGEGFLDHGDTPAFPGIYEAAAYVVGSAVAAAEQIMQQRFRRIFIPIAGLHHAQPDVAGGFCVFNDAAVVVKHLRKQHGIKKIAYVDIDAHHGDGVFYPFEADPHLIFADIHEDGRYLYPWCGSEDETGVGPAYGTKVNIPMAPDASDADFFSAWPRIEALLMEHKPEFIILQCGADSLKNDPLTHLAFSTAAHSHAATRLCHMAETLGHGRVLALGGGGYNLSNVAQGWSAVLRALIEAPIIPAQP

SEQ ID NO: 27873 - protein, 510 aa, Magnetococcus sp. MC-1
MTLVILDGWGLRDTQENNAIANASTPHMDDWLANRPHAQVRTSGRDVGLPDGQMGNSEVGHLNLGAGRVVYQEFTRVSCAIEDGSFMHNQVLLDAIRAANEAGGAVHLYGLLSPGGVHSHQDQILAAVQCAKQNGASEIYIHALLDGRDTPPQSAMEYMTRFEEGLQKLGAGRVATVCGRYFTMDRDKRWERVERGYRLMALGEGTPFDSACEAIQAAYDAQQTDEFVEPAVMVEQGQPIGMINDGDTLICMNFRADRVREISHVFTDTTFEPFVRDGLPKLSAYVCLTQYDVSLQNVQIAYPPVALTNILGQVMAQHGLTQLRAAETEKYAHVTYFFNGGQEQPGEGEDRLLVASPKVATYDMQPAMSAAELTDRVIEKIQSTPYDLVVVNYANPDMVGHTGVYEAAVQAIETVDTQLGRLTDAIVQMGGEVLITADHGNADQMVDEQGTAHTAHTLNPAPLIYLGRDAQLHDGRLSDVAPTLLALMGLPQPLEMDGVSLVQFTQPAVA

SEQ ID NO: 27874 - protein, 391 aa, Magnetococcus sp. MC-1
MSDKVSSIMSTYGRYPVAFERGEGVRLWDTNGRVYLDFLSGIGVNNLGHSHPTVVKAVQEQVAKLTHTCNLYRIPNQEALAARLVATCFADQVFFSNSGADANEAAIKLVRKYMKDRGQPGRYEIITATNSFHGRTMATLTATGQEKVQSGFEPLVPGFRYVPYNDMEAMEKAVGPYTAAIMVEPIQGESGVRVPDADYLNQLRALCDRKDILLVLDEVQSGMGRTGKMWAYQWSDIEPDIMTSAKALASGVPMGACLARRGVAAAFAPGSHGSTFGGNPLSAAAALATLDVMLAPDFLPTVQARGDYFMNALRQLAQGRRMVKQIRGRGLMVAMELNAPGEEVASIALSRGLLINCCMGTVLRFLPPLVVSEQEIDQGLAILGEVLSDLF

SEQ ID NO: 27875 - protein, 378 aa, Magnetococcus sp. MC-1
MSKDLYEILGVSKGANDAEIKAAYRKLAMKLHPDRNPGNDAAEAQFKEVNAAYEVLKDPQKRTIYDQYGHAGLGQGGPGGPGGFGGQGGAGFGDIFEEFFGDIFGGGRQTRGGGRSGARQGEDYRYDLRVTLEEVARGVEKRVRIPSMSTCDTCHGSGARSGSKPTTCTTCGGAGQIRTQQGFFQVQRACHVCHGKGQIISDPCPDCGGAGRQKKEKTLTVKIPPGVDTGTRIRLSGEGGAGIQGGPAGDLYIITEVEPHSMFERYGVDLLCVVPITFPQAALGAKLEVPTLNGKARITLPAGSQTGKRLVLRSKGLPHLNRPGMLGDLVVEVRVETPVKLTTKQKELLEEFDRCGDPDSQPDSVGFFDKVKEFLGGN

SEQ ID NO: 27876 - protein, 113 aa, Magnetococcus sp. MC-1
  misc_feature (3)..(3): Xaa can be any naturally occurring amino acid
MTXGLLLQDRDLKQLPEGSLKVVTERAPSEAEMRDLLFAWKVVKHVKSNAIVYAKEQRTLGVGAGQMSRVDASRIAVWKAHDTAHTAGLRENPLLGAAMASDAFFPFRDGVDA

SEQ ID NO: 27877 - protein, 2804 aa, Magnetococcus sp. MC-1
MTGHFVGNEGVIEAKGSGSGDGGQVTLISAQHTLTTVNSVIDVSGGADSGSGGVVQIRSANRATFDGVVKADAGQNGGDGGLVDVSSEGEVQLIGKVVGLAPRGRNAKLVIDPKHIEINDAGGGAYNSTTVQFDDSQSGTTVITAASINAQVADVVLQANTDITVTTAINIANAGTGLTLQAGRSILINADLTTNNGVVTLTANDHTALSADRDAGVASIAMASGTTINAGSAAVNMTIDASGHGLMGDITAYNVTSSGAVALDSAGSIIVNGPNFASGSTSIGLTADNDVTVGSALTTGSLTIAAGRSVALNSNVTTTSTVNIKANDSTQTLANRGSGDGAISMAAGTTLNGGSAAITLTVDSTNASTAGGITIDLVTTDGNLTVSSHDAITEIDADSEVDLRGDILSLTTTDTNGAYIGAPGTSTTDYLEVHAKTRVDVTTNNGSVALASPGYLSGTVDWFGAAPTDDIGTTDIDESKIVNLNLGTVNVGTATFMLVVTDGGILDGLAGTGTNITAGSANLTTNGGESVVAGAIVLGNDGTRGGSIGDATHALKTELGILTASSSNGSVYIDEASGILINSINANQKGVTAKVNSSYAVVVTTLDGQTETGTNNVTVTAAGDIIIGTASATSTVTLTSTAGNIYDNNDATNNILAKNVVLNAGLNMGLSGDVLELTTESATLTATNGGVYFAMGVPSTVASVTAGGGHDVVINASDGVLSLGMVSAVGGSVTIDGGTGSILDNNGATANIIANSASIKSDKGAGTASDALETTVDTLAVEITGSGKSFYIDESDALTSINAKVNNGSTNLNFTGGSFAFNATTGAFSSTGVGSVTFENTGGGVAIGTVTATGGSATITASTAITDATSAITADTVVLTAGTSIGASGSTIKSTATTLTYLASAGSIYAQESDGATVNAKAVGTGKNIEFATTTGNLTIGTISAKGSVTLTATAGSVLSGGTSSSATGATVVLSAGTAIGASGASVNTVAANLSATASAGGVYLSNAGDVTLTTAVATGAGFQLSNTGALVLNGVTAAGQAVSLTASGAITDGNGATNNISAESLTLVGLSIGSTATNGAVDTQVNSVTATTTSGGIYLNELGSGGLTITAATAVGSDANVSITGAGDIALGVITAKGDDVTLVSAGKITDNNGAANNVTADILNVTGPNGVEGLETSITQLSSTGSTDIVNAGAMAITKASLEGGSSSFIAESLTILDMAGDTATIANNTSLTLQTTTGNIVFLDTNDTIVAQGSGTVTINAGTTDKSGAVAIIGNITTANQNISITADSHITIGLLNAGIGDVSVSSDYGVVLDGNSTAVNVIARNFSLSGTTPTVRQAELHTTNSIANAHAHDSEVAAKLTLLEANTAAMDIMSTAESTANYSLTLASSAYDTAQAEVDRLAPIENGLKITTYVLDGVSIALSTAASAIEVAAGAAQAIPFSGDAGSEAAAAVTGLAANVAGIAAYAIGIAHSEIAGQLDDAEDLAFNKDAEMYAAKSTLTDAIANHQAYKEATSISQAAYDAAVIERNHNWQVARQAVLAEDASSTAGTLALPFGIQISGQLDVNAVNSDVVLAITGPAVLNSMSATKTAGTGIMSITATDNISVVGALVADDYIRLETTGQIINGNAGHSLTASKFVGVAGTGIGASGGLNTSVTTMAASTTTGDVTVTNNKALTLGTVDGVSGITTAGNIVIAATSPLTVSNNVTTSGGTVALTAGNSANSGDDFTLSANTTISAASTVTLTAGDNVAVESGAQITGTTVTITANNTGDGEADGVNGGATIAGNINASSLVLSGGGVNHSGTITSAGSVNISATSTAASSVNGITLGSVTAGGQIDVVSSNKLVMNQNVTTTSGAVVLTAGDSSASGDDLTLAAGKTISSGDNTITLTSGDNMSIGAAAQITGTTLVLAANHEGAGVADGVSGSMVLAGNLSGQTVTISGAGLTHTGSITSNSTVSVNVNSAATSAISGISLAAVTAGGQIDVTSSHALTLTQNVQSTGGPITITAGLQTTSVDNLTVDAGVTVQSSAGVAFSAGDSMTFGLGSQVTGTGITLIADKAGDGDGDGVSGSINLYGNVNGSSVDVSAAGFRQTGTITSSGDVDIAVVSTLSSPYNGIALGTISAAGHSVKISATGTATAGIADNNGAATNVTAADLAMVANGGVGASADALETQVSNLAATGGSGGVTISNSGDLSLTTVEGVTSFSAADGALSLVTTGNLLISDGFVQGAGLTVTLQATGGNINETNSGAAADVVGNIITLTTTGLGNGVGDVANRLELNAQVLNVTTDKGDVYLHDTAGGVAVGLITTGTTEGTRVDMMVSNGGVTEDPGHGHAPKIIADELYLNVTGHGFGIGHVDNDLNVDLTTFVNVTTEGGSIYMADADYGFYVDLVSTNSASTNIAMGTELRLVSLEGSIEESPTRSDAAVDLKAERVVLLAQGENDNIGTVEDAIEIKAANLFSETESGARSSLVAPDGDSPIVEAPGQSANALLIDGDFVGGDDSNLFQEIQSTGNRVGGDIGGGAGGGFGGAGGAGGGFGGAGGDFGGAGGGLVSDAGGFGGEGAPGGDAGGFGGEGAPGGDAGGFGGEGAPGGDAGGFGGEGAPGGDAGGFGGEGAPGGDAGGFGGEGAPGGDAGGFGGEGAPGGDAGGFGGEGAPGGDAGGFGDEGAPGGDAGGFGGEGAPGGDAGGFGGEGAPGGDAGGFGGEGAPGGDAGGFGGEGAPGGDAGGFGGEGAPGGDAGGFGGEGAPGGGPGGDAGGIGGTDGAGGDRGGPGGTDGAGGDTGSPGSGDGDVNKQGEGG

SEQ ID NO: 27878 - protein, 467 aa, Magnetococcus sp. MC-1
MEEMMATIWDLIVIGAGPGGYPAAIRAAQLGLSVLCIEKSPHPGGTCLNAGCIPTKALLASTHLYTQIRDQADLHGIEITTMQVNLARMQGRKERVVSQLRSGILGLFKKYGVTLLHDEAIVSGPGQITLAASGETLQAKAILLATGGQPRRPASMPVDGQVVITSEQAIALTRVPEHLIVIGSGAVGLELASIWVRLGAQVSVIEAQPEILPGWDATVARTAKRSLRQQGITFLTDHRVETVVRSGSRAAVTCLNSKGETLMLDGDQVLVAVGRQAQLCVAGIQNLELQQDEQGRLWVDAHYATSLAGLYAVGDLIAGPQLAHRATAEGLRVADYLAGRPLSPMGPIPSVVYTDPELAMVGLTEQQAKVAGYAVKCGQFPFMASGRARAQEQTEGLIKLVMDQTTGQLLGAHVVGGAGAEHLQLAMAAMLTQDRGQLLERLVMPHPSFGEALHEAWLVATQKPIHI

SEQ ID NO: 27879 - protein, 473 aa, Thermobifida fusca
MTRRAKIVATLGPATSSPEVLRKLVDAGLDVARLNLSHGTHDDHQTMYRNVRAAAEASGRNVGILADLQGPKIRLGTFVDGSVTLSPGDEFTITIDDVPGDRHRVSTTYKGLPGDVRPGDRVLIDDGRVVLECVKSTSTDVHTRVIVGGPVSNHKGLNLPGVSVAVPALTEKDERDLRWALEQGVDMVALSFVRSPADAEDVHRVMDEMGVHVPLIAKIEKPQAVERLQDIIEAFDGVMVARGDLGVELPLENVPMVQKRAIERCRDKAKPVIVATQMLESMIHNPRPTRAEASDVANAVLDGADAVMLSGETSVGKYPVETVQTMARIIAAAEQESLRASHILHRVPETVGGSIARAAAEVGATVGAKALVAFTSSGETARRLARYRSPIPLLAFTTEPATRAQLSLTWGVETHLVPWVDNTDDMVRQVENELLDMDYQKGDKVVIVAGSPPGTRGSTNMLRVHRMGDAISN

SEQ ID NO: 27880 - protein, 292 aa, Thermobifida fusca
MARIAFIGLGIMGSPMAVHFHNAGHQVVGYNRTPAKTKALVEAGGTAAASVSEAVADADVVALMVTDTPDVVEVLTGAGGVFETAKPGTLIIDFSTIRPDVTADLAAQARSRGLRMVDAPVSGGEVGAQNATLSIMVGGTEEDFAAARPFLEVVGKTIVHVGPSGSGQTVKAANQLIVAGHLAVLAEAIVFLEAYGVDVSAALDVLGGGLARSAIMEHKAELMRRRSFTPGFRLDLHHKDLGIVTTAAREAGVVIPVAAAAAQLIAAARANGDGDLDHSALFRTIARLSGRD

SEQ ID NO: 27881 - protein, 414 aa, Thermobifida fusca
MTAPARTRRLVVVGASLAGLRVVEGARDAGFDGELTLIGDEPVAPYDRTVLSTRFLEDREEPQTPVYRPADDLRRDLDVDLRLGVAAHTLDPRSRTVHAGGHTIPYDALVIATGVRPRTPGWAVNLAGVHLLRTVADARALRKSLARSRRVVVVGGGFIGSEVASSARTLGLHVTIVEARDVPFAAALGETAGRLCAALHRAHGTELRCGVTVTALDGTGRVEKVLLSDGSVLKADTVVVGVGSHPNTEWLKGSGVACTDGVECDAALRTTVPGVYAVGDVARWFNPWLGRKVRVEHWTNAAHQAAAVARGIATGQPDTPHASIPYFWSDWYGRRIQFIGEPTADETAVVGDPARGEFACLYRTGERITGALTVGGKGAIARYRTAIRRRAAWQDVLHTALDRAKTVQTGGTRA

SEQ ID NO: 27882 - protein, 403 aa, Thermobifida fusca
MDLAYEAGAPVVGLNDGAGARIQEGVGALAGYGGIFSRNVRASGVIPQISVILGPCAGGAAYSPALTDFVFMVRGIAQMFVTGPDVVRAVTGEEITQEELGGADTHSSVSGVAHFAYDNEHACLTDVRYLLSLLPSNNRELPPHLPTDDPPDRPCTRISSIVPPDPAKPYDVRDVIADIVDEGDFFEVHEAWAPNIVCALARLDGHVVGVVANQPTHLAGVLDIHASEKAARFVQFCDAFNIPLVTLVDVPGFMPGTAQEHGGIIRHGAKLLYSYCNATVPRVQVVMRKSYGGAHIVMDSLSIGSDISLAWPTNEIAVMGAEGAANVVFRKEIAAAEDPDAVRARKIAQYREELMHPHYAAERGFVDELIDPAHTRAALISALAALRGKHAERPDRKHGNQPT

SEQ ID NO: 27883 - protein, 511 aa, Thermobifida fusca
MDDALVQRLTRHVVSSTGRTVVTTAPFTGEPLATLPQSSASDVTEAFRRARAAQREWAQRSPRQRIAPFLRFSDLLLDRQTEILDILQWETGKARKNAFEEVCDAALGTLHYARHAPRLLRRRRAPGAIPLATRTRVNYQPKGVVSVITPWNYPLTLPVADAVPALLAGNAVVAKPDTQTALSALWAIDLLVEAGLPRDLWLVVLGEPAEIGDPLVDEADYVAFTGSSATGARIAQRAASRLIGCSAELGGKNPMIVCADADLDRTVHGAVAACFSNSGQLCISMERLYVHDSIYDAFVEKFVAETKNLRLGADLDYSADLGSLTSQRQFDRVVAHVEDARSKGATVLAGGRPRPDVGPLFYEPTVLTGVDESMTLCAEETFGPVVSLYRFTTEDEAIERANHTPYGLNASVWTRDVARGRRIAERLKAGTVNINEGYGAAFASYGAPMGGMKRSGLGRRHGVEGILRYTEAQTVSSQHVVGLSGPPGMSAETLSRVMTTGIRLMRALRIR

SEQ ID NO: 27884 - protein, 370 aa, Thermobifida fusca
MAQVEIGLGKAGRRAYELDEIGIVPARRTRDPEEVSLSWQIDAYRFDTPLMVSPMDSVVSPKTAIAIGELGGLAVLDLEGLWTRYEDPEPLLAEIRELDDATATRRLQEIYAEPIKEELIGRRIEEIRRAGVVTAARLSPQRTAQYHKAVIEAGVDIFVIRGTTVSAEHVSGRTEPLNLKQFIYDLDVPVVVGGCATYTAALHLMRTGAAGVLVGFGGGSGHTTRSVLGVAVPMATAIGDVAAARRDYLDESGGRYVHVIADGGMTRSGDIAKALACGADAVMVGSPLARAVEAPGGGYHWGSEAHHHQLPRGQRLKVGTIGTLEEIVRGPASTSDGSMNLMGALRRTMATAGYTDVKEFQRVEVVVAPN

SEQ ID NO: 27885 - protein, 500 aa, Thermobifida fusca
MSLKPTGDQEEFQKVLPPGLTYDDVLLVPAYSDLQPGEANTTTRLTRNITLSIPLVSAAMDTVTEARMAVAIARQGGAGVLHRNLSIEDQAAQVDLVKRSEAGMITHPVTCHPDDTLADVERLSAHYRISGAPVVDDDGRLVGIVTNRDMRFEEDRSRPVREVMTPMPLVTAPVGVSREEAFRLLRANKVEKLPLVDDEGRLRGLITVKDFTKSEQYPNATKDAEGRLVVGAAVGVGPEAEERAKALVDAGVDFLVVDTAHGHSAGVLEMVAKLKANTRVDVVGGNIATRAAAQALIDAGADAVKVGVGPGSICTTRVIAGVGAPQITAILEAAKAAGPADVPLIADGGLQYSGDIAKAVAAGASTVMIGSLLAGVEESPGELLFINGKQYKSYRGMGSLGAMRGRSYSKDRYSQAGVVTDDQLIPEGIEGRVPYRGPLSAVAHQLIGGLRQSMWYAGVRTLDELRERGQLMQITSAGLKESHPHDVQMVVEAPNYQARN

SEQ ID NO: 27886 - protein, 490 aa, Thermobifida fusca
MRTAHIVETVRAAEGALLAQLPEGTLMRRAAFGLASVCVRILPRVSGARVVLLVGSGDNGGDALFAGAELARRGAAVTAVGAGRTLHERGLAALRAAGGRTASVEQAAALVAGADLVVDGLVGIGVRGALREPHASLAALTESTDAAVVAVDLPSGVDADTGAVPGASVRADVTVTFGTYKPGLLVDPGAGRAGVVEFVDIGLAPQLPDPDLVSFQAEDVAALLPRPTAESDKYRRGVLALAAGSNRYRGAAVLAAGGALRTGVGLLRYVGEPEVAREVVARWPETVASALDPVDPVASLPQRVAAWVIGPGRGLHPAALAELEAVLASDVPVLVDADALTLLARNPALVRERTAPTLLTPHAGELTRLLPGVERADVEAHRLDYARRAAAEYGCTVLVKGSTTLVAEPNRAVAANPTGTPLLATAGSGDVLAGMIGALLATGLPPWEAAACGAYLHGMAARLAHGGAPISASDLFDAIPRAISAVVYRE

SEQ ID NO: 27887 - protein, 317 aa, Thermobifida fusca
MSTPIGPTDSSLVPRFAGPATFARLPRTDEVAKTDIAVVGIPFDSGVSYRPGARFGPAAIREASRLLRPYNPGLDVSPFAEVQVADGGDIAVNPFAIKEAIATVEASASELLSQGTRLVTLGGDHTIALPLLRAVHRVHGPVALLHFDAHLDTWDTYFGEPYTHGTPFRRAVEEGILDTEALTHVGIRGPLYGKKDLEDDRRFGFGIVTAADVMRRGVDEIADMVRQRIGNRPLYVSVDIDVLDPAHAPGTGTPEAGGLTSRELLELLRGLASCNLVGADVVEVSPAYDHAQITATAAAHVAYDLVSLLALTAKKDR

SEQ ID NO: 27888 - protein, 328 aa, Thermobifida fusca
MRAIVVSAPGGPENLVWQEVPDPQPGPGEVLVEVAATAVNRGDISQREGNYPPPPGAPEYLGLECSGRIIAFGPGTEDSGYRVGDEVCALLSGGGYAERVAVPVGQLLPVPKGVGLVEAAALPEVACTVWANVFMTAQLREGEALLVHGGASGIGTFAIQAARAFGARVLTTAGSEAKLARCRELGADVAINYRSEDFAARVREETGGRGVDVVLDIMGGSYLEANLRSLAVGGRLVVIGLMGGRRAELDLGRMLIKRLSVHAATLRSRPLEEKAAIVAQVTERVWPLVERGEIRPVVDRVLPLSQAAEAHRVLEASEHVGKILLVTN

SEQ ID NO: 27889 - protein, 441 aa, Thermobifida fusca
MALALPLTLAAPSSALAQPHHHAGVSPKAEQVAREVLAPNDGWAAYDGGTTGGAAADPEHVYVVTTYAELREALAGGRTNDTPKIVFLKGRIDANTDEHGNQLTCDDYADPEYDFDAYLATYDPEVWGWDQEPSGPLEEARERSYRNQRDQVVIEVGSNTTLIGLGDDATLVGAQVMVDSVDNVIIRNIIFETAQDCFPQWDPTDGPEGNWNSEFDGVSVRRSTHVWIDHNEFSDGAVLDRDLPEYFGREFQVHDGLLDITHGADLVTVSYNVLRDHDKTMLIGSTDSPTYDVGKLRVTLHHNRWENVLQRAPRVRYGQVHVYNNHYVIPATPEGEKTYEYSWGVGVESALYAENNYFDIDPSVDFSQVVAHWKGTQMYEKGSYANGRSRHHQVSFLDEYNAVHSPTIENKQTWSPPLHGRIDPTQSVPAKVQKAGVGHIL

SEQ ID NO: 27890 - protein, 318 aa, Thermobifida fusca
MPLDPETRALIDELVSGSPPGEAVGVPDASLHSSLRERRIVGPGVALVRDLTIPSPAGGIPARLYHPAPDNPATGCAVFFHGGGYVFGNLDTHDHIARLLAAESRAAVVAVDYRLAPQHRFPAAVEDAFTATRWVAEHATRLGVDAARLAVVGDSAGGGLAAAVALLVRDGGPPLAAQVLIYPVIDLTGYPVTADTPYPSRIAHGEGCFLTTAAMQHVVEQYLADPADAADFRASPIRAADLSGAAPALVVSAEFDPLRDEAEAYARALAAVGVPATTVRINGGVHGMFGLGPVLPLSRHAELPVIALLRDTLQPPQR

SEQ ID NO: 27891 - protein, 378 aa, Thermobifida fusca
MSTKDYLEKDYYKVLGVSKTATADEIRSAYRKLARKYHPDANKGDAQAEKKFKEISEAYSVLSDEKRRKEYDEARSLFGGAYRPGGGGIGDFNLGDLFGHTTTGGERLTDLFGGLFGGRGRATQSRRGADLETETTLSFTEAVSGTTKSFTLTTTVSCPTCRGSGAKPGTTPRVCPRCAGTGHESTNLGGFSLSEPCALCKGRGYLADDPCLTCSGTGNVKGTRTVQARIPPGVSDGQRIRLRGKGEPGERGGPAGDLFVTVRVTPHPVFGRSGDNLTLTLPVTFPEAVFGAEVRVPTLSGPPVTVRIPPGTRNGRVFRVRGKGATRRDGTTGDLLVTVEVAVPQNLNSEAREALQRFQAATADHNPRADLEARAKGA

SEQ ID NO: 27892 - protein, 390 aa, Thermobifida fusca
MAGLTTAEALREAGFDGTITLVGDEPHRPYERPPLSKEVLTSQNSGKGVWLRTDDELAALSLDLRLGVRAMALRPSDRAVELSDGTSLVADAVVVATGARARRPRTDLPGVHVLRTLDDAEALRADLLRYGRVAVVGAGFLGAEVAASARALGAEVTLLEAADTLLPRVVDPRISAVFAELHRDHGVDLRLGVPVTSFAGTHRVERIELADGTSVAAPVVVAGIGVHPNTEWLSGSGVLLDPEVGGVSCDPYLATSIPHVYAVGDLAAWPHPRYGGRIRLEHWANAEEQARLAAHNLLAGEGARRPYTPVPYFWSDQYGRKIQLLGQASPADTVEIVHGSVADRKFVAFVGRQDRLVGVLGMRSTPRVMRYRPLLEEPTSWADALAAAQQ

SEQ ID NO: 27893 - protein, 360 aa, Thermobifida fusca
MVHRGDIPRNDVPPAGVYRADPERYNGRMPYRRTGRSGLDLPAISLGLWHNFGDNRPLETQRAILRRAFDLGVTHFDLANNYGPPPGAAELNFGRILREDFRPYRDELVISTKAGWDMWPGPYGSGSSRKYLLASLDQSLARLGLDHVDIFYSHRYDPSTPLEETMAALDAAVRSGKALYVGISSYSPQHTVEAATILRQMGTPLLIHQPSYSMVNRWIEDDGLLDTLEAEGVGCIAFSPLAQGMLTDKYLNGIPANSRAAAGTSLSPDWLTEANLARIRALNDIAARRGQSLAQMAISWVLRDPRVTSALIGVSSVQQLEENIAAVHAPEFTDAELAEIDRHATDLGVNLWQRSSRPRT

SEQ ID NO: 27894 - protein, 396 aa, Thermobifida fusca
MAERRSAHNYHPLPVVIAHGEGAWVTDVAGRRYLDCLAGYSAVNFGHRNPELLAAARAQLDRITLTSRAFHHDRFAPFVAALADLVGKEQVLPVNTGAEAVETGIKIARKWGYEVKGVPDGRAVIVVASGNFHGRTTTIVSFSTDPAAYRGFGPPTPGFRIVPYGDAAALADAIDADTVAVLVEPVQGEAGVIVPPADYLPRVRDLCTRAGILLIADEVQSGLGRTGTVRACDHSGVDADIYLFGKALGGGILPVAAAVGDAEVFDVIRPGQHGSTFGGNALACAVGTAVVSLVRDGPYLDHVRALAPVLRARLDQLVGNGVVAARSIGLWAGIDVDPTLATGRELCERLLQRGVLVKDTHGSTIRLSPPLVITEDELHWAVDQIAAVLADLRAGR

SEQ ID NO: 27895 - protein, 483 aa, Thermobifida fusca
MPPTKRTGFAAALDRYFHVTARGSNFAREIRGGLATFFAMAYIVVVNPLIIGTAPDINGDTLGLERVAAVTALVAAVSSILMGVISRYPFAIASGMGLNAIVAYVLAPMMTWADVMGLVVIEGVIMLLLVFSGFRKAVFNAVPASLKSAIGVGVGLFLALIGFVNAGFVRPGDGTPVQLGVGGSLNGWPILVFVLGFVVTIVLMVRQVKGAVLIGIVFATVLGIVVELFAKVGPRVDEAGQVNDLGWALNVPTVPTSADDLVSLPDLSLVGQFNLLADWRGVGIATMLMLVLTLLLADFFDTMGTMVGVAGQAGLTDKDGNVPNSQGVLVADALGTVVGGAASASVATTYAESAAGVGEGARTGIAPIVTGLLFIGAMFITPLAVLVPAEAATPVLVAVGFLMMTQITKVDFTDLGIGIPAFLAIVIMPYTYSIANGIGVAFIAYTIVRTAQGRWRDVHPLMLLISLVFLIHFAEAPIQALLG

SEQ ID NO: 27896 - protein, 439 aa, Thermobifida fusca
MHFTELAAYQDTDVPVITRGEGPYVYDTNGKRYLDGLAGLFVSQVGHGRTEIAEAIAEQSRKLAYFPIWTYAHPTAIELADRLADLAPGDLNRVFFTTSGSEAVESAWKLARQYFKLIGQPTRHKVISRRIAYHGTTMGALSITGLQAIKTPFEPLVPSTIQVPNTNIYRAPVHGDDPEAFGRWAADQVEEAILQNDPESIAAVYVEPVQNSGGCFPPPPGYFQRLREICDRYGVLLVSDEVICAFGRVGAYFGAQRFDYLPDIITFAKGVTSGYVPMGGLIAREHLVEPFREAGNTFLHGSTFAGHPVAAAAALANLDIFEREGLIDHVQANAPAFRATLEKLLDLPIVGDVRGEGYFYGIELVKDKETKETFTDEEAHRLLKGFLSPALFDAGLVCRADDRGEPVVQLSPPLICGPEHFAEMESILREVLTEAWQRI

SEQ ID NO: 27897 - protein, 421 aa, Thermobifida fusca
METFSRLESEVRSYCRGWPTLFTRARGSRVYDHTGRGYLDFFAGAGALNYGHNNPTLKTALLDYLGSDSIVHSLDAATTAKRDFLDTFEEVILKPRGLDYKVQFPGPTGTNAVEAALKLARKVTGRETVISFTNSFHGMTLGALAVTGNSMKRGGAGVPLNHTVTMPFDNYMDGQVPDFLWLRSLLEDSGSGLDRPAAVIVETVQGEGGINVARADWLRGLAELCREHELLLIVDDIQMGCGRTGPFFSFEEAGIVPDIVTLSKSISGYGLPMALTLFKRELDVWEPGEHNGTFRGFNPAFLTATVALNTYWRDDSLERETLAKGQLITERLEAIAAEHAEAGASVRGRGMACGLVLPGEGDARRVCAEAFERGLLMETSGPEDEVAKLLPPLTTSVAEMEEGLDILAESVRAAVRTPQPA

SEQ ID NO: 27898 - protein, 427 aa, Thermobifida fusca
MASIEAVHAREILDSRGNPTVEVEVALDDGTIARAAVPSGASTGQFEAVELRDGGDRYGGKGVEKAVAAVNEEISEQIVGYEAEEQRLVDSALITLDGTPDKSRLGANAILGVSLAVAKAAAESADLPLFRYLGGPNAHVLPVPMMNILNGGAHADTNVDIQEFMIAPIGAESFREALRWGAEVYHSLKAVLKAHGLATGVGDEGGFAPNLDSNRAALDLISEAITKAGFTLGQDIALALDVAATEFYADGAYQFEGSSRSAEEMAAYYTELVESYPLVSIEDPLSEEDWAGWKALTESLGDRLQLVGDDLFVTNPERLQRGIDEGAANSLLVKVNQIGTLSETLDAVSLAQRNRYTAMISHRSGETEDTTIADIAVATNSGQIKTGAPARSERVAKYNQLLRIEEELDDAAVYAGANAFPRFARQG

SEQ ID NO: 27899 - protein, 492 aa, Thermobifida fusca
MSISSERIAALRDYVPEVRELTIDGKPVKPAGETWDVYNPATEEVIATVSGATKEQVDEAIRAARTAFDTWSKMSGEERSAAMHSLADRLEARWEELLASIVNEVGTPVSTAEFLQVKMGLGHLRWFADAAKKDRTVHLGPYDVPVPTMSDVDHYPVGVVAAITGYNYPLNLAGFKYGAALAAGCTVVLLPSPRTPLTTLLLGEIIRESDLPDGVINVVLGGADIGQYLSSHPGVDKVSFTGSDAVGAKIMEQAAANLNDVVLELGGKSANIVLPGCDVESFAVDMHMRWSRNSGQGCAALARLLVHEDLFDRFMKAGAEAFPKMKVGDPWDPETHIGPLIRPDHRDRVNGFITEALEQGGKALLQVETPLPEKGWYVNPILLGNLPHSARAVQQEIFGPVAVVLTYKDVDEAIRLANDTAYGLAANVWAPTLEEGRRVAEQLRAGTVWINGGGAMRPDAPFGGSGRSGIGRELGEWGIQEFLEPRHIQWAL

SEQ ID NO: 27900 - protein, 483 aa, Thermobifida fusca
MSLTERPQLFIGGRWVDSKGGRKVDVHNPATGAYVGSTVLASTADIDAAVASARASFNSGVWANTPPEERAAVLHRAADLLEERAPELAKLITSELGCPIWFSERAHVPNPIRHLRYYGTLAKDFAYDERRSDGTNTSLVTQVPVGVVAAITPWNGPLSTPSLKVAPALAAGCSVILKPPPETPLTAYNLADALSQAGLPDGVLNIVPADREEGAYLVSHPDVDKVAFTGSSAAGKKIMAACAERIARVTLELGGKSAAIILDDADVDTVVPALLPMAFMVNGQACIAQTRLLVPRSRKDEFIDAFAQAVAAQRVGDPIDPATQIGPMVSRRQQERVEGYIATGRQEGARVVVGGERPSLPSELAGGWFVAPTLLAEVHNSMRVAQEEIFGPVLAVIEYDGDDEAVAIANDSVYGLSGSVWSSDEERALAIARRMRTGMVSINGRPQAANSPFGGFKQSGIGREMGPEGFHAYLETMSIAVGS

SEQ ID NO: 27901 - protein, 421 aa, Thermobifida fusca
MEEAAGSAASGVAPIRAGTPARPIAEIDVEAAQATPTGLAELDRVLGGGMVPGGVLLLAGEPGVGKSTLLLEVAARYAALGPVLYVTGEESAGQVRLRAERVGALAPKLYLAAETELPAVAGHVDEVMPRLLIVDSVQTMSVPEAPGTPGGVTQVREVAAGLIRLAKERDIATVLVGHVTKDGSIAGPRVLEHLVDVVLQFEGDRHSQLRILRAVKNRYGPTDEIGCFELTDSGIVGLPDPSGLFLTRRTEPVPGTCVTVTVEGRRPLIAEVQALVAPTALPQPRRATSGLDAARVAMVLAVLEKRVNLRMGAADVYTSTVGGVRLVEPSVDLALALALAGSHTDMALPPGMVAIGEVGLAGDVRVVSSLPRRLQEARRLGFTTAIVPAGADDAVHEEGLTVVEVTDLGQALRTAFPELRR

SEQ ID NO: 27902 - protein, 409 aa, Thermobifida fusca
MNSPVRAFKAVGGTPPFMVSGKGPYLTDADGNTYVDLICSWGPLILGHAHPAVVEALAKAAAQGTSYGAPTEAEVELAEEIVSRTPVEKVRLVNSGTEATMSAIRLARGATGRAKVVKFAGNYHGHVDALLAAAGSGVATFALPDSPGVTGASAADTIVLPYNDIAAVEAAFAEAGDEIACVIAEACPANMGVVPPRDGFNAKLREITARHGALLILDEVLTGFRVSPSGWYGLEGVAPDLMTFGKVMGGGLPAAAFGGRADLMDQLSPEGSVYQAGTLSGNPLATAAGLATLRNATPEVYAHIDAAAARVSAAVSEALTAEGVPHRIQHGGNLFTVFFTDTEVVDFDGARAQNTARYAAFFQAMLEQGVYLPPAAFEAWFFSAAHDDAALDRVVSALPAAAKAAAQVA

SEQ ID NO: 27903 - protein, 160 aa, Thermobifida fusca
MKIYQSELRTLEGEPFRLPQTQLLLIVNVASKCGLTPQYSGLERLQEAYAYRGFSVIGVPCNQFGGQEPGDAQEIRLFCATTYGISFPILEKMEVNGPNRHPLYVELTKARDSQGLAGDVQWNFEKFLVAPGGRVLYRFRPQVEPEDPEIIRAIEENLPN

SEQ ID NO: 27904 - protein, 409 aa, Thermobifida fusca
MASPTDNPIVLDPYVSDLEGERERLYEAGPIAWVELPGGVRTWSVTHHQAARELLTDSRLSKNMAHWGAYNRGEISPTWPLLSVIPPTPTNLLGTDGAEHKRLRTLTAQAFTPRRVEKLRPRIREITEELLDALEERANEPQDLKSEFSFKLPMRVIGELYGVEEAAHGQLRSLYDKFFSSVTPPEEFLATREALVQFYTELMERKKANPSDDLTTALLQANENGDRMTDEEVLGTLQIVVAAGHETTVNLLTNTVRALLRFPDQLELLRTGKATWEAAIEESLRWDPPTTNFIFRFATEDIEYGGVTIAKGDSVMISYGAIGRDRGQHGDNPEVFDVTRKTSSRHISFGYGPHVCPGAPLARLEAQVALPMLFERYPDMKLAVDDSELVPNPSVIVNSLKEFPVILRP

SEQ ID NO: 27905 - protein, 443 aa, Thermobifida fusca
MTAEDTTPESTAADKWSFETKQIHAGAAPDPATNARATPIYQTTSYVFRDTQHGADLFSLAEPGNIYTRIMNPTQDVLEKRVAALEGGVAAVAFASGSAAITAAVLNLAGAGDHIVSSPSLYGGTYNLFRYTLPKLGIEVTFIKDQDDLDEWRAAARDNTKLFFAETLPNPANNVLDVRAVADVAHEVGVPLMVDNTVPTPYLQRPIDHGADIVVHSATKFLGGHGTTIAGIVVDAGTFDFGAHGDRFPGFVEPDPSYHGLKYWEALGPGAYAAKLRVQLLRDTGAAISPFNSFLILQGIETLSLRMERHVANAQALAEWLESRDEVAKVYYPGLPSSPYYEAAKKYLPKGAGAIVSFELHGGIEAGRAFVDGTELFSQLVNIGDVRSLIVHPASTTHSQLTPEEQLASGVTPGLVRLSVGLEHVDDLRADLEAGLRAAKAYQ

SEQ ID NO: 27906 - protein, 406 aa, Thermobifida fusca
MAQHYGEHTRAVRAAAAAPAPGTPMRIPVYRASTYAFATSRDYAASLTGDGQYAYARIDSPNSDAFAAAVAALEGAHLEGEVHGQGFASGMAAISITLLALTHAGAHVVASRALYGNTYKLLDVVLRRFGVAVDFVDITDPAAVRAAFRPETVLVYTETLANPTMTVSDLPVLAALAHEAGALLVVDSTFASPVVCRPLEHGADIVLHSATKYLGGHSDATGGVAVGRPDLLARIREARIDLGPHLAADEAFLLHRGLETLPLRMARQCATAAEFAAALAEHPAVARVDHPSLPTHQGHVLARKLFDTGPEGPRYGAVVTVTPRGGREAGIAFADRLRLATIAPSLGGTHTVVSHVASTTHRQMSDEALHAAGIDPGAVRFSIGVEDPADLIADARQALDGLPVKK

SEQ ID NO: 27907 - protein, 473 aa, Thermobifida fusca
MSQRPFWLAGSATTGDNELTVTNPYTGQTVATVAVPSPEQVDQAVAAAHGALDATAALPAHVRATALAHVARRLQERSEEIAQLITAESGKPILWARAEVGRAVSVFTWAAEEVRRDSGRVQRLDTDSAGEGRIALIRRVPKGAVLAISPFNFPLNLVAHKVAPAIAVGAPIVVKPAPATPLSALVLGEILAETDLPAGAFSVLPMPNELAQPLITDERLPVISFTGGQFGWELRKMAPNKHVTLELGGNAAAVVLADADLDWAARRIALFGNNQAGQVCIGVQRVIVEDAVYDEFAAKLVQRVEELVTGDPADEATQVGPLINEAAAARVEQWVNEAVAGGATVLTGGTRDGVTMAPTVLADVPDDAKVVCEEVFGPVMVLRRVSGVDEAFAEVNNSKYGLQAGVFTRDLATAFRAHRELKVGGVIIGDVPTYRADQMPYGGVKKSGVGKEGVRSAMDDLTDERVMVLTGVL

SEQ ID NO: 27908 - protein, 241 aa, Thermobifida fusca
MFGALGRMGSEVVKAVEAADDTELVAGIDVGDDRGKVLGADVVVDFTHPDAVMDNLRWLIEHGIHAVVGTTGFDDARLAEVRRMLDAKPGVNVLIAPNFGIAAVLMMHFAAKAAPYFESAEIIELHHPNKADAPSGTAYRTAELIGAARAHAGLGDAPDATTSELPGARGAQVDGVRVHALRITGMIAHQEVVFGTHGETLRIRHDSMNRESFMPGVLLGVRKVASLPDRLTVGLESLLGL

SEQ ID NO: 27909 - protein, 321 aa, Thermobifida fusca
MITVVGEALIDLISSESGTYRSVPGGAPANTAVALARLGVPSSLLARMSTDRFGQQLRAYVGSRGVSTRDIVVSDEPTTLAIATLDETGRATYDFYVKGTVDWQWRPEELPDPLADDVTAIHVGSLAMAMPPGAAVVEEWVARQRGRAVISYDPNIRPALAGTPASARERVERQVALADLVKVSDEDVYWLYEQDPATGSADLLVEVGRSWLRRGPSLITITCGGDQTLVLVRGREDRPLSVAPEPVDVVDSIGAGDAFCAGLLDALGQAGALGADGRERLAALTDAQLTVCVAHAHRVAAHTCRRVGADPGELDFPPLEF

SEQ ID NO: 27910 - protein, 455 aa, Thermobifida fusca
MATASFQIEGSTTADGRGPSIWDTFCATPGKVENGDTGDPACDHYNRYRDDVALMRELGVGAYRFSIAWPRIQPEGKGTPVEAGLDFYDRLVDCLLEAGIEPWPTLYHWDLPQALEDAGGWPNRDTAKRFADYAEIVYRRLGDRITNWNTLNEPWCSAFLGYASGVHAPGRQEPAAALAAAHHLMLGHGLAAAVMRDLAGQAGRSVRIGVAHNQTTVRPYTDSEADRDAARRIDALRNRIFTEPLVKGRYPEDLIEDVAAVTDYSFVQDGDLKTISANLDMMGVNFYNPSWVSGNRENGGSDRLPDEGYSPSVGSEHVVEVDPGLPVTAMGWPIDPTGLYDTLTRLANDYPGLPLYITENGAAFEDKVVDGAVHDTERIAYLDSHLRAAHAAIEAGVPLKGYFAWSFMDNFEWALGYGKRFGIVHVDYESQTRTVKDSGWWYSRVMRNGGIFGQE

SEQ ID NO: 27911 - protein, 460 aa, Thermobifida fusca
MTKVVIIGGGPGGYEAALVAAQLGADVTVIERDGIGGASVLTDCVPSKTLIATSVRTSYVKEAATLGINVGNEPEDKDLVRVELKTVNARVKRLAQAQSVDTANRLRTEGVEIIIGEARLVDPHIVAVGDERIRADVVLIATGAHPRELPTARPDGERILTWRQLYDLNELPEKLIVVGSGVTGAEFANAYQALGSDVTLVSSRDRVMPTQDADAARVLEDVFARRGMTVLGNSRAESVTRTDAGVLVRLTDGRVIEGSHCLMTVGMVPNTANLGLEEAGIRLDERGFVQVDRVSRTSTPGVYAAGDCTGVNMLASVAAMQGRIAMWHALGAAVSPLRLSTVASTVFTHPELAAVGATEDDVVSGRVDGRIVKLPLATNPRAKMHNTRDGFVKLICRQHTGIVLGGVIVGPRASELILAVSLAVQQRLTVDDVAHTFAVYPSLSGSVTEAARSLMQGFPE

SEQ ID NO: 27912 - protein, 420 aa, Thermobifida fusca
MAETVARRGGLVVLPQDIPTDVVADVIQWTKTRDLVHDTPITLAPTETVGHALNLLPKRAHNAVIVVDEERRPIGVVTEADCVGVDRFTQLHEVMSTELLTLAAGTDPQEAFAILHDSRHRLAPVVDSNGALVGVLTRTGALRATLYRPAVDAQGRLRVAAAVGINGDVAGRAAKLLEAGVDTLVVDTAHGHQEKMLEVLRQVRALDPQVPVVAGNVVTAEGVRDLVEAGADIVKVGVGPGAMCTTRMMTGVGRPQFSAVVECAAAARELGKWVWADGGIRHPRDVALALAAGASNVMIGSWFAGTYESPGDVLRDSEGRLYKESFGMASARAVRLRTADDSPFERARKALFEEGISSGRMYLDPERPSVEDLIDMIVAGVRSAMTYAGAANLAEFHERAVIGVQSVAGYNEGKPVLHGW

SEQ ID NO: 27913 - protein, 438 aa, Thermobifida fusca
MTERWSSALLTDHYELTMVQAALHSGAAHRRCVFEMFARRLPETRRYGVVAGTGRFLDALEHFRFTPEVLEFLERNGIVNSSTLSFLADYRFSGNIWGYAEGDCFFPGSPILVVEGTFAECVVLETLALSIYNHDCAIASAASRMVNAAHGRPLIEMGSRRTHEEAAVAAARAAYLAGFNATSNLEAGRRYGIPTTGTSAHAFTLLHDSERHAFTAQLESLGTGTTLLVDTYEVMRAVHTAVELAGPDLGGVRLDSGDLEELAVKVRALLNEKGAAKTRIIVTGDLDEYSIQALAIAPVDGYGVGTALVTGSGVPTASLVYKLVARAQSDDPDAPLSPVAKRSVGKPSKGGRKWAVRRYDDNGVATSERVFVHEPELTPLERPLLVPLVRNGEVVGREPLQEARERHVRCVAELPAPARQMSRGEPAIPTVFEQRPAL

SEQ ID NO: 27914 - protein, 508 aa, Thermobifida fusca
MQLSLATILAEAARRHPERTALIADGERISYATLWHESLRHAAALRSLGVSPGDRVALLAGNVADFVRCYYGILAVGGTVVTIPPMLRPQEVAFLLSDTGARLVLAQSLFADLAHAAVDGNDVTVRTVGDPQRPDALAPLVADSEPLPSYVSRAPDDIAVIFYTSGTTGVPKGAMLTHLNLVMNATVNAFDVHPMSGEDVVMGSLPLFHTFGQSVALNTTFRVGATLILQERFDPDEAIRMMCEYGATIFDGVPTMFVRLAEAAAHHTKLPSLRFCVSGGASLPEVVLRRFEEAFSTTIYEGYGLSETSPTASTNQTLYGARVGSVGHPIWGVEVEIARADIDDRIELLPRGEHGEIVIRGHNVFVGYLNRPEATAEAIVDGWFRTGDIGFIDDDGFIHIVDRKKDLIIRGGFNVYPREVEEVLLKFPGISQVAVIGVPDAELGEEVCAVVVPDKEGAVDPAELQAWAQERLGKHKYPRRVEIVTELPLGPSLKVLKRELRARFGGKS

SEQ ID NO: 27915 - protein, 433 aa, Thermobifida fusca
MTRTLWHNWADTCRITPTRIATPTSTAEVVAEVRAAAAAGSRIRMVGSGHSFTDIAATDGTLLSPAALASVRSVDLAAGRATVEAGMRLCDLNETLAAHGAALTNMGDIAVQTLAGATQTGTHGTGRASASLAAQIQQLELVLADGSVVTCSRDEDPDLFDAARAGLGAFGVVTAITMAVEPAFLLHARETPMPLGEVLERLEELRTTNDHFEFFWFPHTERTITKRNNRVPGPARPLSAFRAWLDDEFLSNSVFEVVNRMARRLPRLIPAINQISARALTAREYVDVSYRVFTSPRRVKFVEMEYAIPVEHLPDVLHDMRAVFASSRHRISFPVEVRFAPADDVWLSPGYGRESAYVAVHVYQGCPWQEYFADLEAIFTAAAGRPHWGKMHTRTLSYLDKVYPRLRDALEVRERVDPHRRFTNAYLDRVWGE

SEQ ID NO: 27916 - protein, 453 aa, Thermobifida fusca
MSTPDPLRVAVIGSGPAGIYTAEALTRQSREPVAVDVLDRLPTPYGLVRYGVAPDHTSIKRVAHTLARVLEHPDVRFLGGVEYGTDLTRADLARAYHAVVYATGASVDRRMGIPGEDLSGSVAATDFVNWYSGHPDLEVTRFVLDAEEVAVVGAGNVALDVARILVRSVDELRQTDIPEPVLQVLAASKVRCVHIVARRGPLQAKFSANELRELGKLTDVDVTVDPAVVDLDPNSEEVATAARAARTNLRTLAEWAQRPGGGTGRRVELHFWRKPVAVVGDTRVEGLEVEHTALDADGRLVGTGQREVLPVGMVVRSVGYASSPLPDLPFDETTRTLPHEDGRVVDEQRTPLLGEYVAGWLKRGATGVIGTNKSDAAATVRSLLDDAPKLRTSRVPATTIDDLLKEKGVTASSYADWLAIDAAEAALAAELSRGERVKLSGWAELRRVLAERN

SEQ ID NO: 27917 - protein, 298 aa, Thermobifida fusca
MTWGEDTEEGEAADLLATFVDAGGTLIDTADIYQGGQGERILGRLLPTVVRRDDVIIATKAGHCLDRRRPSNTSRRHLLAALEASLRRLQTDYVDLWQLHVYDPTTPLEETLAAVDSAVASGKARYVGVGQVTGWQLARYATWQQATLASGSSPIVAVGTEYSLLNRECERELLPAARACGVGILAWSPLGRGVLTGKYRTGVPRDSRGASAHMASFVEPYLDEQGRRIVESVYTAAQGLGVPPLGVALRWVLSQPGVAAACVGPRTVAQLSEILAAENVVLPREISEALADASAAAV

SEQ ID NO: 27918 - protein, 361 aa, Thermobifida fusca
MPTTLAAVVRAPGEPVRIEEVALPELGPGLVRVRMAAAGVCHSDLSLASGKLAHPMPAVLGHEGVGHVVDVGAGVSDLSVGDTVLLNWNPPCRSCWHCTHGEPYLCANAADASRRVWGTLADGTDVHPCLGVAAFAQETVVPASACVAIPADIPPTEAALLGCAVLTGVGAVRNAAQVRPGQSVAVIGLGGVGLAAVQGARLAGAAMVIAVDPVEEKEELARSLGATHFLTPSDDLSRRIRALADGRGVDHAIECVGRAATIRAAWSCTRRGGTATVVGFGAATDTLTLNALEIPHFARTLQGCLYGSSDPATDVPELLKLYRDGELDLSSLVSRTIGLDDVPDALAELHAGRGARSLVEF

SEQ ID NO: 27919 - protein, 372 aa, Thermobifida fusca
MALAVPVSALMLGASGCGVIPEEWQTPALMRTEQEYDSRLPVVSGAVGEEPEISFPDIEPPTERIAGVAHHGTDDSALIRDTDLVVAHIVEYQWTDKGKGEQVSSTYEHDAPELLSLTRMPDDLAGSIVNQSVGSRIVFLFPPPTEEERSQYEMMGQEPPEGASVSVVDIVARHGKGDVVPGEQITDVGEDMPTVVDKGRTMPEITIPEDTDPPKDVKAIPLIEGDGPEITKGQNIVVQYTGVRWDDGEVFDSTWNTGLEDRAAAENEDTDGDPLHFQIGVGGVIEGWDEGLVGQRVGSRVLLVIPKDKAYGDKAAERGQPEGTLVFVVDLLGAYNSKPEEEEEPEVVEESEAAPEEAKDDESTDDKENSEE

SEQ ID NO: 27920 - protein, 508 aa, Thermobifida fusca
MGSTATPAAPHVRIAIIGSGFGGIGLGVRLRQAGQTDFVILERAGDVGGTWRDNTYPGCACDVPSHLYSFSFAPNPHWPRSFSGQPHIRAYLEDVTDRFGLRPHIRTGHEVVEARWDPAQLRWTVRTTATTYTCDILVSAAGALADPVIPDIPGLDGFPGQVFHSSRWNHDHDLAGERVAVIGTGASAIQIIPAIQPLVQRLVVFQRTPAWVMPRADRPITRLEQWLFRTIPATQKLARAGVYLTRESMVGAFVRYPALLQAATVVARAHLRRAVRDPELRAKLTPDYVMGCKRILLSNDYYPALSRPNVDVVASGLQEVRGSTLVAADGTTHDVDTVVFATGFHVTDMPIANRIYDGAGRSLADHWRDGMSALRGTTVTGFPNFFLIVGPNTGLGHSSMIYMIESQLNYILSALRHLDSTGSAALEPRRSAQDAWNARLQQRMRRTVWARGGCASWYLDARGCNTTLWPGSTLSFRAATRRIDPAEYHLFPARTPTAPSAPTAPEVV

SEQ ID NO: 27921 - protein, 311 aa, Thermobifida fusca
MVGFGAWQIGDAWGEVSETDAMGALHAAVESGITFFDTADVYGDGRSERLVGRLLREYDGLTVATKMGRRVPQSPEVYNLENFRAWNDRSRANLGVDTIDLVQLHCPPSEVYADDAVFDALDTMVEEQRIAAYGVSVETCEQALTAIRRPNVATVQIILNAFRLKPLEEVLPAAREAGVGIIARVPLASGLLSGKFTADTTFAANDHRSFNRNGEAFDVGETFSGVDYATGLAAVERLRPLVPEGATMAQFALRWILDQPGVSVVIPGARNADQARSNAAAASLAPLPETVHARVRAVYDELIRPQVHHRW

SEQ ID NO: 27922 - protein, 460 aa, Thermobifida fusca
MNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 27923 - protein, 463 aa, Thermobifida fusca
MSNDHLPEFPAGFWFGAATASYQIEGAVHADGRGPSIWDTYSHTPGLVLNGDTGDVACDHYHRYPEDVELLRRLGVDAYRFSIAWPRVMPTGSGDVNQRGLDFYDRLVDALLEAGITPVPTLYHWDLPQALEDAGGWRSRSTAEHFAAYTRAVVARLGDRIRHWITLNEPFCSAFLGYAVGRHAPGAREGTPALAAAHHLLLAHGLAVQELRAADAGEVGITLNPDRILPASDSAADRAAADRAETLHNRVWFDPLFAGRYPANEADVWGELADGSYRRDGDLEIIGQPLDFLGINYYRPLKVADGPLTEADPARRTAVDIRAHQQRFDGVRHTAMDWPVVPESFTDLLLDLTERYPNLPPIYITENGSAEHDVVSPDGRVHDTDRIAYLNDHLHALAAAIRAGVDVRGYFVWSLLDNFEWAFGYERRFGIVRVDYDTLERLPKDSYFWYQRLIEHHRARHRG

SEQ ID NO: 27924 - protein, 504 aa, Methanosarcina barkeri str. fusaro
MPFPARADFSNLAVLNEISGKVAKPGDLVEFSFTVEKGYNTSESTSVTFFIEKVPENWTAGIYADGTQVSQITLPEEADEQELTLKVRVPENAKDGSYPVKIGLRPYGESIRNYDKMYQEFTVTVDRNAMSNLEIYSDIPGKKTHPGIPVSFGATIENKYKSRANFQIYLVSKPKKWGVNLLSTDGARITRLGVPGEGSQQFSVTVNPPINATRGDYEILVAACPEKSNQSVLLPLSVTINPEMAKNEDLSAYVEFNSSIVGLAIRPEKTAEFAVSLRSRYDQPLKLNLKVLSQPEGWNTEFVTDDDEDGRLSSVMLAAGEEQFFTVKVKPFQNATSGLYPITVAAVSGDRTVSRQLEININNDLENAELLKVDSTPTELTLNPGGSSEVRVKVENRRNDPLEDVTLEINEVTGITSQIQGFGTIEELEAGESKTIPVQITANANAGSGVKEIFIRAKSDDIVSSEKSIKVNIEKSSSSGLLGIALLGFAIIVLVFVVRKFGRR

SEQ ID NO: 27925 - protein, 331 aa, Methanosarcina barkeri str. fusaro
MNQYTVLMNEYSHSSRIKPIKVLTFGEALFDIIRGSAHLGGAPLNLAAHLAKLGAKPAVITAVGRDELGKSLLSRAKAMGIDTSYILIDKKRPTGTVTVQLQAEGIPVFTINKGVAWDAITPDEKEFKALSGEEWDVFCFGTLAQRTEENRKTLERLFSEIKAKHFFYDVNLRTGNYKKEWILSSLEHTTILKLNEKEASTISCLLSGTSGTCKPLTSYKAFCRLVTEKYPEIFVICISRGPKGAAVCYKGVYEEVETTPIEVADTVGAGDAFSAGFLYTCLSGYGVSKAASIACILGTYVASKPGAVPDYSKELMEELKAQGLNLSFIKT

SEQ ID NO: 27926 - protein, 322 aa, Methanosarcina barkeri str. fusaro
MLQKFTSLFPLWAVLLSAVAYVYPDYFAPHQGLIVPFLSLIMLGMGITLSVNSFLAVLKRPSAVFLGTLMQYTVMPLIAWIVCLVLKLPSDLAAGVILLGCCPGGTASNVISYLAKADVALSIVLTSVSTLIAFLATPFLTWVLIGQSVEVDVMGMLVSVVKVVIVPVVLGLVINYFFEKQISAIKEVFPAISAAAIVIIIAVIIGTNSANLGKSGPLVLLAVILHNGLGLAGGYGVSKVLGFSETEARTIAIEVGMQNSGLSVALAIKHFTAVAALPGAIFSIWHNLSGAFLAGHWSKQSVSVPDESKMPSKKGIHSKKLG

SEQ ID NO: 27927 - protein, 365 aa, Methanosarcina barkeri str. fusaro
MIFDPITVCNLELQNRFVRSATHEFLAEEDGTPTSKLEDLYEELAKNEVGMIITGYSYVLPGGQSDIYQQGIYDDRFIEPYKKITEKVHRYRSKIVLQIVHGGRQASVSDEYPVPMAPSEVKDSHSAVVPREMTEQEILKVIEAFTKATVRAKKAGFDGVQLHCAHGFLLSNFISPYTNRRTDRWGGSVENRTRIVTEIVRRIKEEAGDSFPILVKMNATDGFQPCCSKAELGLDIFQAVEIAKLLEKAGVCAIEVSGGIGEAGGVTIRTAINTPAKEAYFRDCSKAIKSAVNIPVILVGGIRSLSVINDLLENGSADMISMSRAFISEPDIVLKFKSGKVKKARCVSCNLCFDPEGISCNFQFE

SEQ ID NO: 27928 - protein, 454 aa, Methanosarcina barkeri str. fusaro
MKIKSVNPYTEEVNWTYDSFSFEECESRIENSRAAFSGWSSLSVEERTKYFSRAGKVIRQNAEIYAEIITKEMGKPIRQSRGEIEKCACLCDYYAENAAEFLKDEVVDIGAEKSYVTFEPLGLIFGMMPWSFPFWHVFRFAVPAMCAGNVCVIKHSSNMPASALEIEKIFLEAGFPENVFNTLLIDSKTAMEIIEEELVDGISLSGNIDAGSEIGELAGSLVKPLVLELGGSDPFIVLENADLERAVQVAAKSSFLNTGQSHIAAKRFIVLEDIAVDFIEAFELEIQKLKIGDPMDEETDIGPLAKKEFLDSLERVLKDAKKKGAEPHVYGEEQSKGFFFRPTLIPAASTDMKVCNVEVFGPIVPVITVKDEDEAVKVANSTEFGLGAEIWSRDLERAQRLAKSIKSGFVVINGMVKPDPRLPFGGVKKSGIGRELSHYGLKEFVNIKTVVVNK

SEQ ID NO: 27929 - protein, 388 aa, Methanosarcina barkeri str. fusaro
MATTRDYYDILGLSKDASSEDIKKTYRKLALKYHPDRNKEPGAEEKFKEISEAYAVLSDDEKRAQYDRFGHAGINGQYSAEDIFRGADFGGFGDIFEMFFGGGGRRGPMGPRRGSDLQYDLYITFEEAAFGVRKDIDIPRTERCSNCSGTGAKPGTSPKRCPTCGGTGQIRTTRSGLGMQFVSTTTCNTCHGRGQVIESPCPVCSGTGRVRNTRKITVNVPAGADSGMNLRLSGEGDSGEPGAPSGDLYVVLHVMEHPYFKRVDYDVISELPISFAQAALGTDIMVDTLHGKVKMNIPAGTQTHSVFRLKDKGIQRLHGSRKGDQLVRVVIKTPKKLTHEQKELLRQFEALSNGKNPNEDEKDRNEKSTEKSRKSKGFFEKVKDAFEG

SEQ ID NO: 27930 - protein, 471 aa, Methanosarcina barkeri str. fusaro
MAQEKTEEFEKAQGAEKPEKNKAMEKAMKAGQYFDFFEREAGMFNTIGPRAREIIEQDCKITSACTARPYPLVVDSAKGSVIRDVDGREYIDLIAGIAVMNAGYSNPEVKAAISAQLEKMTHCGYGDFFAEPPVKLAKKLEDLSGYSKVFYCNSGTEAVEAAIKLAFWKTKRQGLISFYNSFHGRTLGSLSLTCSKARQKEHFPVLHTAHSHYAYCYRCPFKLEYPSCGIECAKELENLIFRRELSPTDTAAVFVEPVQGEGGYIVPPPEFHKEVRRICTDNDVLLVADEVQAGCFRTGPFLAMENFGVRAEISCFAKALGGGLPLGAMLADRELMDWPQGIHSNTFGGNLLASAASLASLEFLEKENIEHRVKELGSQMKQRLRELQENFPCIGDVRGLGLMVGVEIVKPDKSIDPIQRDRILRKAFKEGILLLPCGDSVIRFSPPLVITDEELDSGLEKFQKALEKAGT

SEQ ID NO: 27931 - protein, 485 aa, Methanosarcina barkeri str. fusaro
MGCKGRENMQIPDHKTKIVCTIGPASSSEEVIRKLVLAGMNVARINFSHGSFESHSEVIQRVRKVAEELDRTVAILADLPGPKIRIGKLEKEPIMLHKGNSVTLTVAETTGNETRIPVSYKQLPESVVPGSLIYLSDGFIQLRCLEVSGKDVLCEVLIGGQLYSHKGLNLPGAKILVDSVTGKDLEILGFALSKGIDTFSISFIESAEDIRNVRNFAAARGKSVYIVSKIERRQAVENIQDILKETDALMIARGDLGVEIPIQEVPSVQKELIHSAKLLGIPVITATQMLASMTDNIRPTRAEATDVANAILDGTDAVMLSEETAVGNYPVEAVEMMAKIAKTTEDWRSGTKWGLDAIIKGITARDMSVDEVITLQVHEALQKLPVAAVLTPTRSGATPRRISRFKPDTWILAFSRVPRTCGFLSLSYGVYPITVNENIESWEKETTEKAKDLGFVKSGEIVIFTQGPSSGSPGGTNMLKILTLK

SEQ ID NO: 27932 - protein, 450 aa, Methanosarcina barkeri str. fusaro
MEKDYDIIIIGTGTAGRTLADKVAHSGLKIAIIDSGEYGGISPPRGCDTKKMFTDLAGVTDSNNRLIEKGVGTNYPLKIDWPSLIEFKGKVTKECPGRIENHFVEMGIDTYHGKAYFENQNTIVAGEDKIKGEYIFLATGSKPRKLNISGEEYVTTSEEFMKTEKLPERIIFIGGGHISLEFAHVARRAMSEVTILHRSERLLRHSDVDMVNLLIKATEAAGIKILMNKPVASIEKDANGFLVRTGSKSGTESETQSFRADMVIHGAGRVPNIEELHLEKAGIKIEKGAIVVDKYMRTSNPRIYAGGDCTSESLKLNSVAALQGEVAAANILNENSLEVDYTGVPSAVHAIPVLASVGTSASKNSDKYKVIYQDRSNWYTTRKAGMEFAASKVIIDEANNRIVGAYILGPNAEEAINIFAAVIRLGLKASDIKKLVFTYPTTCSDIRYML

SEQ ID NO: 27933 - protein, 385 aa, Methanosarcina barkeri str. fusaro
MYSDRINALPPYLFATIDEAKDELIARGVDVIDLGVGDPDLPTHPHIVEAMREAVCDPKTHQYPSYAGMPEFRKAAADWCKKYKGVELDPATEVLALIGSKEAVAHIPLAFVNPGDVVLYTDPGYPVYKIGTMFAGGEPYPLPLTAENNFLPDLDSIPENILKKAKLFFFNYPNNPTAATADMQFFEKVVKFCKKYDIIAVHDNAYCQMTYDGYESPSFLAANGAMDIGMELYSHSKTYNMTGWRLGFAVGNKDLIMGLGKVKSNVDSGVFDAIQIAGIAALCSSQTCVEETTKIYQERRDALIEGLKAMGLKVKLPKATFYIWAPVPEGFTSMSFAKLLLEEAGIIATPGVGFGEAGEGYIRFALTKSVERIREAVERMKKLKF

SEQ ID NO: 27934 - protein, 400 aa, Methanosarcina barkeri str. fusaro
MLYRKIPKNGDKLSILGFGCMRLPVIEDGTIDEERATRQVRYAIDHGVNYIDTAWPYHMGESEPFLGRALTDGYREKIKLATKLPSWLVENREDMDRFLNTQLERLNTDHIDYYLLHSLAGEVWDKLEPLGVIDFLNKAKDDGRITNAGFSFHGPIEDFKRIVDAYPWTFCQIQYNFMDERNQAGTEGLKYAASKGLGVIVMEPLLGGNLASPVPAEVKDIWDEAETKRTPAEWALRWVWNHPEVTVVLSGMNEESHIEENLKIASEAYPNSLTDTEMQLVNRVEQKYRQLVKIGCTGCRYCMPCPSGVNIPECFEIYNNLHMFGNVEGARFKYAVRMSGVFTNTEPGGFASQCTECGQCMEKCPQNLKIPDLLKAVEEDLEGPDLEQRVAMAKKLFKKG

SEQ ID NO: 27935 - protein, 401 aa, Methanosarcina barkeri str. fusaro
MSSKTTFEIEDKCLPPFFVKQKISIEKGDGVYVWDEEGKMYIDFTAGWGVTCIGHANPVITEALIDQGKKIIQNPNSGLTYSPARARLLSLLAEILPLNLTRVFFTNSGAEANDAAIKLARKVTGRPDIISTDQSFHGRTISTTSATGQAKHRDRYSPLMPNYRFVPYDDLEAMENSLDENVAAVILEPIQGEGGVCIPSEGYLKEVSNLCKKNGSLLIVDEIQTGFFRTGPAFVTSSYGVRADFMTMAKGIAGGFPFGAFALSENVAKKLEIGDHGGTYCGNPLGCAVSYAVIKYLIDNNISRNVEEMGCFALKRMSLWPNIYGNVIADIRGKGLLIMVEFQSEEIATNVKNECLARGLFVTQTQGNGIRIFPALNVKKEELEEGLLIIEDVVKKINLTF

SEQ ID NO: 27936 - protein, 446 aa, Methanosarcina barkeri str. fusaro
MLSPIAWSTPPKKYGPWESIVSLLTEGLVKRGIDVTLFATADSHTAAKLHAVCPRPYEEDKDMIRKVYEGLHISEVFERAKEFDIIHNHFDYLPLTYSALVDTPVVTTIHGISSRKILPVYKKYNNKTFYVSISDAYRCRDLDYIATVRHGIDIGSFYFNEKPQDYLLFLSRLHKDKGVREAIEVAKKTGRKLRIAGFIADQAYFEKEVQPHLDNKQIIYEGHVDPEFKKELLSNAYALLHMINYEEAFGIGVVEAMASGTPVIAMNRGSMPELIRDGETGFLVNSVEEAAEAVQKLGSISRKKCRENVEKRFSVDRMVDDYIKVYETILEKCKREEERPWGFYEVLRQRPGYKVKSLTVLPQGEISLQRHFHRSEHWYIISGEGLVVKNGNEIRVLPGDSVDLPVNEIHRIKNIGSQNLVFIEIAQGDYIGEDDIERLEDKYGRV

SEQ ID NO: 27937 - protein, 394 aa, Methanosarcina barkeri str. fusaro
MEREVKFATKCVHAAEKPDPIFGAHTTPIFQTSTFIFENARQGAARFAGEESGYVYARIPPNTPTHAVLAEKFAALEGGEAGQTFASGMAAVTAIALTALKQGDHLISTDVVYGCTYSLFSQVLPGLGIEVSFVDTSKTENVKRAFKPETKMVFLESPANPTLNVCDIPEIARIARENEALCVVDNTFATPYFQRPLELGADLSLSSCTKYIGGHADLLGGIVAGNNDFIDRMSEVVGYTGGIMGPHEAWLCIRGLKTLHIRMERHAENAMKVAEFLESRPEVEWVRYPGLPGHPQYELARKQMSGFSGMLSFEVKGGIEAGRKLMDNVKLCSLAVSLGATDTLIQHPASMTHACVPHEVRKSVGITDGLVRLSVGIEDPEDIIADLKQALEVI

SEQ ID NO: 27938 - protein, 293 aa, Methanosarcina barkeri str. fusaro
MIIGVLGPEGSYSEKAAQIWTLRHRLDNVKIQYFADIEDAFLAVIQGKSDLSIVPIENSIEGSVGITLDLLLENGVEIVGEIVVKIEHCLLSKGGPEKIKVVLSHPQGLAQCRHFLKKYFPEAELRSTGSTSHAARLAGEFEEMAAIASPEAAECYRLKVLLPNIQDRKENYTRFIALQAAGKISDEQVLCSTEDKTGKPENSSHSAFKTSIIVYLEKDRPGALYEILGAFAKNKINLTRIESRPSKKELGDYYFYIDFEGHTGDALIEKTLKDIENKIDTLKILGSYPAFKT

SEQ ID NO: 27939 - protein, 160 aa, Methanosarcina barkeri str. fusaro
MAEDITKDTSKKIENGDRISVNYVGKLEDGTIFDTSLKEVATEAGLYNQMRNYEPLAFTVGTGQMIKGFDEGVVGMQVGEEKTITIQPEEAYGEYREEFAREIPNNAVNFTPEIGMKLATENGLTGTITKVNEDNFVVDFNHELAGKTLVFSVKIVSVEE

SEQ ID NO: 27940 - protein, 477 aa, Methanosarcina barkeri str. fusaro
MKSNDAKKTVSSVQRIVILGASLAGLSAAEALRSEGFAGTLTVIGDEPYAPYDRPPLSKNVLTGWLPAEHTTLPQSVDLQAEWLLGVPATGLNLDNREVELADGRRFGFDRLLIATGARARPWPDSAQAALDGVCLLRTRDDAAQLRARLAARPKRVLVIGGGFIGSEVASVCRELGLAVTVTERSATPLIGALGAAAGTLAGQLQRVHGVDLRCNVTVMALEGDESGRLRRAYLSDGDILDIDVAVIALGAIRNVEWLHNSRLAFDSHGIACDAACRAFDTDGMVTDDIFVAGDVARWPHPLYEGELLAVEHWGNAIEQARTAAHNMVSAPTDLRAYKTLPAFWSRQFGVNLKTVGLLRFADEVVLTQGSISERRLVAAYGYKGRIVAALTVNMARWLPAYRAMIEDRAPFPPVLHAPDGPAELRPVPAGFPFRGQPTHSPNATQTGPGPSTPPPEESSTSTKVKDPRVPPGFRPK

SEQ ID NO: 27941 - protein, 458 aa, Methanosarcina barkeri str. fusaro
MTGIKSIILAGGSGTRLWPLSREMYPKQFLKFGNTSLFQETVLRCLEISDISEIFVVTNEAQKFFVIGQIEEIGYSLPTENVLIEPEGKNTLPAIFFGMKEIEKKYGRSVVGIFSSDHVLDRVAMQTIASAEDLASDYLVTFGVVPVFPHTGYGYIKPSEACVPGYRVSEFREKPDRETAEKYIKEGCLWNSGMFLFDTELFFDEVKKYAPSVFTCFENGKDINEIYACVDKISIDYGIMEKSERVAVVKLEQKWSDLGNFAAIYDEFEKDPVGNVVHECDPIMLNSDGNLVYSSCGKLVSLIDIKDMVIVDTSDALLVCPKSSSQKVKDIVSALKERNDERAYIGQTVYRPWGSYTLLEASPEHKIKNITVLPDHKLSLQLHYHRSEHWVVVKGMACVEVRGQQFFLRPGESTFISAGEKHRLSNPGKIPLEIIEVQLGELVDEADIVRFDDVYGRS

SEQ ID NO: 27942 - protein, 494 aa, Methanosarcina barkeri str. fusaro
MKAIDRNCECLGLLPVQLMENAGAIIAQHIREKLESGRVLFLAGRGNNGGDAFVAARHLAGSSGYTVKVMLLGKARDIRTKEALHNFSLLKFSRVDVLEITDSSQLEASASEAFQEADLLVDAVFGTGIRGKLRELESMAIDFINREGEAGKTIISIDIPSGLDPDGGDFEKTVHAGLTVTFHHMKTGLLSEKAKEYTGIIKVADIGICADAEQYVGPGDLMMLHRRESGEHKGDSGKILVIGGGPYSGAPALASLAALKAGADLVTVAVPAPVAEIVASYSPNLIVRKLSSNILCPEDLSILMDPINSHDVVVMGMGLGRATETLEAVRKILPFCRKAVLDADALSALSGAIFESLAGNCELIVTPHAGEFTRLRNLETPESLESRIKAVREFSEEKGVVTLLKGKIDITSDGKQTLLNRTGNPGMTVGGTGDVLAGLTGSLFSRNPAFLAAACAVHINGSAGDLAFEKAGNGLLATDVLEKIPEIIKAAEIG

SEQ ID NO: 27943 - protein, 308 aa, Methanosarcina barkeri str. fusaro
MKAIRIHDFGEPDVLKYEDIPESQPGPGEVRIRAIAAGVNPIDWKIRRGYMELPLPMTMGSDVAGVVDAIGQGVDSFQPEDEVFGKASAGQGGYAEYIVVNSTQIAQKPKSIGFIESAAIPTAGLAAWQSLFDIAGLEKGQSVLIHGASGGVGTFAVQFAKWKGAYVIGTASSKNAEFLKSIGCDEVIDYRNQQFEEIVSNLDVVLDTIGGDTFERSWGVLKPGGFLVTTVASIPEGTPQKHGVRAERLITQADGKELAQIAAIIDERKIKPIVTTVLPLADAQKAHEMSESGHTRGKIVLRIAEDPK

SEQ ID NO: 27944 - protein, 336 aa, Methanosarcina barkeri str. fusaro
MKINTWFGNLETARAGEILESRLLSKDVRELALHSLSLRDNKSDLPPEGFDLKNAAIKSGFVESTAEYYSLLHEVTLEAAKLQVSGSLTPDQRIIQAVEALDDINETTNALSERLSEWYGGYFPESGLVGENLALFIVKYGSRENVGSEDPLYSKARNSMGAKLEPADEVLLKGFAENVCSLYERRRQIEAYIENSMELVAPNLKLIAGSMLGARLISLAGSLEKLAEFPSSTIQVIGASKALFKHLRARAPSPKHGIVYSHHLINTAPWWVRGKVARAVASKLSLAARIDFYSGEINPSLTEKLEAKVLQIRTLNPRSPQKRQESGAKPKKRRRK

SEQ ID NO: 27945 - protein, 403 aa, Methanosarcina barkeri str. fusaro
MTENFIGPENLQVTEPENLQAKYDSIIEKDSKYVMQTYGRQPLVLSEGKGAIVRDINGKEYIDCVAGIAVNNVGHCHPAVVRAIQAQAEKLLHVSNLYYTEIQAELAEALVSVTGMERVFFCNSGTEAVEAAMKLARMASGKSAFIAAEHSFHGRTIGALSVTHKSMYRDPFMPPVSSETTFVPYSDADAIRQAISENTAAVILEPIQGEGGVNIPNPEYLKEVREICDETGTFLIFDEVQTGFGRTGTWFCKDQFGVEPDIMSMAKAIGGGFPMGAIAARDGLSFGRGQHASTFGGGPLACAAALASIEAIREEELLKRSKENGAYFMGKLRNMEREDVVEVRGKGLMIGVEINHPCSDFVDFAREHGVLVNCTSESVLRLVPPLVITKEQIDKVVDVLEQA

SEQ ID NO: 27946 - protein, 476 aa, Methanosarcina barkeri str. fusaro
MENYDLIIIGTGSAMNYINPILDSNLKMRVAVIDKDEPGGICLTRGCIPSKILLYPAELIREIETASIFGIKLEIKDIDFLAIMERMRRKSGEDIEAIRKSLTDDPYLDYYHESAEFISPYTLKVGEKTLHSKMIFLCTGSKPAIPTIKGLEEAGYLTSDTVLKLTECPKKLAILGGSYIAAEYGNFFSAIGSRVTVIGRNSQFLPQEEPEISRLASMKMSEYMQIITNHEAIEVRKEDNGQKTVVARNKNSGKEVKVTVDEVLVATGRAPNTDILHPDRAGIKTDTHGWILVNEFLETSQPNIWAFGDANGKYLLKHVANYESGIVYLNAILKEKAKADYHAVPHAVFSYPEIAGVGMREQEAVEKYGEERILIGLKFFEDTAKGSAMEIRDYFVKVILDSEEEKILGAHIIGPHASVLIHQIIPLMYTESRSPEPIMRGMDIHPSLSEVVTRAFYSRLPPEHYHHFLKHIGLED

SEQ ID NO: 27947 - protein, 417 aa, Candida dubliniensis
MFLQNILSVLAVALLIDAAPVKRSPGFIALDFNVMKTPVDQNDPTVRAKRSPLFLDIDHTGFPVDDTGRNDVVKRGPVAVDLDNEIITYAADITLGSNNQKLSVIVDTGSSDLWIPDSKAICIPKWSGQKGDFCKTNGSYTPSASNTSKNLNTRFNIQYADGSYARGNLYQDTVGLGGAFIKDQIFADVWSTSAHKGILGIGFQKNEATESMYDNLPISMKKQGIISKNAYSLFLNSPEASSGQIIFGGIDKAKFSGSLVDLPITSDMRLSVALKSVNVLGQNVNANVEVLLDSGTTISYFQPSIARNIIYALGAQVHFDSAGNKVYVADCKTSGTVDFQFDKNLKISVPASEFIAPLYYTNGEPYPKCEVRVRASESNILGDNFMRSAYIVYDLDDNKISMAPVKYTSQSDVVPIN

SEQ ID NO: 27948 - protein, 397 aa, Candida dubliniensis
MFLKNIFIALAIALLVDATPTTKRSAGFVALDFSVVKTPKAFPVTNGQEGKTSKRQAIPVTLHNEQVTYAADITVGSNQQKLNVIVDTGSSDLWVPDANVDCQVTYSDQTADFCKQKGTYTPSSSSASQDLNTPFKIGYGDGSSSQGTLYKDTVGFGGASIKNQVLADISSTSIDQGILGVGYKTNEAGGDYDNVPVTLKKQGVIAKNAYSLYLNSPNAATGQIIFGGIDNAKYSGSLITLPVTSNTELRISLGSVEVAGKTINTDNVDVLLDSGTTITYLQQDLADQVVKAFNGELTQDSSGNSFYLVDCNVSGDVVFNFSKNAKISVPASEFAAPLQTDDGQTYSKCQLLFDVNDANILGDNFLRSAYIVYDLDDNEISLAQVKYTSESSISAIN

SEQ ID NO: 27949 - protein, 444 aa, Geobacter metallireducens GS-15
MYVCQNCGYQSAKWLGKCPDCSAWNSLVEEVRGKGKGPSAPLSGVAPVPICDVAGEAEERLPCGISEFDRVLGGGLVAGSVILIGGDPGIGKSTLLLQVMDHLARTVGPVLYVSGEESARQARLRGERLGIRAKELLILAETALETVLAQIGAVAPRAVVIDSIQTMYAPGLESAPGSVSQVRECAGRLMVAAKRSAIPTFIVGHVTKDGSIAGPRVLEHMVDTVLYFEGDRGHAFRILRAVKNRFGSTNEIGVFEMKEGGLCEVRNPSEIFLSERPLGVSGSAVVTTIEGSRPLLVELQALVTPSSLGVPRRTTLGVDANRLALLVAVLDKKVGLHMAGQDIFLNAAGGARVSEPAADLGMVAALASSHLDKVIDPQTVVVGEVGLAGEVRAITQPETRVREAAKLGFTRAVIPAGSLKQVTAVEGMEVIGVKSVEEALDRLL

SEQ ID NO: 27950 - protein, 250 aa, Geobacter metallireducens GS-15
MTFITAGDPDLATTEELIPLLAENGADIIELGVPFSDPMADGPTIQLSSERALAAGTTLSRILATVKSVRGRTQVPIVLMGYFNPIFSYGLERFAADAAAAGVDGVLLVDLPPEEAGEFKACADRHGIDVIFLLTPTSDETRIRTVTNRARGFIYYVSVTGVTGVRSGIEASVAGNVNIIKECSKVPVAVGFGIATPEQAGEVAATADGVVVGSAIVKLFEKHRGEELKGALATFVSSLKQAVDRGRYDN

SEQ ID NO: 27951 - protein, 280 aa, Geobacter metallireducens GS-15
MAWFKRDKAPGAADKKVKVPEGLLTKCVSCKANLLTKDLEKNINVCPQCGHHYRISARQRIDLLMDPGSFAEHDAGMTSVDVLNFKDSKSYQDRIQQAVAKGGSRDAVVCGEGAIDAVPVQLAVFDFSFMGGSMGSVVGEKITRAIERGIEKRTPVIIISASGGARMQESILSLMQMAKTSAALAKLKDLGLPYISILTDPTTGGVTASFSMLGDVNMAEPKALIGFAGPRVIEQTIRQKLPEGFQRAEYLLDHGMVDLIVERKDMRARLAQILSMLYRR

SEQ ID NO: 27952 - protein, 439 aa, Geobacter metallireducens GS-15
MERHEQKTATAATWGTQVRTRTMATHRYKQISVLTMNTFAFTVCFAVWVMFSIIGIPIKGALGLNETQFGILAATPILSGSLIRLPLGMWTDKYGGRIVFFILMLCTIVPIYLVSAATAYWHFLLLGLFIGLAGGAFSVGISYTARWFTKARQGFAMGIFGAGNAGAAVTKFLAPSLVVAYGWQMVPKVYAVAMLVTAILFWAFTFTEHSHKVSSTVTIKDQLAALRDPKVWRYCQYYAIVFGGYVGLSLWMTKYYINEYGFDIRTAALVAAIFVLPSGVIRALGGWLSDRFGAHTVTCWVMWVSGGCLLLLSIPHFDVVVTTVNGPVARHVGLNVWVFTSLLFVVGIAWGFGKASVFKHISDEYPHNIGVISGIVGLIGGLGGFVLPIMFGALVDLTGVRSTAFMLLYGSTCVSLFWMYLALKKENVHRKLKTADILE

SEQ ID NO: 27953 - protein, 359 aa, Geobacter metallireducens GS-15
MLRGAIKGMLAETSITAFRGNGSFASEHEVTVTMAGGEQETIWGETIIIATGSSPRELPSAPFDGLHILSSDQMLTNTDLPKKLLIVGGGAIGCEFATLYKTFGSEVVLIEAMETLLPREDRDAGKKLQAAFEAQGITVRTGTSIDRLIVVDEKIRIQFDNGDSIDSIDKVLVGIGRAPNIEGLNLEAAGLRTEHGAVKVNELMQTNVPHIYAIGDVTGGLTLAHAAQREAQLLVQNLLHGSSHALKELAVPRVAFSYPEVAAVGASQEGNGIRAYTLPQVPNGRSVVDKVAPAFVKLFLKEQTSEIAGAVIIGEAATEIIHEMALAVENGLTLQQVGNTVHVHPTHSKNILYAIQSCG

SEQ ID NO: 27954 - protein, 331 aa, Geobacter metallireducens GS-15
MGRYWAMDRDNRWERVERAYNAMVQGEGVQRASSAEAIEASYAADVTDEFVEPSVMVRDGAPVGQLRDGDGFIFLNFRSDRAREITRALALPDCEGFARQARPNLASYVCMTEYDATFGLPIAFGPEELKNILGDVLAHAGIRQLRIAETEKYAHVTFFFNGGVEEPFPLEERCLIPSPKDVATYDQKPEMSAYPVTDELLKRIDSDAYDVVIVNFANADMVGHTGILEAAARAVEAVDSCVGRIVAKVREKGGAVIITADHGNAEKMVDETGGPHTAHTSEPVHLVLVDDSRKGIRLRAGTLADIAPTMLEILGLSQPAEITGKSLIAQS

SEQ ID NO: 27955 - protein, 284 aa, Geobacter metallireducens GS-15
MEPKEEGGLFQKLMHGLAGSIFHGEQANSRIDLSDTRGVSIRIENLNKHFGDKHVLRDVNLEIRSGETFAIIGPSGTGKSVLLRHIVKLVRPDNGEIYIDGHPIFAANGEETTANYRYSMVFQSSALFNSLTVGENVGLWLREKRVCKEQRIGEIIREKLAMVGLEGTEELKTSELSGGMKKRVAIARSLAMNPDLILYDEPTAELDPVTTDELANTIIRLKETTKNTTVIVTHDLNFALYVADRIAMMHGGTIVGAGTPAEIKASENPIIKGFIYTTTKGIKG

SEQ ID NO: 27956 - protein, 229 aa, Geobacter metallireducens GS-15
MKVQSSIEKALEGIQDGATLMVGGFGLVGIPEKLILGLREKGVKNLTVISNNCGVDDFGLGILLQNRQIRKMVSSYVGENKEFERQFLSGELEVELTPQGTLAERIRAGGAGIPAFYTPAGVGTPLAEGREVRSFNGREYLLETGLVADFALVKAWKGDWMGNLIYNKTSRNFNPMMATAAKVTIAEVEDLLDPGELDPAFIHTPGVYVQRIVLCGNYEKRIERRTVRA

SEQ ID NO: 27957 - protein, 472 aa, Geobacter metallireducens GS-15
MHRIAFGTSGWRGILCEDFTFENVKVVTQAIADHVTSIGEKEKGIIVAYDTRFMGERFAKETARVLAGAGIKAYVCKRDTPTPVVSHEILRRKAAGAINFTASHNPPEYNGIKFSPSWAGPALPETTKDIERRANEMLGEVCYREVALDEAARAGLVEEIDPRETYLADIETKVDFTAIASLGTIAVNVLYGTARGYLDEPLMKHGAKIKTLNMHPDPYFGGFPPEPSEKYIQDFIGLVKSDPAVKLGIATDGDADRFGIVDADGSFIEPNYIIALLFDYLVRVRKMTGAVARSVATSHLIDAVAKKHGIEVIETPVGFKYVGELISQDRIIIGGEESAGLSIKGHVPEKDGILACFLVAEMVAREGLSVKALLERLYGEVGRFLTKRENITLSPVLEAGYADKQRQAPAEFAGLKVKDMVTVDGSKFILEDGSWLLFRKSGTEPVVRLYGEASSEEKLAAVMAAGKAFILG

SEQ ID NO: 27958 - protein, 254 aa, Geobacter metallireducens GS-15
MDQVSYAVGGRTILDRFDLFLEPGVNRTILGMSGAGKTTILRLMLGLLKPDGGTISIDGVSICGMRERQLIQVRKKIAIVFQGGALFDSMTVGENVGYRLFEEGRLSEKEIERIVLEKLSFVGLEQTIDLYPAELSGGMKKRVAIARGLAAEPEYIFFDEPTTGLDPVGVYNIRHLMLRLQGEGKTTLMVTHDLETAFAVSRRFSFLHHARLAFEGTEEEMRRCDTPEIREFLTPTDRSLFRYTTNNHTETTTT

SEQ ID NO: 27959 - protein, 306 aa, Geobacter metallireducens GS-15
MGQCCWDTLAVVDSYPSPDSKAEAAVWAEQAGGPTATALVALARLGIPCRFAGVVGDDDAGSRIRQALDSEGVDGAFLVTRRRGASQRAFIMIERGSGRRTIVWRRPTGDPLDPREVPDAFLAGSSLLLLDGLMADASLHAAGRARSLGIPVMVDAGRMRPGMLDITRQCDYVVAAEQFFLDLGWDRTPEHFRGLAADLGAPVVTVTLGAAGSLTWSGHEPFHVPAFTVDAVDTTGAGDVFHGGYGYGILQGWSVRETVVFASAMAAMKCRQVGAQQGIPRLPDVLEFLTRRTITVLSNPQTEVSP

SEQ ID NO: 27960 - protein, 221 aa, Geobacter metallireducens GS-15
MKKIAPSILSADFSRLGDEVRAVAAAGADYIHVDVMDGHFVPNITIGPPVVEAVRKVTELPLDVHLMIENPDRYIPDFAKAGSDIIVVHAEASVHLHRTIQLIKSLGKKAGVSLNPATPLSVLEYVLDELDLVLLMTVNPGFGGQSFIEACLPKIQALRAMLDRRGCNAELEVDGGVKIDNIDRIAHAGANVFVAGSAVFGSKDYKETIKELKRRAKEPIL

SEQ ID NO: 27961 - protein, 200 aa, Geobacter metallireducens GS-15
MTRPLMLMILDGWGINPSAEHNAVAQARTPNLDTLLATYPTTEIQTSGMAVGLPDGQMGNSEVGHLNIGAGRVVYQDLTRITKAIQDGDFFTNPVLLECIAKTRAAGGRPHLARLLSDGGGPLPTTPTSTPWWKLGKAPRGLTGCVSFHGHSRTGPQPPSPQKSGAPNYPGLQLGKREKLPRQLGGPGPHLSTGVMGGAN

SEQ ID NO: 27962 - protein, 306 aa, Geobacter metallireducens GS-15
MGLEDVAPLTPGPAEVVVRLHAVGVNPVDAYIRSGQYRPDLKLPYTPGLDGAGVISAVGSEVKHRHVGQRVYVAWSLSGTYAEEVLCKEFQTHPLPDGVSFAQGAAIGVPYGAAFRALFQRAHAVAGETVLIHGASGGVGIAAVQLARRAGMWVIGTAGTEKGEALVRAQGAHHVLNHRVEGYLDRLQEFPCGKGVDVIVEMLANVNLDRDLGVLAKGGRVVVVGSRGRVEIDPRTAMGKEAAILGMTLYNASDKELAGMHAAFVEGLANGTLRPVVSRELPLAAAAEAHHAVMESSTFGKIVLLP

SEQ ID NO: 27963 - protein, 1112 aa, Geobacter metallireducens GS-15
MARREPLRGGNPLWYRDAIIYQLHVKAFADSDGDGMGDFRGLMGKLDYLQSLGITAIWILPFYPSPLRDDGYDIADYYSVNPSYNTLREFREFLRAAHARRIRVITELVLNHTSDQHPWFQRARRAKPGSAHRDYYVWSDNPDRYQGTRIIFQDFETSNWSWDPVAKAYYWHRFYSHQPDLNYDNPKVQAEMLRVIDYWLGMGVDGVRLDAVPYLFEREGTNCENLPETHAFLKKLRAHVDASFPNRMLLGEANQWPEDAIAYFGEGDECNMLFHFPLMPRMYMAIEMEDRFPVIDIIDQTPAIPEGCQWAIFLRNHDELTLEMVTDEERDYMYRIYAADPKARINLGIRRRLAPLMERDRRKIELMNALLFSLPGTPIIYYGDEIGMGDNYYLGDRNGVRTPMQWSPDRNAGFSGANPQRLYLPVIIDPEYHYEAVNVEIQERNPTSLLWWMRRTIAVRRRHRAFSSGTLEMLYPANHRVLAFLRRHEDEVILVVGNLSRFAQAVSLDLKEFAGISPADLFSRNRFPVIREIPYPLTLGPHDHFWFILSRAESPRLPEGELPRINLPGGLPWWEALQHTGGDTRLERATTDYLNRSGWFRGKARAIIGYALRDTVLLRTSDQVFPLFFLEVRYQNGAPETYLIPVAFLRGPGAKRVDAESPQAAIASLSVGDEAGILCDALHDREFRDALLALALGRRRLHGKRESLVVPLHGRGGHAEGMRETEHLISELVTGEEASSVILYGDRHVFKLYRTVEPGVNSEVELVRFLTEKSRYPNIVPFQASLELRHPGTEPCTIGLVQEYVKNQGNGWRLALHLLGQYFERILSRRGEIPPPPKRFSSLIDGSACTVPEPVANLIGGFYLEMAGLLGRRTAELHLALAAGGNDPAWKPEAYSTIYQRSVYQSMRNQARRTLQLLSQNRNLLPIDDQGPADRVLGAEKEILSWLAQIVGRRIGTMKIRIHGNFHLGKVLFTGKDFVILDFEGEPDRTLSERRIKRSPLRDVASMIRSFHAATLTALARHGNGRSGDVQLLEPWADACYYHVSCRYLAGYLERMGNSPLVPADRNDLATLLRSFLLDRALRDLGFALGNRPETASSPLKGIETVLREYGE

SEQ ID NO: 27964 - protein, 408 aa, Geobacter metallireducens GS-15
MEFPVSQVLTEDASHDEINELIASHGGKCIVKPVFLGGVGKKGKAGLVRICSNVFDAMVAKRDLFFATHHQGNREVQACGVTFEGYIASDIEIYVSISESSEYRMPVLLLTTKGGVDVEDVPPEDKRTIVFNPVTGVKSFHINDALRELKCPPQYISSLVQHLPKLWQVYDNYGLTTLELNPIRMGKVKGRYVPFACDIKASFDQDNPAWKRLGYPEEIFSTTITQFESEINVLRTHQGQSDVTEVNPKGTILPFIFGGGANSAATEILADRAIISSDFGGNPPYEKIRAIADITFKHWLPQANVVLLIGGRANNTNIFTTFKAIFDSLREHIRLNPDVFVVAGRGGPMVVEGMVYGRDVLDSLRVPYRFFGHDSSMMSVLQHAIEIDSFLEPKPVAVAPKQIKAKAA

SEQ ID NO: 27965 - protein, 414 aa, Geobacter metallireducens GS-15
MARDFQLDTLLIHGGLEPGPAGATTVPIVQSSSFAHETAEDLEDIFRGRKAGHVYTRINNPTTESLERRLALLEGGISAIATSSGMAAITLAVLSIVRCGDEILSSASLFGGTFSLFRDTLSNYGIATRFVDPSDLAAMRAAVTERTRLIFVETMGNPRLDVPDLAALAAIAREAGVPLVVDATVTTPVLGRVKELGADIIVHSTSKYINGTGSAIGGAIIDCGTFDWRRESYPHFEPYVKKFRQFAFSARARKLIHKDLGACPAPMNSYLLSEGIETMALRMERNCANAQRLAEFLAAHPKVAWVNYPGLTSSPWHETAKAQFGGRYGALLTFGLADKAAAFHCIDGLRLAKNLANIGDTKTLVIHPASTICADFGPEEKALMGVSEEMIRVSVGIEAIDDIIEDFAESLNAI

SEQ ID NO: 27966 - protein, 287 aa, Geobacter metallireducens GS-15
MAAGIEADIVAKLESFNPGGSVKDRIGVSMIRDAEGRGLINKDTVIIEPTSGNTGIALAFVCAARGYRLVLTMPDTMSVERRNLLKAYGAELVLTRGAEGMKGAINKAEELAADIPNSFIPQQFRNPANPHIHRFTTAEEIWTDTDGKVDVFVAGVGTGGTVTGVGEVLKKRNPGVKIIAVEPFDSPVLSGGHPAPHKIQGIGAGFVPEVLNREAIDEIFTVRNEEALETARRLAREEGLLVGISAGAAAFAALEVARRPENKGKRIVVVLPDTGERYLSTVLFQDQ

SEQ ID NO: 27967 - protein, 115 aa, Geobacter metallireducens GS-15
MTRSLPWLVELVPDMFVELSETLAQRKGIKQGDTVKVTTERGSIEAVALVTSRLKPFNVQGRMIEQVGMPWHFGYAGLAKGDSGNVLTPTVGCANTGIPEFKAFLCNIEKGGKRA

SEQ ID NO: 27968 - protein, 372 aa, Geobacter metallireducens GS-15
MAEKRDYYEVLEVHRNASDTEIKKAFRKLAIQYHPDKNPGDKESEEKFKEITEAYEVLSDSQKRAQYDQFGHAGLGAGGFSSGGFGGFGAGTPFGDIFGDIFGDIFGGRPRGSRGRRGDDLQYNLELSFEEAAFGVEKEILVPFGKRCDECGGSGAKPGTEPKVCPTCRGAGQVRFQQGFFSVSKTCSHCNGEGRVVENPCPTCRGNGMVRDTKTLSVKVPAGVETGTRLKMTGEGGQGTKGGGNGDLYVAIAVKEHPIFTREDNDVICEIPISFVQAALGCEMEVPTLDGKVSMKVPEGTQSGRIFRLRGKGVPQLQGYGRGDQMVVVKVETPSNLNKRQRELLEEFARISGEDAHPMKKNFFDKVMDLFS

SEQ ID NO: 27969 - protein, 398 aa, Geobacter metallireducens GS-15
MAIRYIDEIESLKGKKVFIRVDFNVPLDEHQNITEDTRIRAVLPTINFALDAGAKVILASHLGRPKGERKPKYSMAPAAKRLSRLLNKEVQLAPDCIGDEVKKMIDAMKPGEVLLLENVRFYEGEEKNDADFAKALANDCEIYINDAFAVSHRAHASVEAITKFFPVVAAGFLMNNEINYFEKAMQKPIRPLVAILGGAKVSGKLEVLESLVNKVDKIIIGGGMAFTFLKALGYNVGKSLVEEELLEIALTTYTKAREKGVKFYLPVDCVAADRFNPEAETKVTTIQEIPEEWMALDIGPATVTLFTEALQNAKTIIWNGPMGVFEMDAFSRGTFAMVSAVANSYALTIVGGGDTDSAVHRAGEYAKISYISTGGGAFLELLEGKHLPGIKVLEENGK

SEQ ID NO: 27970 - protein, 192 aa, Geobacter metallireducens GS-15
MLSAQDCFWEEEGAFTGEISPGMLVDAGCSHVIIGHSERRQYFGETDETVNRKIKAAITAGLTVLFCIGETLAEREADKTFEVLRTQIENGLAGLARGDLAKIVIAYEPVWAIGTGKTATDEQAQIAHAFIRKVVGELFTVQIAETIRILYGGSVKPENVRGLMNQPDIDGALVGGASLKADSFGAIVNYKA

SEQ ID NO: 27971 - protein, 436 aa, Geobacter metallireducens GS-15
MNYVIIGNSVAAVGAIRGIRSIDQQGNITVISRERHVAYGRPLISYLLGGLITEKRMAYLPEDFYEKNRVNLLLNAEVVGVDTDNRKVTIAGGDVIVYDKLLVATGGDPFVPPIEGMAGKDRIFTFTTWDDAAKLKGIADDIEKVVVIGGGLIGLKAAEGLHLIDKKITIVELADRILSAAFDRPAGRVVAKKMKANGIDVITEDTVVRIEGDGAAITGVTLKSGDFIPCDTVVVAIGVRPAAGFLKGSGVEVNRGIVVDDLMETNVKGVFAAGDVAEAKDFFSGVKNPMPIWPDAYIQGDIAGVTMAGGSKGYQGGIAMNSIELFKVSTISMGITNPVEPKEYEILTYQDLENYQYRKIVLKDGILAGAVLVGAVDRAGIFAGLIRDRIEVSSFKDHLLTPDFGFVNLPREIRSTLFAPVGKVTGAYEQARAVGH

SEQ ID NO: 27972 - protein, 469 aa, Geobacter metallireducens GS-15
MQIKFGTDGWRGVIARDFTFDNLSRVAQATMEYLIREGLAPRGLVIGYDRRFLSREFAERVAEIAAGNGIRVWLTAGYAPTPAVSWAVHELGAGGGVMITASHNPPAYNGFKVKESFGGSARPSTTKILEEMVAANDAAGREIKARPLAEALADGSVATFDPKGGYFRQLARYVDLEAIRKANLPVVVDPMFGAGAGFVPELLPGVREIHGDENPSFGGQPPEPTEEHLTELAALVASGRYRIGLALDGDADRIGAVDETGEFFSSHRIFTVILRHLVERKGLTGGVVKTVSTTRMVDLLAEKFGLPLHETPIGFKHICELMLDHDILMGGEESGGLGVKGHIPERDGILMGLLLLEAMAVSGKGVRQLLDETMDEIGRFCYRRIDLPIADAAKELLIARLKQGGIASIAGRNVARENFRDGFKFIFEDGSWLLIRPSGTEPVLRLYSEAGDAQTVEELLAAAREIAGL

SEQ ID NO: 27973 - protein, 385 aa, Geobacter metallireducens GS-15
MKTYGRYPLVPVRGEGCRVWDADGKEYLDFLAGVAVNNLGHCHPKVVAALQKQAAEMIHCSNYYNIPTQIELAELLCSNSFADKAFFCNSGAEANEAAIKLARKYAREKTGDVERYEIITAIASFHGRTMATISATGQEKVQKFFDPLLHGFTYVPFDDADALEAAVTPKTCAVMLEPIQGEGGVVIPSADYFRKVREICDRHGLLLIFDEVQVGIGRTGKLFAHEHFDVTPDIMTLAKALAGGAPIGSMLAKDEVAASFSPGTHGSTFGGNPLVTAAGVAAVRAVLEEGLLNRAEEMGEYLVGELERLKEKYAFITDVRGIGLMIGMELSAPAGEIVLKGLERGVLLNVAQDKVLRFVPPLIVTKQEVNEMIAVLDGILEEIKQ

SEQ ID NO: 27974 - protein, 364 aa, Geobacter metallireducens GS-15
MILGHCHPRIVASVQRATENGSSFGAPTELEITLAEMVVAAVPSIEMVRMVSSGTEATMSAIRLARGYTGRDKIIKFSGCYHGHADSLLVKAGSGAATFGVPDSPGVPRDFAQHTLTATFNDLESVEELICAHSREVACIIVEPIAGNMGTVPPRAGFLEGLREICTNEGIILIFDEVMTGFRVAYGGAQERYGITPDMTTLGKIIGGGLPVGAFGGKREIMQQLSPSGGVYQAGTLSGNPLAMTAGIETLKLLQEDGFYGRLEEKSRALAEGIADAARRAGYPIYSTRVGSMFCAFFTNGEVHDWTSAAMCDTKSFATFFRSMLEEGIYLAPSQFETAFVSIAHSSEDIEKTIAAAFSCFKKL

SEQ ID NO: 27975 - protein, 484 aa, Geobacter metallireducens GS-15
MMILKNSSLLKQQCYLDGHWCCADGGATIDVTNPATGEILGVVPKMGTQETRRAIEAANGALDGWKARTAKERSAILRRWFELIMENLEDLAVIMTAEQGKPLAESRGEIAYAASFIEWFAEEGKRIYGDTIPSYARDKRIVVIKEPIGVCAAITPWNFPAAMITRKAGPALAAGCTMVVKPATATPFSALALALIGEQAGIPAGVFSVITGSSKEIGDEMTGNPIVRKLTFTGSTEVGKQLTAQCAGTMKKVSMELGGNAPFIVFDDADLDAAVEGAIASKYRNTGQTCVCTNRILVQESVYEAFSAKLVAAVSKMTVGDGLKGEVQQGPLIDMTALEKVEEHIADAVAKGARVVLGGKRHALGGTFFEPTIITDVTPGMLVAREETFGPLAPLFKFSTDEEAIRMANDTEFGLASYFYSRDIRRVWKVSEALEYGMVGINTGLISSEVAPFGGVKESGVGREGSKYGIEEFVEVKYLCMGGI

SEQ ID NO: 27976 - protein, 480 aa, Geobacter metallireducens GS-15
MDKSSRKTKIVATLGPASSSPEMISKLMEAGADLFRLNFSHGANDQRRETIATIRRLSAARGKEIGILADLQGPKIRTGRMENGAISLRKGDPLDIVTDEVLGTPTLISTIYKALPHDVKPGSRILMDDGLIELKVHSVEGNLVRCTVVEGGTLKDLKGINLPGVHVSAPSLSEKDLRDLEFCLAEGVDYIALSFVRSAEDVEGLKRILFERGIHIPVVAKIEKPEALRNFKSILKAADGVMVARGDLGVEISAEKVPLFQKKIIRACNEAGKPVITATQMLESMISHPRPTRAETSDVANAILDGTDAVMLSGETASGQFPLEAVRTMAKVALDVERYAQMEDTLPQRRHNPSIAEAVAEAACRAAVTVDARAISVMTQSGSTAALISKFRPPLPIIAFTQSLETRRRLSLYWGVKPLPIGPMTGTDEQIAAVESTFLSAGYRKGDVIVITMGVPVEARGSTNLMKVHKLGTGKFFEIF

SEQ ID NO: 27977 - protein, 1128 aa, Geobacter metallireducens GS-15
MNTTEPTTLPVSFRRLNLAQALGALNDNLIKLIIVFYLIGRYGREEAGTIAAMGSAAFVAPFLLFSALAGSLADRFPKGRIVVGVKALEVGIALLAVSGLFLASPPLLYGAVFLLGTHSALFAPAKYGVVPELVPREGLSKANSLLEMASFLAIVGGTALAPFLVQLAGGRHGVALLAGVAIAVAGLLIARTLPPTPAVAPDRAISFLPTSYWRTLRSLKRDGYLLLAVIGAAYFLFVRAFCQLNLLPYGMKILALSEEQSGYLFLAAAIGIGAGSLWAGRLSGRTVEFGVVPIGAVGLTVCSFVLAMMPASLWAVLAVVALFGVSAGLFIVPLQSFIQLRAPADRRGEVLAASSFLSWVGVLLASGLLWVLSGPLGFSPGSCFTVLGAITLVLTAVTLRVLPDFLLRFIALAVMRIRYRVTTIDDRHVPVEGGALLVANHVSWLDALILLATQQRRIRFVMEREIYSAPGLKQLCALMGVIPVSSRDGKRGLLEFIATARKALDDGYLVCIFAEGEITRTGMLNRFKGGFEHIVKGTSHPIIPVYIGGAWGSALSYAHGRLLSRLPSLIPYRVTVLFGAPVPAGSTPHDVRRAVMELSAAWFEARKPRRRALGELFAETARENWHRLAMADTGGRELTYGRALTGAVALAAKLKDATPGQEMVGVCLPPTVGGALVNLALTLNGIVPVNLNYTASPEGIRSALAQCAITTTITSRVFLEKLGTLPEFPGVLYVEDLLAGLTDGDKRRAFLTARFLPLRTFARPAGFDADRLATVIFSSGSTGEPKGVMLSHHNILSNLEALRMVFRATQRDNICSALPFFHSLGFTGTLWLPLLSGFSAVYHTNPLDGETIAKTVRERQSTLLIATPTFLMAYLRRAKKEDFATLRLVITGAEKLKPKLADTFQEKFGIRPMEGYGATELSPVISLSLPDVEVNGVRQIASRQGSVGLPVPGVVVKIVDPDTFAALPEGEAGLILVKGPNVMLGYLHKPEKTAEVVKDGWYVTGDIGRLDNYGFLHITDRLSRFSKIAGEMVPHGAVEDALHARLGMTGVVAVTGIPDEKRGEKLVVVFAREAGDAETLHRLMAESDLPNLWKPGRDCYVAVDALPLLGTGKLDLRGVKEAALAVVG

SEQ ID NO: 27978 - protein, 470 aa, Geobacter metallireducens GS-15
MTPQEVVSFAKENGALMVDFKFMDFVGTWQHISVPITEFSEDTFEEGQGFDGSSIRGWQPIHASDMILLPDPDTAKMDPFVAVPTLSLICNVFDPITKEDYTRDPRNIARKAEAYLKSTGIGEIAFFGPEAEFFIFDEVRYDSSSNQSFYMVDSVEGAWNSGREEFPNLGYKPRHKEGYFPLSPTDSQNDLRNEMVMELQKVGIRVECQHHEVATGGQAEIDMRFSSLVDMADQLQWFKYVIKNVAYRNSKTVTFMPKPLYGDNGSGMHCHQSIWKNGQNLFAGDKYGGLSQMALWYIGGIIKHAKALCAITNPTTNSYKRLVPGFEAPVNMAYSSRNRSASIRIPMLSTNPKAKRIEYRTPDPSCNGYLAFAAMLMAGLDGIENKIDPGQPLDKDIYGLSPEELKDIPSAPGTLEDALNALRDDHEFLLKGDVFTPDVIEKWIEYKMEAEVNPVRMRPVPLEFALYYDI

SEQ ID NO: 27979 - protein, 397 aa, Geobacter metallireducens GS-15
MPIATKIAGHISKSSWIRKMFEEGERLRQVHGAENVYDFTLGNPDTEPPREFQEEFARLATNPIPGMHRYMNNAGYQETRAAVAEVLAEASGLPVEAGHVVMTCGAGGALNVVLKTILNPGEEVIILTPYFVEYKFYIDNHGGVPKEVWTNRETFQLNIPAIEAAITNKTRAVIICSPNNPTGVIYPEESLKELGEMLARAERRYDRQIYVISDEPYARIAFDGKHVPNIFRYVESSVIVTSHSKDLALPGERIGYLAVNPSARGVEQFVEGAVFSNRVLGYVNAPALMQRLVTKLQRASVDIGEYQSKRDLLYDRLTAMGFEMVRPDGAFYLFPKSPLTDDVEFVKMAQKHRILLVPGAGFGAPGFFRIAYCVDRGMIERSLPAWQQLARETGLGG

SEQ ID NO: 27980 - protein, 355 aa, Geobacter metallireducens GS-15
MKTLQELRRDIDAIDDQILDLLNSRSRLAIEVGKVKAGENRDFHVPSREREIYERLAAGNSGPFPNEAVRSVFREIISASLALESPMKVAFLGPKATFTHLASLQHFGLSAELVPQKSIPAVFEEVSKGRSLYGVVPVENSTEGMVSHTLDMFMESDLKINAEILLEVSHDLLSRTGRLEDVKKVYSHPQAIAQCRNWLDENLSGVPVVDVASTALAAQIVGEDYTAAAIASEFAAALYDLKVVRHRIEDQVNNFTRFLVVGRKMADRCGDDKTSLMFSVKDEPGILHRMLEPFAKRGVNLSKIESRPLKKKAWEYIFFLDLAGHISDPVVSDAVQELKNYCQFVKILGSYPRAK

SEQ ID NO: 27981 - protein, 436 aa, Geobacter metallireducens GS-15
MKTIASFFRFDHYRTSFRKETVAGITTFLTMAYIIIVNPAILEAGGIPRGPQTTATILAAVFGCVVMALWANRPFAIAPYMSENAFVAFTVVKTLGYTWQTAMGAVFVAGIVFSILTVFRVRSWLAEAIPLSLKCAFAVGIGLFLTFIGLNETGLVTLGVAGAPVKMGNIAAPSVLLAVFGYLLTVFLMTRQVRGAIVIGIVATTTLSIAFGVTPMPKEFVSLPPDISPILFQLDIGSVFEIRFFPVVLTIFIMAFLDTVGTLIGLSMRADLLDEHGNLPEIEKPMLADALATTVAPLLGTTTTGAYIESAAGIEEGGRTGFTALVVAGLFLLALFFAPLFTIVPSHAYGIALIVIGSFMIEPIKRIAFDDFTELVPAFLTIVLMIFTYNIGVGMSTGLLTYPLLKAAAGRGREVPAGMWVLALLAVSLFVFFPKM

SEQ ID NO: 27982 - protein, 332 aa, Geobacter metallireducens GS-15
MIGLGRMGADMVRRLRKGGHECVVYDLNVNAVQALEREGIAGARSIEEFCAKLVKPRVVWLMVPAAVVDSMLQRMTPLLAANDIVIDGGNSHYQDDIRRADQMRAQGITYVDVGTSGGIFGLERGYCLMIGGEKQAVERLDPVFRTLAPGIGAAPRTPGREKREGTAELGYLHCGPSGAGHFVKMVHNGIEYGLMAAYAEGLNILHHANAGKEGQGADAETAPLRNPDFYRYDLDLADITEVWRRGSVISSWLLDLSATALLDSPDLQEFQGRVSDSGEGRWTVAAAIDEGVPAHVLSSALYERFSSRGEDDFANRLLSAMRYEFGGHREKS

SEQ ID NO: 27983 - protein, 382 aa, Geobacter metallireducens GS-15
MGFQGLLTDEEKLVRETARKFVNDEVLPIIEEHALNETFPSHLIPKMGELGFYGPNLPEKYGCAGLSNVAYGLLMYELERGDSGLRSFASVQGSLVMYPIYAYGSEAQKEYWLPKLAAGEKIGCFGLTEPDFGSNPAGMRTNAVREANGKWRINGSKMWITNGSVADVAVVWARTDDGVRGFLVEKGTPGFSAPKMHGKWSLRASVTSELVFEDVIVDEEKSLLPNVKGLKGPLGCLTQARYGIAWGALGAADACYQAALEYALSRIQFDKPIASYQLQQRKLAEMVTEITKGQLLVMQLGRLKDQGNYSPAQVSMAKMNNVHVAINICRTARTILGANGIMSEYPIMRHANNLEAVYTYEGTHDMHLLIIGEKVTGISAFR

SEQ ID NO: 27984 - protein, 397 aa, Novosphingobium aromaticivorans DSM 12444
MSITPLMPVYPRCGVRPVRGEHCHLISEDGTRYLDFASGIAVNLLGHSNEHLIGAIQKQAATLMHVSNLYGSPQGEHLAQRLVDLTFADTVFFTNSGAEAVECAIKTARAYHSSVGNDHKYELITFKNAFHGRTMATISASKQEKMHKGFLPLLEGFKYVDFDDLEGAKAAMGPNTAGFLVEPIQGEGGIRDASDEFLKGLRALCDEHDLVLIFDEVQCGVARTGTLYAYEQYGITPDVMATAKGIGGGFPIGACLATEKAARGMVAGTHGSTYGGNPLAMAAGEAVLDVVANEEFLGEVRAKGERLRGRIEQFIGNYPDLFIGVRGRGLMLGLMMKVEPRPFVAHMRDNHQLLTVSAGDNTVRVIPPLVIDDSHIDEFMERLSAAAASYAPEAPVT

SEQ ID NO: 27985 - protein, 360 aa, Novosphingobium aromaticivorans DSM 12444
MLHDFPFLTPQGSTAILREPIGVCGLITPWNWPLYQITAKLAPALAAGCTVVLKPSELSPFSAALLAQIVHDAGTPAGVFNMVTGTGPGVGEAIAAHGDIDMVSITGSTRAGVLVAQAAATTVKRVTQELGGKSPNILLDDADFERVVPLGIAAGMRNVGQSCSAPTRMLVPRHRLTEVEQLAANAANALVVGDPLAEATDLGPVANSRQFDKVQQMIAVGQAEGARLLCGGPGRPEGLDRGFFCRPTVFTCDDPAMRVAQEEIFGPVICVIPYDDDDHAVRIANDTIYGLGSHVQSADIDRARTVAARIRAGQVHINHPAWDGHAAFGGYKQSGNGREYGRFGLEEYLETKAVLGYFPQ

SEQ ID NO: 27986 - protein, 410 aa, Novosphingobium aromaticivorans DSM 12444
MSSSDNMSDLGPGTRGVLAGRREEWTGTPDHPGAVVNPAVWRASTHLYPDMAALRAHPANEDGRFYYGRRGAPTQWALAEALTQIEPGAAGTVLYPSGVAAIAGVLLTMLRPGDVLLMTDNAYEPSRVMARGLLRDFGVETRWFDPTSIGAFEAACCDRTKAVLLESPGSLTMEVQDVPALAAAAKARGIVSVLDNTWASPLGFAGLSHGVDIVAMSLTKHVSGHSDCMMGSASAGPDWYRKLRLRSQGLGLVVSPDDASLMLRGLRTMKMRLEAETASALAIAGWLEGRPEVARVLCPMLPGSPGHELWARDFAGGCGLFSFVLKGGSSAARDALIDALALFGIGYSWGGFESLATPVDPASIRTASAWPLAGMAMEDRFGVRLSIGLEDTADLIADIEQALGAWRAAL

SEQ ID NO: 27987 - protein, 505 aa, Novosphingobium aromaticivorans DSM 12444
MTWEPEIEELRRREAMAEQMGGAEKVARQHARGKLDARARIAGVVDAGSFREIGKIAGKGRYGPDGELLDLAPSNLIFGRANVEGRPVVASADDFTVRGGAADAAIARKFIQCEQMAHTLKIPLIRMIDGTGGGGSVRTLEDIGATYVPATPGWGDVVRNLDTVPVVALSLGPTAGLGAARVVASHYSIMVKGLSQLFAAGPAVVAAIGEDRDKEGLGGSAIHTRNGVVDEEVANEAEAFARARRFLSYLPSHVGGAAPRTVAADPTDRREDFLIDLVPREAKQVYSMRRLLDAVVDKGSLFEMGRLWGRAVITAFARLDGWPVAVLASDPSYLGGSWDARSSEKAERFVKLADQFRLPLVHMVDNPGFMIGHTAESTGTIRYGVQAMNAIYKATVPLCSVIVRRAYGIAGSAMSNAEAFQYRFAWPSGDWGSLPIEGGIEVAYKSEIEAAEDPAAHLGAIRDRLNRVRSPFRTAERFGVEDIVDPRDTRPLLCEFANLAWRTLP

SEQ ID NO: 27988 - protein, 470 aa, Novosphingobium aromaticivorans DSM 12444
MLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMAVASAEIFGPVVPVIRFADEPQAIRIANDTPYGLAAYFYARDVGRIWRVMEALEYGMVGVNDGIISTEVAPFGGIKHSGLGREGSRHGLDEYLELKYCLMGGIDR

SEQ ID NO: 27989 - protein, 338 aa, Novosphingobium aromaticivorans DSM 12444
MLAPLTNQQSHPDGRLSDEELRWLEMRGQGGFGMVMTAAAHVQAIGQGFPGQLGVFSDDHVPALSRLADALRRSGAVSAIQLHHAGSRSPAALVGTPVSPSASDNGARALTLQEVERLRDDFIAAAHRADRAGFDGVEVHGAHGYVLAEFLSPTINRREDRYGGSAENRARIVFEVIEGIRATCRPDFQIGLRLSPERFGQDLGEILAVAARAMGEARIDYLDMSLWDVFKHPEDETRRERTLLEWFADLPRGKVRLGVAGKIMGGRDAAHVLEQGCDFAVIGRAAILRHDFPERVRQDGDYVSPALPVTARHLADEGLSKPFLDYMRTWKGFVTEDA

SEQ ID NO: 27990 - protein, 356 aa, Novosphingobium aromaticivorans DSM 12444
MADLFSPVRLGEIELANRIVMAPMTRDRAGPHDEPTDLMVEYYRQRASAGLIVTEGTQPSPNGKGYWRTPGIHSPEQVEGWRRVAEAVHGEGGRIAVQLMHVGRASVRANKAPDAETVAPSAIPCPDPIPGPDGVPVPTEMPRELAAHEIPGVIAEYVAAARNARAAGIDGVELHCASGYLPMQFLSSNSNQRGDAYGGSAENRVRFVVETLSALAAAISPGRVGFRICPGVKFNGMDDADPAETYATLLRAVDHMGLAYCHLIHIPNQGFDSLDLVRANWSGPVIENCGLTRERAEKVLAEGKAEAVSFGYAFIGNPDLVERLRTGAPLAKADRDTFYTGHGDDARGYTDYPRAG

SEQ ID NO: 27991 - protein, 509 aa, Novosphingobium aromaticivorans DSM 12444
MVRCLADRPRNLAEFLAAALARDPEGEAVVEGERRMTYAGLDRAARALAARMIALGVTPGDRVAVLLGNRIEYPVIVLACTFAGAIAVPMNIRQTAAETAHALAASGARLLFHEADARLPDRAQVPALAALVAIADDAPLAETLAPQDVPVSALPPLPGEDEPAVILFTSGTTGKPKGAVLTHCNIAHSILHFCHHYALREGERCLLAVPASHVTGLVALLATSLGLGGCLVIMREFKAGEFLRLMAQEQVGYTLVVPAMLTLALMQPQFESAALSNWRVCGFGGAPMPDATIADLALRLPGLALHNTYGATETTSPAVIMPADQAAARSRQLGLPVLCCDLLVMDDQGRECPPGEQGEIWMAGPMVIPRYWNDTAATAAAFVHGYWKSGDIGSRDADGHVSIHDRMKDMINRGGFKIYSVEVENALCAHPAVIEAAVVGRPCPVLGERVVAFVHAGAPASAEELRAHVAARLSDYKVPEDIRFETVPLPRNANGKLLKHALRDRLVGA

SEQ ID NO: 27992 - protein, 502 aa, Novosphingobium aromaticivorans DSM 12444
MASSEGQLSKLGEAARTFLATRPGLLIAGRNTPAASGARRDVLDPSTGLVVTDVAEGGAADVDAAVAAARATFQSAEWRDMRPLARERLLHRLADLIERDADILAELEVIDTGKILPMARHGDLVIALDSLRYMAGWTTKIEGTTIDPSFSYIPPIRFSARTVRQPVGVVGQIIPWNFPLVMAIWKIAPALAAGCTVVLKPAEDTPLTALYLGRLIAEAGFPAGAVNIVTGGREVGMAIVEHPGIDKIAFTGSTAAGQDIQRRAAATMKRLSLELGGKSPVVILEDCPVPMAVEGAAGAIFFNHGQVCTAGSRLLVHRSIYEDVVQGLAHAANGMVLGEGMDPAGQMGPLISARQRDRVAGYVQGALDQGARLLAGGEAPDRDGFFYRPTVLADGTPSMTIFQEEVFGPVVIAMPFDTEEEALALANDSCFALGASVWTQNLAAANRFAGALRSGNVWINAHNILDPAVPFGGWKMSGYGRELGHSAVELYTEAKSITMPLL

SEQ ID NO: 27993 - protein, 394 aa, Novosphingobium aromaticivorans DSM 12444
MAGMVRFDWEDALGLEGLLTDDERMIRDAARAFAQDRLQPRVIDAFANEHTDPAIFREMGEQGLLGVTLPEDYGCAGAGYVSYGLVAREVERVDSGYRSMMSVQSSLVMFPIYEYGSEEQRRKYLPRLASGEWIGCFGLTEPDAGSDPGGMRTTARKVDGGYVLSGSKTWISNAPIADVFVIWAKSDAHDGGIRGFVLEKGMKGLSAPKIENKVSLRASITGMVVMDDVFVPDDALLPNVQGLKGPFGCLNRARYGISWGSLGAAEFCFAAARQYGLDRHQFGRPLAATQLFQKKLADMMTDITLGLHASLRVGRLMDEGAFAPEMISIVKRNNVGKALDIARIARDMHGGNGISGEYQVIRHMVNLETVNTYEGTHDVHALILGRAITGIPAF

SEQ ID NO: 27994 - protein, 393 aa, Novosphingobium aromaticivorans DSM 12444
MIDPLQRLHPVYAGMPVTIFEHMSGLARELGAINLGQGFPDEAPPPALLEALSRAAAERSHQYPPMAGIPELRRAVAGFYAWTQGLEVGAESVIVTSGATEAVACAILAAVAPGDEVLLFSPAYDAYAPLIRRAGGVPVFVPLSPPHWRYDEAAIVAAVTPRTRALVLNDPLNPTGTVAADTELAMIASLCVRHDLIAICDEVWENVRFDGRRHRSLLALPGMARRTIKIGSAGKIFGATGWKVGWMVAAPDMAAVLARAHQFLTFTTAPMLQWAVAQGLEDPALAAGCTARWAETRGVLIEALGRRGFTVLDTTATWFTCIDLAASGIALDDRTFSDRAVREAGVASIPLSALWEGDAAPEGIVRLCHCKPEAMLLEAMDRLVRWRDGLRAA

SEQ ID NO: 27995 - protein, 334 aa, Novosphingobium aromaticivorans DSM 12444
MIPHGEHSMLAMQLDGPGKRLHPVVRPLPLPGRGEVRVKVHACGVCRTDLHVADGDIHGLLPIVPGHEVIGVVDALGPGVTDVEPGARVGVPWLGHACGTCPYCDSGRENLCDAPLFTGFTRDGGYATHVIADARFCFPIPEGFDDLHAAPLLCAGLIGYRALRLAGDAPVLGFYGFGAAAHILAQVALWQGRTVYAFTRDGDAKAQAFARDIGCQWAGPSGAAPPQALDAAIIFASAGELVPTALRAVRKGGRVVCAGIHMSDIPAFPYADLWEERQILSVANLTRRDGVEFLPLAARAGVRTHVEAMPLMKANEALDRLRRGDVSGALVLVP

SEQ ID NO: 27996 - protein, 484 aa, Novosphingobium aromaticivorans DSM 12444
MVQREALLLIGNADVAASGGATFERTGPLGGEPTVAAAASAADAIAAADAAAAALPAWAALGPNERRRLLLAGADALEAQTGAFVEAMAAETGASNGWAGFNVHLAAGLLREAAALTTQVKGETILSDRPGCYAMTLRRPAGVVLGIAPWNAPVILGVRAIATPLACGNTVVLKASEHCPATHRLIGTALRSAGFPAGVVNVVTNAPADAGEVVAALVNHRAVRRINFTGSTRVGRIIAGLAAQQLKPCLLELGGKAPMIVLDDADLDAAVAAAGFGAYMNSGQICMSTERIILEDGIADAFVERFRARVDGLTAGDPRAGSAPLGSVVDEATGRRVRHLIEDAVGKGARAHGDWQTGGTLIPAIVVDGVTPDMLLYSEESFGPVTTILRAANEDVAVRIANDTEYGLTSSVFSQNIARALRVAERIEAGMCHINGATVHDEAQMPFGGTKASGYGRFGGEAGIAEFTELKWVTIDTQTPHWPI

SEQ ID NO: 27997 - protein, 432 aa, Novosphingobium aromaticivorans DSM 12444
MKETSMSAPRESRKAIGNHPLHPETLMLNHGYDPHLSEGAVKPPVFLTSTFVFPTAEEGRDFFDYVAGRKEPPPGQGRGLVYSRFNHPNSEIVEDRLAVYEGAEAGVVFSSGMAAITTALLAFARPGDVILHSQPLYGGTETLLAKTFANLGIGAVGFADGLGDEEIAAAADAAMGRGRVSVVLIETPANPTNSLVDIALARRVCDAIGEAQGHRPLLMCDNTLLGPVFQRPLDHGADVSLYSLTKYVGGHSDLVAGAALGSAAIMREIRLLRSAIGTQLDPHSCWMLGRSLETLALRMEKANANAAVAAAFLRDHPKVRHVSYPLFNEPDSPQARLFARQCTGAGSTFSFDIVGGQDAAFRFLNALQIFKLAVSLGGTESLASHPGTTTHSGVPADVRERIGVHETTVRLSIGIEHPDDIVADLAQALDRA

SEQ ID NO: 27998 - protein, 477 aa, Novosphingobium aromaticivorans DSM 12444
MEFNNNYHMLIGGELVAAEARLDVVNPANEQVIACVPDAGAAELDAAVAAARKAFPGWAATPIAERKAMLDALADSIFANVDGFKRLLTAEQGKPHHEAQGEIMGAGYWLKAYTALDLPETVNEDSDERLSITRHVPLGVVGAIAPWNFPMILAMFKVAPGLLAGNTMVLKPSPFTPLCTLKFAELAKEILPAGVLNVITGGDHLGPLMTAHPGFDKISFTGSTQTGRRVMASAAPTLKRVTLELGGNDAAIVMPDVDVEKIAEQLFWAAFTNNGQICIATKRMYIHKDIYEPLRDALVAYARTVKVGDGSEQGTQIGPINNEAQYNRVLDLIQDAKDNGYKFLLGGEKAEVPGYFVPITILDNPPEDSRIVQEEQFGPVLPLIRFDDFEDVLNRVNASDYGLGGSVWGSDEDKAFELAQRVQSGTVWVNETQHLSPLAAFGGMKQSGVGVEGGLEGLLEYTSAQTLVRRKKAAFVN

SEQ ID NO: 27999 - protein, 494 aa, Novosphingobium aromaticivorans DSM 12444
MTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 28000 - protein, 111 aa, Novosphingobium aromaticivorans DSM 12444
MPKFDANGLVTAVAVDHATGALLMLAHMDAQAIAKTRETGFAHFHSRSRGRLWMKGESSGHVLRIVEIRVDCDQDALELRVEAAGPACHTLAPTCFYRRLDHRGQLERIVD

SEQ ID NO: 28001 - protein, 305 aa, Novosphingobium aromaticivorans DSM 12444
MRAESILATIGNTPHIRLSRLFPDHEVWVKCERANPGGSIKDRIGLAMIEAAEADGSLKPGGTIVEPTSGNTGIGLAMAAAVKGYKLILVMPESMSLERRRLMLAYGATFDLTPREKGMKGAIERAKEIVDQTDGAWMPQQFDNPANVSVHVRTTAQEILKDFGSEPIDVLITGVGTGGHLTGCAEELKKHWPSLKAYAVEPTLSPVISGGQPGPHPIQGIGAGFIPGNLHTQSIDGAIQVDPADAKEMARLCASKEGMLVGISSGATLAAIAQKLPSLPAGSRVLGFNYDTGERYLSVPDFLPE

SEQ ID NO: 28002 - protein, 248 aa, Mesembryanthemum crystallinum
MAGLAFGRFDDSFSWASIKAYIAEFISTLLFVFAGVGSCIAFNKLTADAALSPSGLVAVAVCHAFALFVAVSVGANISGGHVNPAVTFGLAVGGQITILTGVLYWIAQLAGSVAGCFLLKAATGGLTTPIHSVASGVGAIEAVVMEIIITFALVYTVYATAVDPKRGSVGTIAPIAIGFIVGANILAAGPFSGGSMNPARSFGPALASGDFHDHWVYWVGPLIGGGLAGLTYSNVFMHHEHAPLSSEY

SEQ ID NO: 28003 - protein, 244 aa, Novosphingobium aromaticivorans DSM 12444
MNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAGTGEA

SEQ ID NO: 28004 - protein, 447 aa, Novosphingobium aromaticivorans DSM 12444
MCQACGSVTHRWQGQCVDCSEWNTLAEEAPETIFSAKHDLSSGGRRVAFVSLDQPVALPQRRKTGIAEFDRALGGGLVPGCAILMGGDPGIGKSTLLLQASAKVALSGGSAVYISGEEASDQVRLRADRLGLGKAPILLAAATSVRDILTTLGNMEPPSLVVIDSIQTMHSDQIEGAPGTVSQVRGCAFELIRYAKENGVALVLVGHVTKDGSIAGPRVLEHMVDVVMSFEGERSHQYRILRALKNRFGAVDEIGVFAMAGQGLEEVGNPSMLFLSGREQEVPGSAVFPALEGTRPVLVEIQALTVRLASGATPRRAVVGWDSGRLAMLLAVLEARCGLNFSSAEVYLNVAGGYRLTDPAADLAVAAALVSALSDRPLPSGSIWFGEISLAGEVRPVAHTPVRLKEAAKLGFSRGCGPEAGAEKVDGLRYSPLRLLPNLIDRVMGGS

SEQ ID NO: 28005 - protein, 402 aa, Novosphingobium aromaticivorans DSM 12444
MKRTTGQDRSITRKWRPATQAIRGGTWRSEMGETSEALFLTSGFTYDDAATVAARFAGEAEGMTYSRLQNPTVQMLEERIALLEGAEACRTQATGMAAMTTALLCQLSAGDHIVAAKAAFGSCRWLVDNLLPRFGVQGTTIDASDNAAWEAAIRPNTKVFFFESPANPTMDIVDLEFVCGLAKKHGITTVVDNAFATAALQRPMDFGADVVAYSATKMMDGQGRVMAGAVCGSADWINNVLLPFQRNTGPNIAAFNAWVVLKGLETLDLRIHRQSENALKVASFVEKRVPRLLYPGLPSHPQHALAQKQMKAGGTIFSFDLDGGRAQAHALLDALQLIDISNNIGDSRSLMCHPASTTHHGVGPETRADMGVGEGMLRLNVGLEDADDLIEDLDQALRKAGL

SEQ ID NO: 28006 - protein, 327 aa, Novosphingobium aromaticivorans DSM 12444
MTKTFGRQSTTDDVLAGLDLTGKTILVTGVSAGLGVETTRALVSRGAKVVGTARDLAKARKALVHAGVDRASIELVELDLADLASVRRASDKLRLEGQPFDLVIANAGVMAPPFGLTADGFETQFGTNHLGHFAFVNRIAGLMRPGSRLVLLASSGHRFANVDLADPNFESSAYDPFVAYGRSKTANILFAVEFDRRYRSLGLRATAVHPGGIRTELDRHMGDGQLQSLVDQINADMAKEGKPPLEWKSPPQGAATTLWAGLVADADDVGGRYCEDCQVSPVVRDESIGFASPGVRPYALDAEMAKALWAKSEEWVSETFDLRSAAD

SEQ ID NO: 28007 - protein, 489 aa, Novosphingobium aromaticivorans DSM 12444
MTPEGVNVAHPDKLYIAGRWVPAHSGRMIELVSPNTELVVGRVAEADETDMDAAVAAARDAFDHGPWPTTPPAERIAAFRRMVAHLETRVPELAKAWTAQMGGLASFAGPMHGGSVMALGQIAGFAEKFEFVERRPSMAADTALIAYEPVGVVAAIAPWNGPFGIMANKVAYALLTGCTVIMKPSPETPLEAYIIAEAAEAAGIPAGVVNLVTGHREASDHLVCNEGVDKVSFTGSTVAGKRIASVCGSRMARCTLELGGKSAAIVRDDFPIDAAAKMLAGTITMMSGQVCAMLSRVIVPRRRHDELAEAIAAEMKKVRIGNSDDPETQLGPVAMKRQLERIEMYIEEGRKTADLVTGGGRPAHLNRGYFIEPTLFANVRNESRIAQEEIFGPVLSLIPVEDEEDAIRTANASAYGLNGSVLTNDAEAAYRIARRVRTGGFGQNGLRMDFGLPFGGFKQSGIGREGGPEGLFPYLEMKTILIDGMPSAL

SEQ ID NO: 28008 - protein, 300 aa, Novosphingobium aromaticivorans DSM 12444
MAQAPVAPTHSPEELPELPEAFDGKFPIRVRGVRNAFGDHVIHENLDLDVRRGEILGVVGGSGTGKSVLMRTIIGLQIPDAGEVEVLGSSITDARDDEDIDIRSRWGVLFQGGALFSTLTVAENVEVPLREFYPEISDELRHEIARYKVLLSGLPAEATSKYPAELSGGMRKRAGLARALALDPELLFLDEPTAGLDPIGAAAFDQLILKLQQTLDLTVFLITHDLDTLYEICDRVAVIADKRVIAVGTIPELLALDHPWIQEYFNGPRGRAAQDAQARHEAAQAAAGQDPEDDPAQQGA

SEQ ID NO: 28009 - protein, 471 aa, Novosphingobium aromaticivorans DSM 12444
MERAAMNALSPTLTNRSLVDIDRDHLIHSVTSFRGHEQHGAIVLESGDGMWLTDAEGNRILDAFAGLWCVNVGYGQESIVEAAAAQMRKLPYATGYFHFASEPAIRLAGELTAAAPSGLDHVFFTQGGSDAVDSAIRYIVHYWNAAGKPSKKHFIALEWGYHGSSSLGAGLTALGNFHRNFDLPRPWQHHIASPYPYRHPQGDDDAAVIASTVAALEAKVAELGADNVAAFCCEPIQGSGGVIVPPRGWLKALREACTRLGILMLVDEVITGFGRTGPLFACEEEGVSPDFMTTAKGLTAGYIPMGAMFMADHVYQTIADAAPAALPIGHGQTYSGHPVAAAVGLEVLRLYREGGLLENGRKTGERFAWHMERIRAHPLVGDVRYRGLLGAIELTPDKATKAIFDASLDIGGRLSKLTYANGVIVRCFGNAVLGFAPALCCTLEEMDMIFERVERSLDQLLDQPDIRALVV

SEQ ID NO: 28010 - protein, 490 aa, Novosphingobium aromaticivorans DSM 12444
MTAFDPDSIRPALAANFIGGEAVVGRGRSFEVLRPSDGQLLGELRAADEQQLCAAVENAAMAQKASGWGAMEPRGRMKLLRRWADLIEADAETLVPLEAVGSSRTLAEVRAWDLPYTAECIRFFAEFADKHGGEIAATTPDKLGFTLTEPYGVIGAIAPWNLPLVMAAWKLGPALAAGNAVVLKPSELTPFSVVRLAELAVAAGIPAGVFNVVQGGGGDIGDALVRHERIAKVSFTGSTRTGQAIMAACAMTGPKPSTLELGGKSPQIVFADADLAKASALVARAITLNSGQVCVAGSRLLVHEKARDEVVERLTTAFEAHRLGTTWDAATTMGPIISEGQLATIDGIVQRARAAGAEAVTGGARAVSPQSGSYYQPTLLAGMSDDNEAVQGEIFGPVLTVQSFADEDEAFALANGTRYGLAAGVHTTDISRALRAVRALEAGTVWVNRYGRSDDFILPTGGFKQSGVGKDLGREAYLGSCKVKTALIQI

SEQ ID NO: 28011 - protein, 412 aa, Novosphingobium aromaticivorans DSM 12444
MTLNTPRIPVGKSFWQSGHRPTLFAAFLYFDIAFMVWVILGPLAPIISKELGLDPAQKGMMVAVPTLAGAVIRLVNGLLVDRIGPKRTGIISQVVVIAGMFAAWWFGISSYEGTLALGVILGFAGASFAVSLPLASRWYPPEHQGKAMGIAGMGNSGTVFASLFAALLAKSFGWTNVFGLALIPLVAVFAFYLVAAKDSPEQPEPKPLSAYASVLKEQDAWWFMLFYFVTFGGFVGLSSSLPTFFADSFGVTPVIAGYCTAAAVFMGSMLRPLGGALADRFGGIRTLSVVYVVAGALLAVIAAVSTQGLALAIALFVAVMGTLGVGNGAVFQLVPQRFRKEIGVMTGLVGFGGGVGGFYLASSLGAIKKATGSASLGFLIFAALAVVALVGLTAVKRRWRTTWGAALGGARI

SEQ ID NO: 28012 - protein, 468 aa, Novosphingobium aromaticivorans DSM 12444
MSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 28013 - protein, 161 aa, Novosphingobium aromaticivorans DSM 12444
MNDAFAGLPYRPCVGVMLVNSQGRVFVGRRIDDKDGVAWQMPQGGIDDGEELHPAALRELSEETGVAAELVTIIAESREEHLYDLPDELIGKLWGGQYRGQRQKWLLLRFAGEDTDIRLDAHDPAEFSEWRWVEPEQLPDLIVPFKRRVYRQVVDEFRDLI

SEQ ID NO: 28014 - protein, 438 aa, Novosphingobium aromaticivorans DSM 12444
MNKVRGSKVRGLGFWMTLALVVGNMIGSGIYILPATLAPLGFNQLIGWAVTLAGALCLAAAFARMGARLPLAGGPYAYAQAAFGPIPGFVTAWSYWTMLWAGNGAVAVALVSNLSLIAPWIGATPAVPALLSVGFVWLLTLVNIRGVRAAGDVSVVTTALKLVPLAGLIGLAIWLLITGAPTVVQPEVPLSGGVIATAAGLTFWGFLGLESATVPADKVENARTVVPRATLIGVAITGLVYMGISGAFALYMPMADAAASPAPVADFLARFFGSGMGQVVALFAAISAFGTLNGFILLQGEVPWAMARGGVFPRWFAAEGPRGTPVRSHVVSSILLSIVTLLNYGRGMGDLFAFIASVSLAAGMLSYFVAMLAAVRLLPDERPMVIAALVGAAFIAWAAWGLGAEALTYGAGFVALGLPVYLWIRRDGAASTTANDPG

SEQ ID NO: 28015 - protein, 462 aa, Mesembryanthemum crystallinum
MGEQELLLQQQIKEDRNVSRETEMKHPALQGKYELGRVLGQGTFARVYHARNLVTGNSLAIKVVAKDKVIKVGMMEQMKREISVMKRVKHPNIVQLHEVMASKSKIYLAMDLVRGGELFSKVSKGGKLDEDVARSYFKQLISAVDFCHSRGVYHRDLKPENLLLDEHGNLKITDFGLSASFENEDHHQTLLRTSCGTPHYVAPEVISRKGQQGYHGAKSDIWSCGIILFVLLAGFLPFHDDNIIRMYRKVFKGDFTCPSWLSSQARDLITRLLDINPATRITVSEIMQSDWYCMDTSSMTAVTTDEFDLDHNNNNNNNSNYNNIHHHKKEPEMLNAFHIISLSQGFDLSPLFEEKHREERQDMRFATTKSASTVVSRLEEVAAKAGKFIVKKFCGDSVVRLQGQERGRKGKLAIAAEIMSVSPSLLVVEVKKDNGDTLEYNQFCTKQLRPALKDIVWTCPSS

SEQ ID NO: 28016 - protein, 426 aa, Novosphingobium aromaticivorans DSM 12444
MSDPQWYSTGRDHVWLPYTQMKTARPPLPVASAEGVKLRLADGRELVDGISSWWATVHGYRHPHIEEAIRRQLETLPHVMLGGLAHEQAYTLARRLAGMLPGDLDHVFFSDSGSVAVEVAMKMAAQFWLNQGHRRVKFLCFRGGYHGDTFATMSVCDPDEGMHSLFRGALLEQVVVDLPRDAEGEAALGALIEQHRGELAGIVVEPLVQGAGGMVFHDPFTLQALRRLADEHELLLIFDEIFVGLGRLGDAMFACQIAGVQPDIVTLSKALTGGNLPLAATIASGRIYDAFLSDDPMHALMHGPTYMGNALGCAAANASLDLFESEPRLEQAQAIGRGLEQALEVLRGLPGVRDVRVRGAIGVIQLDRTAPADRLSAACIDRGVWLRPFRDILYTTPPLVTGEEDLARITSAMVEAVTEWSRETHV

SEQ ID NO: 28017 - protein, 266 aa, Novosphingobium aromaticivorans DSM 12444
MTRLSNAFAKGRPALVTFVTGGDPTPGATDAILDALVEGGADVIELGMPFTDPMADGPAIQLANLRSLGAGTKTADVFRIAADFRARHPEVPLVLMGYANPMVTRGPDWFAAECVKAGVDGVICVDIPPEEDPELGPALRGAGVSLIRLATPTTDAARLPAVLEGSSGFLYYVSVAGITGMQQAAQASIEEAVARIKQSATIPVAVGFGVRTPEQAAAIAKVADGVVVGSALVDLVARHGADAAGPVKELTAALAAAVHSARKEIA

SEQ ID NO: 28018 - protein, 283 aa, Novosphingobium aromaticivorans DSM 12444
MSWLNKVRNALPFTPKRDTPDNLWIKCPSCSEMLFTKEYEDNLSVCPHCDHHGRIGANARLEQLLDAGYELLPAPKVKEDPLKFRDTKKYVDRIKAARAANPHPDALTNAFGRIEGQKAVVGVQEFAFMGGSMGMAVGNAFVAGTERAIKEKCPYVAVTAAGGARMQEGILSLMQMPRSTVAISRLHAAGLPYIVVLTDPTTGGVTASYAMLGDVQIAEPGALIGFAGQRVIQDTIREKLPEGFQRAEYLHAHGMIDMVTHRRDLKTTLAQVIDFLMAGKAAA

SEQ ID NO: 28019 - protein, 484 aa, Novosphingobium aromaticivorans DSM 12444
MAKLDPRGRKVKILATVGPASRDPEMLEKLFRAGADAFRVNMSHGEHAIHAETIANIRALEKKVNRPITILCDLQGPKLRVGKFKDGRAVIRHSGHFTLDRNPEPGDETRVCLPHPELFGVLHKGQRLLIDDGKLRLRVIRADENEILCSAEVGGVISDRKGVNVPDAVVPVPALTDKDRRDLSFAVEQGADWIALSFVQRPEDVAEARRLLGGHGSLMAKIEKPAAISRLEEIVELSDGIMVARGDLGVELNPEEVPPLQKRIVETARRQGKPVVVATQMLESMIEAPTPTRAEVSDVANAVYDGADAVMLSAETAAGAWPEEAVTIMHRIAAQVEADPGYGARVHFLETLPDPTTADALAQAAASITETLPISGIIVFTGSGSTARRVARERPGVPMLVLTPSHKTARKVGLLWGAHAVSTKDIGSFEEMIAKGKRMALRHGFGSAGSKLVALAGVPFGTPGATNLLHVVTLTGDELTRHGE

SEQ ID NO: 28020 - protein, 423 aa, Novosphingobium aromaticivorans DSM 12444
MRAKPNDVDLRERAAKVIPNGMFGHEATHLLPASFPQFFSRAKGAYIWDVDGNRYLDFMCAYGPNLLGYGDELIDAAATRQLALGDTMTGPGPVLVDLCETLVDMISHADWVMVCKNGTDATTMALTAARAQTGKRRVLVAEGAYHGAAPWCTPMPGGIVPEERAFISKYKYNDVASLEAAVAAAGDDLAAIFASPFKHDAFEDQALPDPAYARRARELCDQTGAMLIVDDVRAGFRLVRDCSWELVGVRPDLSSWGKSFANGHPISALLGSNSCRAGAEAIYATGSFWFSAVPMAAAIETLRILRESDYLERTIRLGERLREGLAAAAARHGFSLRQTGPVQMPQILFNDDPDFRIGFAWAEAMLERGVYVHPWHNMFLNGAMSETDIDFAIEAADGAFAQVREHVGELEPHATLMSLLGAH

SEQ ID NO: 28021 - protein, 415 aa, Novosphingobium aromaticivorans DSM 12444
MASEVQAERADVVIVGAGHGGAQAAIALRQNGFEGRVLVIGREPEIPYERPPLSKEYLAREKTFERICIRPAQFWEDKAVEMKLGAEVVSLDPAAHTVKLGDGSAIEYGKLIWATGGDPRRLSCVGADLAGVHAVRTKEDADRLMAELDAGAKNAVVIGGGYIGLEAAAVLTKFGVNVTLLEALPRVLARVAGEALSEFYQAEHRAHGVDLRTGAAMDCIEGDGTKVTGVRMQDGSVIPADIVIVGIGIVPCVGALISAGASGGNGVDVDEFCRTSLTDVYAIGDCAAHANDFADGAVIRLESVQNANDMATAAAKDICGAPVPYKATPWFWSNQYDLKLQTVGLSTGHDNAVLRGDPATRSFSVVYLKGGKVVALDCVNMVKDYVQGKKLVEARAQIAPEQLADAGVPLKEMLA

SEQ ID NO: 28022 - protein, 331 aa, Novosphingobium aromaticivorans DSM 12444
MSDPLYDVIAIGNAIVDVMAPCEDADIARLGLAKGGMTLVDTARAKELYDAMGPAREISGGSAANTLAGLAALGANCAFIGQVADDQLGEVFAHDIRAGGIAFDTPTRADEPPTARCLIFVTPDGQRTMNTFLGASQFLPAEALDDATIAAAQVLYLEGYLWDPEEPRKAMRRAIAAARNAGRKVAFTLSDAFVISRHGDDFRALIDAGQIDILFANEHELAALTGIEDFHVGIEQLAAKVPTVVVTRSENGAHAISQGERAHVPAEPIAKVVDTTGAGDLFAAGFLYGYVRGRPLAESLTLGAICAAEIISHYGARPEADLKDLVAQRLG

SEQ ID NO: 28023 - protein, 219 aa, Novosphingobium aromaticivorans DSM 12444
MTPLISPSILSADFARLGEEVRAIDAAGADWIHVDVMDGHFVPNITIGPMVVKALRPHTTKPFDVHLMISPVDGYLQAFADAGADIITVHPEAGPHIHRTVQAIKALGKKAGVSLNPGTPAKMLDYLIDDVDLVLVMSVNPGFGGQSFISSQLRKIEAVRKMIDKSGRDIHLEVDGGVDTRTIRSCVDAGADVLVAGTATFKGGPSQYAANIAALKGLG

SEQ ID NO: 28024 - protein, 367 aa, Novosphingobium aromaticivorans DSM 12444
MHEPLFQPVRLGAIEAPNRIIMAPLTRGRANPQAVPTPIMGEYYRQRASAGLIISEATAISPEGAGWPSAPGIWTDEQTEAWKPIVDEVHAAGGRIVLQLWHMGRVVHPYFLGGEPPVSASATRAPGHAHTPEGTKDYETARPLRLDEIPRLIDDYGRAAENARKAGFDGVQLHAANGYLIDQFLRDGTNLRDDDYGGSPENRVRLMREVMERLISIWGKERVSIRLSPNGDSQGVDDSNPEATFGEAARVLEELGVGFVELRQPGPEGTFGNTDVPKQDGLIRSIYTGPLVLNSDYTPEEAAADVASGRADAISFGRPFISNPDLVERIRVGAHLNPNKGVPATWYFPGEAGYTDYPTLAEETAIA

SEQ ID NO: 28025 - protein, 323 aa, Novosphingobium aromaticivorans DSM 12444
MGWDAPGGPEVLRPENVRVPQPGPGQVLVKVAFAGVNRPDVIQRQGFYPPPPDASPLPGLEIAGQVVAMGQGVTWPFIGTAVCALVAGGGYAEYCIAEADQCLQVPTGLPMAQAAAMPETLFTVWHNVFERGMVAEGETILVHGGTSGIGSMAILLGKLFGVKVIATCGGPEKCEQALAIGAAHAIDYKAADFVEETLRLTEGRGVHMVLDMVAGDYVARNLKCLADDGRHVTIAVQGGVRAEINMAEVMRRRLTLTGSTLRPRSRAFKGALASEIRDTVWPLVVEGALRPIMDQTFPLAEAAAAHVRMEQGAHIGKIVLAVG

SEQ ID NO: 28026 - protein, 463 aa, Novosphingobium aromaticivorans DSM 12444
MAPLPMFEKPPVHWTEELRAMLRLAAPMVGANLLQMAVFAVDVVFVARLGPVALAASSLSVSLFGLLVWSLSGLVGAASPLIAAELGRRRHAVREVRRTVRMAAWAGTLAGLFAMGVCLLGGPLMRVTGQQPEVIALAVPFLNVLMWAAIPSTISALLRTFVATLGRPTIGTVITGMAVAINAFGNWVFVFGNLGAPEMGLTGSALSSIVTTCAMVLAYIVVIRSDRRLRRYRLAGRWWKPEWKRFADVLRVGLPITGTILAEAGMFNGAAFLMGRIGEVELAAHTIALQFAAIAFQVPFGVAQAATIRVGLAFGAGERAAIARAGRVAVVLGMGFMVVTASIMLFAPRAILHLYVDPDAPENRAMAVLAVQYMAVAAAFQLFDGAQAVGAALLRGLQDTRIPMAFALFGYWLPGLGTAVGLGLFSPLGGLGVWIGLMVGLVVVASLMLWRWRNRARLGLLPA

SEQ ID NO: 28027 - protein, 477 aa, Novosphingobium aromaticivorans DSM 12444
MGKATGFLEIDRKDRTYDAPAERLKHYREFVVPHDEAGLKGQAARCMNCGIPYCHNGCPVNNQIPDWNHLVYENDWRDALTNLHSTNNFPEFTGRICPAPCEAACTLNIIDQPVTIKSIECAIVDRGWKEGWIEPQVPVKKTGKSVAVVGSGPAGLAAAQQLARAGHSVTVFEKNDRVGGLLRYGIPDFKMEKTHINRRAMQMEAEGVQFRTGVEVGVTVSFASLQENFDAVVLSGGAEDPRGLQIPGAELPSVRMAMEFLTQQNKRNAGDDELRAAPRGSLFATGKHVVVIGGGDTGSDCVGTSNRQGALSVTQLEIMPKPPEKEDKALSWPNWPLKLRTSSSHEEGCEREFAVLTKRVVGENDVTGLECVRVEWVNGQMQEVPGSEFVLKADLILLAMGFVGPRKQGLLEQAGVELDARGNVKGNVVDYKTSVENVFACGDMRRGQSLVVWAIREGRQCARAVDEALMGVSELPR

SEQ ID NO: 28028 - protein, 408 aa, Novosphingobium aromaticivorans DSM 12444
MFPKGFLWGASTAPHQIEGNNTASDLWFLENQQPTVFAEPSGDAANSLLLWERDLDLARDIGLNTYRFGVEWARIEPEKGRFSQAMLDHYRRVVDGCRARGLVPIVTYSHFTAPRWFSAQGGWTNPESAELFARYCTKVTQAIGDAIHSAITLNEPNILLILKPMLPQAVWDIQKLTLETAGRRLGVEKFVCANVAAFEDLPALQHGLLAAHKAGRAAIKAVRPALPVGVSIAMLDDQAVGRNSIRDRIRSELYGAWLDVAKADDFIGVQNYERALWGDKGRLPAPQDAPRNWSGTEIWPGSLAGAVRYAHAMTGRPVLVSEHGVGTDDDAVRAALIPPALGALKQAMDDGVPVLGYCHWSLVDNFEWIFGYKPRFGLATFDPVTFERKAKPSARVYGAIARANALTA

SEQ ID NO: 28029 - protein, 182 aa, Novosphingobium aromaticivorans DSM 12444
MPDTLAAIPLTRIDGTADSLANHAGKVLLVVNVASKCGLTPQYEGLEALYKARKDEGLEVLGFPANDFGAQEPGSHEEIAEFCKLNYGVSFPLFAKADVTGPGKQPLYAALTEAAPTKQGPAQEFRDRLKGYGMTPTEDPEVLWNFEKFVIGRDGEVAARFAPGVTPDDPALLAAIDAELAK

SEQ ID NO: 28030 - protein, 468 aa, Novosphingobium aromaticivorans DSM 12444
MIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVHEG

SEQ ID NO: 28031 - protein, 501 aa, Novosphingobium aromaticivorans DSM 12444
MEKRREAARLGGGQKRIDAQHAKGKLTARERLEVLLDEGSFEEVDMYVEHNCVDFGMPDTVIPGDGVVTGSGTINGRLVYVFSQDFTVFGGSLSERHAQKICKIMDMALKVGAPVIGLNDSGGARIQEGVASLGGYAEVFQRNVLASGVVPQLSLIMGPCAGGAVYSPAMTDFIFMVKDSSYMFVTGPDVVKTVTNEIVTQEELGGAVTHTTKTSVADLALENDIEALLAARDFFDYLPLSNRQEVPERPTSDPYDRLEPSLDSIVPASATQPYDMHEVIRKTVDEGEFFEIQPKHAGNIICGFGRVEGRTVGVVANQPMVLAGVLDINSSKKAARFVRFCDAFNIPIVTFVDVPGFLPGTAQEHNGIIKHGAKLLFAYAEATVPKITVITRKAYGGAYDVMASKHLRGDLNYAWPTAEIAVMGAKGAVEIIFRGLSAEEQAVKTREYEDRFANPFVAASKGFVDEVIHPHSTRRRVALGLRKLRNKSLENPWKKHDNIPL

SEQ ID NO: 28032 - protein, 370 aa, Novosphingobium aromaticivorans DSM 12444
MKTRAAVAFAPKQPLEIVELDLEGPKAGEVLVEIMATGVCHTDAYTLDGFDSEGIFPSVLGHEGAGIVREVGPGVTSVKPGDHVIPLYTPECRQCKSCLSGKTNLCTAIRATQGQGLMPDGTSRFSYKGQTVFHYMGCSTFSNFTVLPEIAVAKIREDAPFKTSCYIGCGVTTGVGAVINTAKVQVGDNVVVFGLGGIGLNVIQGARLAGAGKIIGVDINPDREEWGRKFGMTDFLNSKGMSREDVVAKVVAMTDGGADYTFDATGNTEVMRTALEACHRGWGTSIIIGVAEAGKEISTRPFQLVTGRNWRGTAFGGAKGRTDVPKIVDMYMTGKIEIDPMITHVMGLEEINTAFDLMHAGKSIRSVVVF

SEQ ID NO: 28033 - protein, 352 aa, Novosphingobium aromaticivorans DSM 12444
MREESRAWADEAVRRIEADFNRSADTHLIRVELPRFPGITLYLKDESVHPTGSLKHRLARSLILYGLCNNRIGPDTLLVDATSGSTAVSEAYFARLIGLRFVAVIPRSTSPAKIDAIRFHGGEVHMVDTAAQMYAEAARLADDAGGLFLDQFTYAERATDWRGNNNIAQSIFQQMSREDHPVPSWIVCGAGTGGTSATLGRFIRYGRHATRLCVADPEGSVFHLHHADRSVTEPSRGVRCMIEGIGRPRVEPSFLPDVIDRMIAVPDAASIGAMRAIAARIGRPVGGSTGTNVHACLEIAQEMAASGETGSIVTILCDSGLRYAGTYYDDAWLDGQGIDWRADEVRVAALLS

SEQ ID NO: 28034 - protein, 336 aa, Novosphingobium aromaticivorans DSM 12444
MLRGNFADNPYGVAHRRKPDMNACMTDQTSAELSAQVPIEPATVAFLGLGVMGGAMARHLGKAGHRLTIYNRTPSRAEAWQSANPGLASRVASSPAEAAEDADVVITCVGNDDDLADVVLSPNGAFSTLRRGALYIDHTTVSARIARQIAVEGRDKELLCVDAPVTGGQSGAEAGTLAIMCGGSARAVDAARPILAAYAKRVVHVGKSGAGQTAKMANQMCIAGTLAGLSEAIRFAQIAHLDLEKVFEAISGGAAQSWQMDNRFHTMANDEFDFGFAVDWMRKDLGLAIEEARNLGASVPVTALVDQFYVDVQAMGHGREDTSALIRHLPRRAPRA

SEQ ID NO: 28035 - protein, 474 aa, Novosphingobium aromaticivorans DSM 12444
MRERLQQYIDGKWVDSEGGKRHEVINPTTEEPCCVITLGTQADVDKAVAAAQRAFKTFSKTTREERLALLERIVEEYKKRVPDLAAAMAEEMGAPVSFASTAQVGAGIGAFLGTMAALRNFSFVEDNGAFKVAYEPIGVVGMITPWNWPLNQIALKVAPALAAGNTMILKPSEECPTNAAIFTEILDAAGVPPGVFNLIQGDGPGVGTAISSHPGIDMVSFTGSTRAGILVAKAAADTVKRVHQELGGKSPNVVLPDADFAKYLPSTASGPLVNSGQSCISPTRILVPREREAEAAAFVSAMYSATPVGDPMQEGAHIGPVVNKAQFDKIRGLIQSAIDEGAKLETGGPDLPANVNRGYYIKPTVFSGVTPDMRIAQEEIFGPVATIMAYDSLEEAIEIANDTAYGLSACITGDPAKAAEVAPELRAGMVAINNWGPTPGAPFGGYKQSGNGREGGLYGLKDFMEMKAISGLPA

SEQ ID NO: 28036 - protein, 469 aa, Novosphingobium aromaticivorans DSM 12444
MATAKDILARIKDEEIEWVDLRFTDPKGKWQHLTMVSTVLGEDELEDGLMFDGSSIEGWKAINESDMILKPDLDAVYVDPFSASPMLIICCDIVEPSTGELYARDPRSTAKRAEAFVKTAGLGDTVYVGPEAEFFLFDDVKFYDGYDGNGFRIDDIELPTNSNKDIEGGNLAHRPRAKGGYFPVAPVDSCVDIRGEMVRTMLDMGLPCDKHHHEVASAQHELGLTFGTLVQTADRMQVYKYVVQQVAHAYGKTATFMPKPIKGDNGSGMHTHISIWDSGKPLFAGNGYAGLSDMCLYFIGGVIKHAKALNAFTNPTTNSYKRLVPGYEAPVLLAYSARNRSASCRIPYGAGAKAKRVEFRFPDAMANPYLCYAALLMAGIDGIKNKIHPGEAMDKNLYDLPPAELAEVPTVCGSLREALESLEADHDFLLQGGVFTKEQIESYIELKWPEVLRWETTPSAVEFDMYYSL

SEQ ID NO: 28037 - protein, 466 aa, Novosphingobium aromaticivorans DSM 12444
MAEYDYDVLFIGAGPGGYVGAIRTAQLGLKTACAEGRETLGGTCLNVGCIPSKALLHGSEKFDEARNGTFASYGIKTGAVELDLDAMQAQKADSVKSLTGGIEFLFKKNKVTWLKGYAAFEDAHTVTVAGQKVTAKNIVIATGSSVTPLPGVTVDNDAGVIVDSTGALALNRVPQHLVVIGGGVIGLELGSVWRRLGAKVTVVEFLDQLLPGMDGDVRKEAAKIFKKQGMELKLGTKVTGVAVNGGTATLTVEPSKGGEASTIEADCVLVAIGRRPNVDGLGLDKIGLELNARGQIETDHDFATKIPGVWAIGDVIPGPMLAHKAEDEGIAVAENIAGLTGIVNHDVIPGVVYTMPEFAGVGLTEEAAKERGEIKVGKFPMLANSRAKTNHEPDGFVKVISDAKTDRVLGVWCIASVAGTMIAQAAQAMEFGATSEDIAYTCHAHPTHSEALKEAAMAVTGKPIHM

SEQ ID NO: 28038 - protein, 448 aa, Novosphingobium aromaticivorans DSM 12444
MTAPTAADLSADIARVFALQQAHMWEAKASTAAERKEKLARLKAAVEAHADDIVAAVLEDTRKPVGEIRVTEVLNVTANIQRNIDNLDEWMKPVEVATSLNPADRAQIIHEARGVCLILGPWNFPLGLALGPVAAAIAAGNTCIVKLTDLCPATARVASVIVREAFDEKDVALFEGDVSVATALLDLPFNHVFFTGSPRVGKIVMAAAAKHLTSVTLELGGKSPVIVDDSADIDQVAAQLAAAKQFNGGQACISPDYVFVKEDKKAALVEGFRANVQKNLYDDAGNLKKDSIAQVVNKANFDRVKAMFDDAVAKGATVAAGGTFEADDLTIHPTMLTGVTPQMTILQDEIFAPVIPVMTYDTLDQAIGYIEARDKPLALYVYSKDEANVEKVLARTSSGGVTVNGVFSHYLENNLPFGGVNTSGMGSYHGVFGFKCFSHERAVYRHQQ

SEQ ID NO: 28039 - protein, 460 aa, Ferroplasma acidarmanus
  misc_feature (10)..(10): Xaa can be any naturally occurring amino acid
MTEYDLAIIXWVPTVFAAAIKASELTSNQMKIALIGTGELGGTCVNVGCVPSKFLIEASKNYKEAKSPAYAGITSSATLDFSEFMESLNQFVSGERETKYTSVMKNFENIDLIEGLAKFIDNDTISVNNTELKATNFIIATGSRTFIPEVRGLTDYYTSDTVWKMRKLPGKLAVIGSGEVALELAYAFSNFGSEVHIFNRSNRILKGFDDDVNSQLMAALKSNGIVFHLGVNFYEIKNEEGKKDIVTWTGTFGDFDEIIVATGRMPNIDGLDLRAGGITADNGIVVNPDFRTTNPKIYAAGDCVRQSLKLETLAGKEGVIAVENILGGNRKINMQEVPWVVFTEPNVASVGYTEAELKKKHIEYDVRTVELKNVVKANILNSYTGIAKIISGKDKKILGIHVIAPMAAEFITEGVYLIKNGLTYDDLIDTIHVFPTVAESIKITGQAFIRDISKMSCCMD

SEQ ID NO: 28040 - protein, 379 aa, Ferroplasma acidarmanus
MLLDGYQLTVIAFAVLLIPDYIHLSDYSLDYGLLIASVIIGAIIGTILVGYLSDLVGRRRVYLSTLMFFILFDMISVFSVNFYMLFISRVLLGVVLGAEYPVANSYIAEVTPSDKRGFYLAFATVFFSVGSISSAIVAVFMFPLGNIGWRLMLGVAVIPAIIVEFMRFSLPESKLWEEKKEKTGFLEMFSKKYSKNIILAALIWFLYDIVAYGLSLTLPTILKLGHFVTNVDNALLTTFFLVIGIVSGVFVMIKVDKFGRKGIQITGFLLMAVLFLILPHFYYLAGIITIVSFLELFNAFGGATVGIIPAEVTITRFRGTSYGFSSMMGKIGAVIGVIAMSLLITSKNYFNAYIFLAVIMIIAILLTLLLPETKNIKLE

SEQ ID NO: 28041 - protein, 472 aa, Ferroplasma acidarmanus
MVEEISMYDISRKELDKIEKSNKVFSIIILLVVFGTFFDAIEQYNAGYAASGVSSVFHISASVISTQVEFITFGFMAVGAVIAGYMGDNLGRRFLYSFNLGIYAIGALISALSVNYSMFLFGRIVVGLGLGGEVAIGLTLISEIMPTRVRSQLTGAVNVGPGFGIFAVAILALIFIGPYEQIFGGSKLAWRWFLGILILPALLILLYRRYIPETPRFLISKGRQDEAFAVIKMLSENKLIPLKKLKNYYKVDDLRQQYNYIGLKPINEKPKTRELFAGKYARRSLLLFILSFITFGTSASFTIIYPEIFTSVATALHLSSTFTLTTIVNFGTLLGTFTAVFLATKNRKILISTLGILAIIGAGLTVTFHSYAYIVVISLFIFAIFSYASNTTIWLYSPEMYPTRIRNIGTGFILATSLGGVAIMEVLTSYVYALYNLTGIGLVAIGAFVVYVILAFFMADDTSKKDLEVVSP

SEQ ID NO: 28042 - protein, 460 aa, Ferroplasma acidarmanus
MSEYDLAIIGWGAAGFAAAIKASELTSNQMKIALIGTGPIGGTCVNVGCVPSKFLIEASKNYKEATKPSYRGITANANINFSEFMESLNDFVSTERNTKYADVIKNFENIDMYEGMAKFIDNNTVAVNNKDIKALNFIISTGSRTLIPEIKGLTDYYTSDTIWNMRELPGKIAVLGSGEVALELAYAFSNFGTEVHIFNRSNRILKGFDEDINNHLINALKTNGIIFHLGQNFQEIINKNGKKSIVTEAGTFDNFDSLLVATGRVPQIDKLNLKAAGISTDNGIVVDDSLKTTNPIIYAAGDCIRQSLKLETLAGKEGVIAVENMLGGSRTINMHEVPWVVFTEPNVASVGYTEAELKSKNIEYDVRTVELKNVVKANILNSYDGIAKVISGKDKKILGVHVVAPMAAEFIIEGVYLIQNGLTYDNLINAMHVFPTVAESIKIGGQAFIRDISKMSCCMD

SEQ ID NO: 28043 - protein, 267 aa, Ferroplasma acidarmanus
MEKIMWYGKIIDKKIYLYRNLQKDYMNILESLRQGIIPETEETCSEKIPDLREILLKFEKERINSEFSHDQYIIKVYSVKKELEEIINLYLEKLVSIYTLLDIKYNNDPCLYFSKLKNAGLQDVDNAAAEMGINMCSFRSYLDNYLGNEIEKYMPHTVSLIGKTLALDFLLKSGSLENLVKYPAGTLQILGAEKAFFNHMRKGTPPPKHGIIFNYPGLSALPPNQRGKVARAIANKMAITLKMDFFKTDGDTEGMVNEIKKKMNIQV

SEQ ID NO: 28044 - protein, 213 aa, Ferroplasma acidarmanus
MEISPSIISSNLLELGTQIKECQDAGAGSFHLDIMDGHFVDNITMGPDLVAAIRKGTNLRLDCHLMIERPDRYYKSFINAGADVLLIHYETPIEVINLIKKFQDENIRYGIVINPDTDVKKIYKLIPGSEIVLVMSVFPGFSGQKFIEKSLEKVKALREFIDENNYSTRIEIDGGINNETGKLAVEAGADILVSASYIFKNGINESIKKLKSL

SEQ ID NO: 28045 - protein, 374 aa, Ferroplasma acidarmanus
MIQQSAKEFAEKEIIPVAAKMDRENFFPRELFRKMGKEGYLGVTIPEQYGGSGSDYVSQAIIEEEISYASGSLGLSYGAHSNLCLDNLYRNGSEYLREKYLEKLCSGEHVGSLGMTEPSSGSDALSMKTSATMDKGNFILNGSKTFITNAPYADIFLVYARTGENITPFVVESSDRGFSRGQEFDKTGMRGSPTGTIFFNDIILPENRIVGKLNGGRNVLLSGLNLERAVLAFNSIGIARRALDLAIGYASERKQFGRPISDFELVQEKLAYMYTKFESSRLFAMEALKRVQEDRMDSLDAASAILYASESSEYIAREALQIFGGYGYIKDFEIERVFRDSILLTIGAGTNEIRKKVISEALIKKYGKGGKSVK

SEQ ID NO: 28046 - protein, 270 aa, Ferroplasma acidarmanus
MKIGYFGEPGAYSHIAAIQMATGEYVPLESVRAVFMSLEDGNINLAVVPVENSIEGAVNQTYDFLFRMNFYIIKEYYLRIKHCLIGHAGAKTDNITHVHSHPQALSQCSDFIYSHGMKPVSEYDTAGSVQIIKENFGLSHAAIASEIAANLNGMQILEKDIENNRHSYTRFFLIAKAPVKASAPSKTSIVFSTRNKPGALYKILKILNDYGINMTKIESRPVQYIPFQYIFFIDIENNKNTDAAITDIQKSVEQFKILGTYGTARINDED

SEQ ID NO: 28047 - protein, 496 aa, Ferroplasma acidarmanus
MEKIFGNIINGIEETGGERIELKSPVDGSLIGYIIDTDKDTVERAIQSSREAFNKFYLESTIKSRQELIGKLTDIVQEKATIYADLESKNTGKTIRQSTFMDIPLAISHIRYFAETDEFKFQRKITHPEYPGTEGIVQNAPMGVVASIAPWNVPFLMAVWKIIPPVLAGNAVVIKPSHYTPLTAIELVKDMKAAGFPDGLVNLVNGTGRTTGNLLVNSDHVDMVSFTGSTPTGSRIMEQAAKNIKKVSLELGGKSPNIVFADADLDHAVKGVIFGIFLNAGQLCESASRLIIEESIMDKFLQKVKTYLDSMKSGNPMDFETDISAITTKEQKEKIESLISQTVKSGGNIFYSKNMQGTPDKGTYFPPTLLTGLTPGQQISDEEIFGPVLTVYPFKSEKEAIDLANSTKYGLAAGIWTKDIEKAGRVASMIEAGTVWVNEYHLLSAAAPRGGFKKSGIGRELGLEGILEYTQTRHIFYGNNESGMSDVAYGILIKTE

SEQ ID NO: 28048 - protein, 200 aa, Cytophaga hutchinsonii
MAFTTEKDTVSYSLGVNIATSLKNQGFDDLNLDALTTALSDVFGNKTLQIDEAKGGQILNAYFQGMQERKQKKNIEEGVAFLKANGAKADVITLPSGLQYKVLVEGNGPKPTATDKVTTHYHGTLINGTVFDSSVERGQPATFPVNGVIAGWIEALQLMPTGSKWQLYVPSDLAYGARGASELIGPHTTLIFDVELISIN

SEQ ID NO: 28049 - protein, 205 aa, Cytophaga hutchinsonii
MYTKKNKQFVLMGLTYSLMMFVSSCLGINSDVKNRPSATDSMATVDKTQSIYSIKVTTLDGQPFDLSTLKGKKILIVNTASKCGYTPQYEELQQLHALHGDSVAVLGFPCNDFGGQESGSESEIGAFCTKNYGVTFQMFEKVHIKGNEQHPLYKWLTDPALNGWNKDAPTWNFCKYLINEKGELVNFFGSGVKPMSKTVLDAIRK

SEQ ID NO: 28050 - protein, 499 aa, Cytophaga hutchinsonii
MILDGWGLGTNPKVSAIAAAKTPFVDSLFVNYPHSKLEASGLAVGLPVGQMGNSEVGHMNIGAGRIVYQDLVKINLAVENNTLADEPAIKDAFNYAKTNNKKVHFIGLVSDGGVHSHVNHVKGLCNIANQYGLKDVYVHAFTDGRDCDPKSGLGFVKELQESMAKSTGKIASLVGRYYAMDRDNRWERVKLAYDVMVNGEGTHAADALKAIEESYAAGVTDEFIKPVVLVDANDKPIAKIEPGDVVICFNFRTDRGREITVALTQKDFHEQNMFKLDLYYVTMTNYDDTFNNVKVIFDKDNLSNTLGEVLQGASKKQIRIAETEKYPHVTFFFSGGREEPFKGEKRLMAASPKVATYDLAPEMSANEIKEKIVVELKSKDPDFVVLNFANPDMVGHTGVFEAAVKACEVVDSCTEAVVTTALENGYTAIVIADHGNADYMINEDGTPNTAHTTNLVPCILIDNEYKKPLKDGKLGDLAPTILALMGIEKPKEMTGESLL

SEQ ID NO: 28051 - protein, 464 aa, Cytophaga hutchinsonii
MSTKFDVIVIGSGPGGYVAAIRASQLGKKVAVVEKAELGGICLNWGCIPTKALLKSAQVYEYIKHAKEYGINVGNAEADFTAVVKRSRDVAAGMSKGVQFLMKKNKIEIIAGFGKLVKGKQVEVTDDKGNKSLYGADHIILATGGRARELPNVKIDNNKIIGYRKAMVLESKPESMVIMGSGAIGVEFAYFYATMGTKVTIVEYLPNIVPVEDEEISKQLEKEYKKMGINIMTGAAVESVDTAGKGCKVTVKKGDATEVIECDIVLSAVGVATNLEGIGLEDVGVATDKGRVLVDDYYKTNIPGVYAIGDIVKGPALAHVASHEGIICVEKIAGLNPEPMDYGNIPGCTYCTPEIASVGLTEKAAKEKGYELKVGKFPFSASGKASAAGAKEGFVKVIYDAKYGELLGVHMIGANVTEMIAEAVVARKLEATGHEIINAVHPHPTMSEAIMEATAAAYGEVIHL

SEQ ID NO: 28052 - protein, 349 aa, Cytophaga hutchinsonii
MAGGIGSRFWPFSRTKYPKQFHDVLGTGATLIQQTVNRFKNICPPENIIIVTNKDYVGLVKEQLPFLQDHQILAEPIGRNTAPCLAYASYKILQRDKNANIVVAPSDHIILQEKEFENVIVEALQATEQADILITLGMKPTRPDTGYGYIQYIDEKKLRIKKVKTFTEKPALELAIKFIESGEFVWNAGIFIFNAQTIVDAIKKHLPEMDEVFTEGSGLYWTDKENDFINKAYSRCGNISIDYGIMEKSDNVYVMLADFGWSDLGTWKSLFENMPKNDDGNVIDGNVLTYDAKDTIIKTPKNKLVVVEGLEGYIVAEFDDVLMICRKENEQRVKDFVSDVKATQDKRFV

SEQ ID NO: 28053 - protein, 454 aa, Cytophaga hutchinsonii
MLNKKHIKETLVLAGPVAFSQLGHISVGVVDTLMAGQIDKEALAAATIALSVFFPLFMLYIGFSYGFTPLISQADGEGDELKIARILKHALVLNLVIGFFLTGLLYLCIYAIPFMHQPAHIVQPATEFFAIIALSMIPVIIFQVFKQFIEGLGNTKQAMVVSILGNVVNIVLIVILVYGWYGLPKLGLNGIAYATLIARIFMAVTMVLFFLFTKNYAHYRSAYKRTKLEWHYFVDVFNKSYPVGLQMSFESGAFSLAAIFVGTFGTAQISAHQIALNLASVTYMVATGIAAAATVRVGYEYGRKEKTELQIAGRTAIILVVALMSTTALMFTLLHQVLPSFYTEDIEVIGIAGSLLWMVAFFQLSDGIQVVSMGSLRGMGDVVVPSSVAFMAYWVLGLPLGAFLAFVLKWEVYGIWVGLTVGLVFASIVLLVRFLKKSKRVVFEEDAKSVMLKA

SEQ ID NO: 28054 - protein, 426 aa, Cytophaga hutchinsonii
MKADSTLWSWGSNSSGQLGDNTTDNKSIPSQFNTAKGWLKISSGNSHCIGLKKDGSIWTWGWNSEGQLGNGSLTKMLVPTQIGVDNDWMAVSAGQYNTFAIKNNGTLWGCGRNFEGQLGKGTTGSNVKTFIQIGTATDWAYVSVGAFHTMAIKTDGSLWAWGSNNNGRLGIGTTTTKNAPTKVGTATNWKSVYAAGSNTFAIKTDGSLWAWGYNYAGVLGDGTTTDRLSPVQIGTDNNWKTISSDGNTSFALKSDGTLWVWGDNNSGQFGNGTTTNSTLPIQIGTDNQWQHISINYSFLLAIKTDGSLWTWGYNYSGQLGNGTTTNTNLPVLVDCNLSLKVHEAISSENIVVYPNPTAGELTIKIKNQAAQNIHITIMNSVGQILQQKYITDESQLLDLSSQPNGMYLLKIQTTDNQVSLQKIQKF

SEQ ID NO: 28055 - protein, 455 aa, Clostridium thermocellum ATCC 27405
MPQFRDDVDTFARSLIALGVKPGDHVAIWATNVPQWFITFWATTKIGAVLVTVNTAYKIYEVEYLLRQSDTHTLVMIDGFKDSNYVEIIKELCPELETAEPGKPLHIKRLPFLRNIITIESKQKGCISWDEAIALAEKVPIEEVQRRALAVNRHDVCNMQYTSGTTGFPKGVMLTHYNVINNGKCIGDCMDLSTADRMLIQVPMFHCFGMVLSMIACVTHGSTMCPIPYFSPKVALDCINREKITVCNGVPTMFIAMLEHEDFKKTDFSHMRTGIMAGSPCPVKVMQDVVDKMNMKEITIVYGQTEASPGCTQSRVDDPIEVRVNTVGRPLPGIECKIVDPQTGEELPDNTDGEFVARGYNIMKGYYKMPEATAAAIDKDGWLHTGDMARRDENGNYKITGRIKDMIIRGGENIYPKEIEDFIYTHPKVKDVQVIGVPDKQYGEEIMAWVILKDG

SEQ ID NO: 28056 - protein, 339 aa, Clostridium thermocellum ATCC 27405
MVSPGKIEFHEVEKPELKPGQVLIKIMRIGICGSDIHVNHGKHPFTKYPVTQGHEVSGKIVEVAEDVEHLKVGQKVTIEPQVVCGKCHPCRTGKYNLCEELKVMGFQTVGAGSEYFAVDAKNVTTVPDHLSYDEAAMIEPLAVTVHAANRVGDVKDKDIVVIGAGPIGILLVQTLKAKGARKVMVTDVSDYRLELALKCGADFAVNTKKEDFGEAMLRCFGPDKADVIYDCAGNNTTMEQAIKHSRKGSIIVLVAVFEGMATVDLATLNDKELDLNTTMMYRHEDYVEAIELVEAGKVKLTPLMSKHFAFRDWEKAYEYIDNNREITMKVLIDVNNDDD

SEQ ID NO: 28057 - protein, 217 aa, Clostridium thermocellum ATCC 27405
MRLVLLGAPGAGKGTQAVVISQKYNVPHISTGDIFRSNIKNGTELGRKAKEYIDKGLLVPDELTVDIVKDRISQPDCKAGFILDGFPRTIYQAERLDEILKELNVELDCALNIYVPDEEIIKRMSGRRVCSKCGMSYHIVYNQPKVENICDSCNGELIQRDDDKEETVIQRLNTYHKQTEPLIEYYEKKGKLLTVHGQEGVDDTTKEVLNALSGVKL

SEQ ID NO: 28058 - protein, 400 aa, Clostridium thermocellum ATCC 27405
MQLEEIINLDKKYFMNTFGNRTPVCFSHGKGINLWDINGKKYYDFLAGIAVNALEHSHPKLVNAIKQQAEKLIHCSNLYYIESQAKLAEKLVSISCADKVFFANSGAEANEGAIKLARIYFKKKGMPEKYEIITLEKSFHGRTLATIAATGQDKYQKPYCPLTPKFLKVPINDLEALEKAINSSTCAVMIEPIQGESGVNLTSVEYMKGVRKLCDEKGILLIFDEVQCGLGRTGKLFAYEHFGVEPDIFTLAKALGGGFPIGALCAKEHVASAFEPGDHGSTFGGNPLACTAALAALDVIIEEGLVENSAKMGTYFMSKLSELAEKYSIIQEVRGKGLMIGVQLSIDAAVEIKNKCFEKGYLIGSIGNNILRMLPPLIVTEQDIDGMIDTLDSVFQEYQI

SEQ ID NO: 28059 - protein, 1035 aa, Clostridium thermocellum ATCC 27405
MAKKRVYELAKELNTTSKRLMEKLEEINIVVKNHMSFLEEDELEALYDHIGVIRHKDDKSNTDDNKTASAHSVAQHSSEAMKELKKEAKKAPRIIRTTEIYLDSKDEEIKEIKANDAKSQKKPEEKRKKNDFVRVETETSGLRPGLVRETKPEYMRILEEQKKSEASKAQTNEKKDAEKNSVKEVVKKEEGSKQTAEIKDGSVNMEGKVLEEVKATVADSATNVNLNESIDKDKKTNDNRQVSTDNSAVNNEENAADTLNKKDMDKKNNNKKNEAKKNAEKKNEAKKNEKNDNKGGNAKKNEHRSPDMKKNDSNRPQDANKQNSKAAADKNREEGRTGSKKSLEIPKVELTTSQKEEFNSQRAERREYNKDAEKDSKRELRKEQPRSAISGGRNKNHKVIKNVFNSRKGVSEVLSDDFEMDDFYFGGSKKSRKIKKKKEEKKEEKPAPPKPVVTSIKIAAPITVKELAEALKKTSAEVIKKLMSLGIMATLNQELDFDTAAIVADEFGVKAEEEVVVNEEDILFDDSDDPNDPEAVPRPPVVVVMGHVDHGKTSLLDAIKKTNVTEKEAGGITQHIGAYMVKINNRNITFLDTPGHEAFTAMRARGAQVTDIAVLVVAADDGVMPQTIEAINHAKAANVTIIVAINKIDKPTANPEKVKQELTEYGLIPEEWGGDTIFVEVSAKKGVNIDYLLEMILLAADMLELKANPNKQAKGTVIEAKLDKDKGPVATVLVQRGTLCVGDSIIVGTTTGRIRAMTDDKGHRIKKAGPSTPVEILGLHEVPEAGETFYVITDEKTAKQLIEKRKLKQREQLLKASARVTLDDLFNQIKEGKVKELNIIVKADVQGSVEALKQSLEKLSNDEVRVKIIHGGVGSVTETDVTLAQVSNAIIIGFNVRPPANVIDAAKKAGVDLRLYTIIYNAIEDIEAAMKGMLEPTYKEVVIGHVEIRQIFKVSGVGTVGGGYVTDGKITRNANIRLVRDGIVVHEGKLGSLKRFKDDVREVAEGYECGLSIEKFNDIKEGDVVEVYVMEEVKE

SEQ ID NO: 28060 - protein, 267 aa, Clostridium thermocellum ATCC 27405
MKEGDSMAFLEVKGIEKSFGTVKVLKKIDFSLEKGEVIAIIGPSGSGKTTLLRCLNFLERPDKGSIIVNNEVIFDAMDPSTQRESEVRKKRLHFGLVFQNFNLFPQYTVLKNVTLAAELLAKERPDYKQNKKAILKEIQDRGKMLLSQVGLSDKLDCYPHMISGGQQQRVAIARALALDPDILCFDEPTSALDPELTGEVLKVIKGLAERNTTMIIVTHEMDFARDVANRVIFMDAGVIVEQGSPQEVFGNPKEERTRQFLARYKKH

SEQ ID NO: 28061 - protein, 503 aa, Clostridium thermocellum ATCC 27405
MRRKESMAYIYEEVSRTFSEYLLIPNLTTEKCTPDNIDLSTPLVKFKKDEECSLKLNIPIVSAIMQSVSNDTLAIALARCGGLSFIYASQPIESQAEMVKRVKKYKSGFVVSDSNLTIDSTLKDVIELKNRTGHSTIAITDDGTASGKLLGLVTTRDYRISRDPLDKKVKDFMTPFSKLVVGKLGISLSEANDIIWENKLNCLPIVDDEQRLHYLVFRKDYDDHKQNPYELLDSNKRLRVGAGINTRDYKERVPALVDAGVDVLCIDSSDGFSVWQKYTLDYIKSNYNIKVGAGNVVDREGFLYLAEAGADFVKVGIGGGSICITREQKGIGRGQATAVIEVAKARDEYFEKTGVYIPICSDGGIVHDYHIVLALAMGADFVMMGRYFARFDESPTKKVKSGNGYVKEYWGEGSNRARNWQRYDHGGESTNLKFEEGVDSYVPYAGKLRDNLEITLSKIKATMSSCGAASISELQKTARLTVVSSTSIIEGGAHDVILKDKDY

SEQ ID NO: 28062 - protein, 278 aa, Clostridium thermocellum ATCC 27405
MVKIGFLGPKGTFSQEAMLAYTKGSNDFVGVDYNTMVELIMAVENDEIDEAVVPIENSLEGAVSTTMDMLAWDVDLKIKAEVVIEIKQNLMAKKGTDIKDIKYILSHPQPVGQCRKFLNSVFPHAVVKYVYSTAQAAKEVAQGDGNMASIGSLAAAKEYGLEVLKESIQDNDKNFTRFVVISKKEAKKAEKNKTSIVFSTENKPGSLYRILDIFNLWDINMTRIESRPAKNELGKYIFFVDINGHIEDEDVRDALTMVRRKTSFYKFLGSYPEFEIGC

SEQ ID NO: 28063 - protein, 473 aa, Clostridium thermocellum ATCC 27405
MLTDFYELTMGNGYFENGIGDRIAYFDMFFRRVPENGGFAIMAGLAQVIEYINNLKFEDDDIEFLRSKGIFSEDFLKYLKDFKFCCDIWAIPEGTPIFPNEPIITVRGPVIQAQFIETMILLTINHQSLIATKANRIVRAAQGRPVLEFGTRRAQGYDGAVLGARAAYIGGCAGTACAIADRDFGVPASGTMAHSWVQLFPSELEAFRAYARVYPDNCVLLVDTYNVLKSGVPNAIKVFKEEVVPRGFRPKGIRIDSGDIAYLSKEARKMLDEAGFPDCKIVVSNSLDEYIIRDILQQGAQVDIFGVGERLITSKTEPVFGGVYKLVAVEENGTIIPKIKMSENVVKITNPGYKKVFRLFDRKNNKAIADVIVNAGEVIDDSKPYEIFDPDHTWKRKTVTDFYAKELQVQIFDKGKCVYKVPEINEIRDYCREQINTLWDEVLRFENPHKYYVDLSEELWNIKNKLLKEHTLL

SEQ ID NO: 28064 - protein, 324 aa, Clostridium thermocellum ATCC 27405
MYEIYALQKGYKRMNPYKRIALKALSHWGRNLKKNYRVYRRFTNVVSVCTGHGCRIADLEVAAGDRNIPVRLFHPDDPALGVLIFFHGGGWVTGNVDSYTHVCSNMANQTKNIVVSVDYRLAPEHPFPSGLEDCYDATREFFKNPGLLNCKADDITLIGDSAGGNLAAAVSLMARDRGEFLPKRQILIYPSTYNDHSENSPFPSIRENGTGYLLTSEEIQNYMDMYAPNIEDRQSPYLAPLLARDLSNQPDTLIITAEYDPLRDEGEAYGMRLKEYGNNVKMYRIKGALHGFFSIPWKSQHVSRSFEIINWFLNSYNGQSEELL

SEQ ID NO: 28065 - protein, 461 aa, Clostridium thermocellum ATCC 27405
MSPKKVPMPEQDPNVRIKNFLEVALGYTEQMAMEEAQRCLNCKHKPCVSGCPVNVKIPEFVQLIAQGKFEEAYNKIRETNNLPAICGRVCPQENQCEKFCVRGIKGEPVAIGRLERFAADWHMKNGTTSYEKPEKNGKRVAVIGSGPASLTCASDLAKLGYEVTIFEAFHVPGGVLMYGIPEFRLPKKLVQEEIETIKQLGVEIKTNMVIGKVYSIDELKAEGYDAIFIGSGAGLPSFMKIPGENLNGVYSANEFLTRINLMKAYEFPNCDTPVKVGKNVAVVGGGNVAMDAARSAKRLGAENVYIVYRRSEAEMPARLEEIHHAKEEGILFKFLTNPTRILGTDDGWVKGMECIEMELGEPDESGRRRPVPKPGSEHVIDVETVIIAIGQTPNPLIASTTPGLATQKWGGIIVDENTGATNIEGVYAGGDAVTGAATVILAMGAGKKAAKAIDEYLKNKK

SEQ ID NO: 28066 - protein, 311 aa, Clostridium thermocellum ATCC 27405
MAKIAKNLTELIGNTPLLELSNYNRANNLEAVLIAKLEYFNPASSVKDRIGYAMIKDAEEKGIINKDTVIIEPTSGNTGIALAFVAAARGYRVILTMPETMSIERRNLLKALGAELVLTPGADGMGGAIRKAEELAREIPNSFIPQQFSNPANPEIHRRTTAEEIWRDTDGQVDIFVAGVGTGGTISGVGEVLKQRKPDVKIVAVEPFDSPVLSGGTKGPHKIQGIGAGFVPDNFNRAVVDEIFKVKNEEAFETSRKLARTEGLLVGISSGAAAFAATQIAKRPENKGKNIVVLLPDTGERYLSTALFQDA

SEQ ID NO: 28067 - protein, 220 aa, Clostridium thermocellum ATCC 27405
MLIKIAPSILSADFSKLGEEVLRIEKAGADLVHIDVMDGHFVPNITIGPPVVKSLKKVSKLPFDVHLMIENPDMYIESFADAGADIISVHAEACRHLHRTIQKIKQLGIKAAVALNPATPLCAVEWVMEDVDMILLMTVNPGFGGQKYINGVTRKIEELERIVESRGLNIDIEVDGGIDTETVQYVTKAGANVIVSGSTIFAAEDTAKIIQELRMNSYRK

SEQ ID NO: 28068 - protein, 302 aa, Clostridium thermocellum ATCC 27405
MIYDDMQQLIGNTPLVRLRHSGFPDGVRVYAKLELYNPSGSVKDRIGKYMIEDAEKRGVLVPGSTIVEGTAGNTGLGIAFAALNRGYRLIMVVPTKFSQEKQALLRALGAEVINTPREEGMLGAERKAEELRQSIPKAVSLEQFRNPANPLAHYETTGPEIWEDLGADIDYFVAGAGSGGTYAGIVRYLKEQKPDIKGILADPIGSTMGGGEHGDYDIEGIGNDFIPETMDMSLVDEVIKVSDDEAFTETRLLARNEGIIAGSSSGANLAAVRKLAMRIQRGTIVTVLPDRGERYLSKNLFL

SEQ ID NO: 28069 - protein, 511 aa, Clostridium thermocellum ATCC 27405
MKDKLVMLIILDGYGINPRKEGNAIEAANKPNIDRFMREYPNTIVRTSGMDVGLPDGQMGNSEVGHTNIGAGRIVYQELTRITKSIQDGDFFEKKEFLDAAENCRKHNSKLHLFGLLSDGGVHSHNTHLYGLLEFAKRQNLKDVYVHCFFDGRDVPPDSAMGYVEELENKIREIGVGEIATVMGRYYAMDRDNRWERVKLAYDAMVLGRGNQAQSAKEAVAESYKRQEFDEFVKPTVIMKNGSPVATVGENDSIIFFNFRPDRAREITRAFTEVNFSGFEREKGYFPVFFVCMTQYDKTFENVVVAFKPESLENTFGEYISKKGLRQLRIAETEKYAHVTFFFNGGVEAVYEGEDRILINSPKVATYDLKPEMSAYEVTDKVLECINKKEYDVIILNYANPDMVGHTGVFEAAKAAIEAIDECLGKVVPAVLEQNGVVLITADHGNSEQMIDYETGGPFTAHTTNPVPLIVIGLGDVKLREGRLADLAPTMLDILGFEKPKEMTGESLIVK

SEQ ID NO: 28070 - protein, 251 aa, Clostridium thermocellum ATCC 27405
MSRKVIAAGNWKMNKTPKEAVEFVQALKGRVADADTEVVVGVPFVCLPGVVEAAKGSNIKVAAQNMHWEEKGAFTGEVSGPMLAELGVDYVIIGHSERRQYFGETDETVNKKVHAAFKYGLKPIICVGESLTQREQGVTAELVRYQVKIALLGLSAEQVKEAVIAYEPIWAIGTGKTATNEQAEEVCGIIRECIKELYGQDVAEAIRIQYGGSVNAANAAELFNMPNIDGGLVGGASLKLDDFEKIAKYNK

SEQ ID NO: 28071 - protein, 397 aa, Clostridium thermocellum ATCC 27405
MAMMNKKTIEDIDVKGKKVIVRVDFNVPLDENRKITDDKRIVGALPTIKYLVEHGAKTILVSHLGRPKEGFEEKYSMAPTAVRLGELLGKEVIMAKDVIGPDAKAKAAALKEGEVLMLENVRFHKEETKNDPAFAKELASMAEIYVNDAFGTAHRAHASTAGLADYLPAVCGYLIQKEIEVMGKALSNPERPFVAILGGAKVSDKIGVIENLIDKVDTLIIGGGMAYTFFKAKGYSIGTSLCEDDKVELAKSLMDKAEKKGVKLLLPVDNVVGKEFSNDTERKTVPSDQIPDGWMGMDIGEETIKLYSEAIKNAKTVVWNGPMGVFEFSNFANGTREVARAVAESGAISIIGGGDSAAAIEQLGFADKITHISTGGGASLEFLEGKVLPGIDVLMDK

SEQ ID NO: 28072 - protein, 488 aa, Clostridium thermocellum ATCC 27405
MFDTKDKDLEREIIIDWETGKRLTFKGLQTEVVRLANFLKSKGYVPGTVIATHLYNGIEAAVAFLAAEYIGCVVCLVDPLFKADEVPYYVEDSGAKCLITHLEKDEIAGKLPSEVDVINVREVQEVCESDEFEKSLEIYDFEENELALLLYTSGSTSTPKGVMLTTGCCHTFLRKNHQSMYRYDPDDRILCFVPFSHGFGSISVLIPALAYKAGIVFQKTFHPAKVAEAVIKENITHMLGVPTHYRQLLRYEPFINNLGKLKAAFCSAAPISCEVARQWYEKTGIYLDEGYGMSEATTLITTRMSRLPSTSGDVGHPPEGIISVDIVDDNDRVVENGTIGEIRVTGQGLMLGYLNRPKETAERLRNGYLYTGDLGYKNPDGSLVVCGRKTEFINVAGLKISPVEVETALNSHSDVIDSAVVGVTDEVYGEVVKAFVIKKQDSNLTERELIKYVSDKVANFKVPKYVVFVDEFPRNNVGKVDKKALKNM

SEQ ID NO: 28073 - protein, 465 aa, Clostridium thermocellum ATCC 27405
MEKFFKLKENGTNVRTEFIAGLTTFVTMAYVIFVNPNTLEASGMDKGAVFVATILAAIIGTLIMGLVANVPYAQAPGMGLNAFFAYTVVLGQGFTWQQALALVFLCGLINILITVTRIRKMLIAAIPQSLQYAISGGIGLFITYIGIKQAHLLDFTVSSGTYTTLPNGNVVSGDIVPALADFTDPVTQLALIGLVITVVLMLLKVRGAILWGIMATTVIGLFMGITPIPELTASNFLPPSISPTFLKLDLAGLFTDPAKIPTVLATILAFSLSDTFDTIGTFLGTGRKTGIFDEEDEKALHSGKGFKSRLDKALFADSTATSIGALLGTSNTTTYVESAAGISVGGRTGLTSVFTALFFFLALFLSPIAGMVTSAATAPALIVVGILMMESLAKIKWDEFEEAVSAFFTVVVMPFTYSISNGVAAGFVFYVITKIVKGKAKEVHPILYVVVLLFILNFVFSALKL

SEQ ID NO: 28074 - protein, 469 aa, Clostridium thermocellum ATCC 27405
MRKYGLKKIVWMLGILCFLVVSLNTSIFAADGKNVVLGDVNGDSKINAIDVLLMKKYILKVINDLPSDGVKAADVNADGQINSIDFTWLKKYMLKAVEKFPGEASNNPDAVIQFESGFAHSVLLKKDGTVWVLGNNGKGQLGLPEVSAVNEPVMINGLSGIKSVAAGREHTLALQEDGTLWAWGNNYSLQLIEYMERDPDTKERFTSIPIKVETHSDIKYVAAKFSRTLIVKNDGTVWLYSLPPINTSSDAEYMPWEIKGFGDIKMADIGTGHIVALREDGTVWTWGENVWGQLGNGWQQHHNIHTYIYFEPNQAKNLSDIVSIAAGDAHSVALKSDGTVWTWGSNFNGELGNGTTTYILEPKKVEGLEDIVAIDAGIGHTVALKADGTVWVWGKNSYGQLGNGTTMRSTVPIQVEGLEGIVAIQAGMECTIAYKNDGTVWAWGKNDFGQLGDGTFENILRPVKVFERK

SEQ ID NO: 28075 - protein, 334 aa, Microbulbifer degradans 2-40
MTTYRPAKTSLANLPTALQPLDRVSQILGGPRIWLKRDDLTGSTLSGNKVRKLEYVVAEALSNGADTLITCGGLQSNHCRATALVAAQLGLKAHLILRGQQKGSAADGNLLLDDLAGAQISQYSVADYSKNLTSLFSHWQNHYAQQGRKAWCIPTGASDEIGIWGYIDAFAELEAQLAERDINPDLVVCATGSGGTQAGLSLGAHILGSKAKVVGMAVCDSEAYFERKAKQDITLWQQKYGQAAGISAQQATQVQINTIDKYIGPGYAKAYPELLERIRWLAATEGVVLDPVYTGKAFYGLVQEIKSGRWANMKDIVFVHTGGIFGLFPYRDEF

SEQ ID NO: 28076 - protein, 457 aa, Microbulbifer degradans 2-40
MNNANQQKAHLVIVGNGMATGRLLDELIKRDANAYNITVIGDEPEGSYNRIMLSPVLAGETELATIINKPAAWYAQNNIRFVAGVRANAINRQAQTVALADGSCIAYDELVIATGSRPALIPATNQHLQNIFSFRTIEDVNSIASCAQAGRKAVVVGGGLLGLEAAYGLAQKGVQVTLVHRSKGLLNRQLDSGAGEFLQQVMASKNIQFALGTEVAAFNSDALGGSGFASETLKSATLTNGETIECDLAVISTGITPNKELGQEAGLACGRAIIVDDYMTSSDNCISALGECCEHKGETFGLVEPIWHQCISLAEKLCFKRNVAFVNPVVATKLKVSGVQLFSAGEHLTGDDCREIKMVDVKNKIYRKIVLRNNRIVGVVLFGDTRSGADYFELMQQAVDVSSVAALLVMGKAFYAEQLQAAQNLNQCANQADFSQADSLNTASVTVSKNANNDIAA

SEQ ID NO: 28077 - protein, 251 aa, Microbulbifer degradans 2-40
MLLACAQQITGINAIYFYAPTIFEQSGVGTNAAFAQAALIGLINVLFTIVAMGLIDKVGRKPLLLIGLTGVAISMSLCAWEFKQAHYKIENAAIFEELNIPAPMNLVGVTFNSDTEFKQALRIELGDLAAKDYEAKLISNAIQFNAKLFLFGILLFVASFAVSLGPVMWVLLPEIFPNHLRGVGMALTGLVNSAVSFSVQLVFPWELSQLGAALTFFIYGAFALLGCILVARYLPETKGKSLEELEATFIK

SEQ ID NO: 28078 - protein, 424 aa, Microbulbifer degradans 2-40
MENIFKDLESNVQSYALSFPVIFNRAKNEELFDTEGNAYIDFLAGAGSLNYGHNNDVIKKALVEYIMEDGVTHGLDMHTKAKAEFMDSFNTHILQPRELDYTMQFTGPTGANAVEAALKLARKVKGRTNVVSFTNGFHGVTAGAVAATGNQHHRDGTGVPLANVSRMPFCGYHGQNVDTIKMIDKLIGDPSSGVDAPAAAIVEVVQGEGGLNVAQDEWLRQLEKLCRKHDMLLIVDDIQAGCGRTGTFFSFEKAGIKPDIITLSKSFSGYGLPMAVVLMSPELDIWKPGEHNGTFRGNNHAFVTAKAAIEHYWKDDKFQNEIAEKSAKVTKRLKHIADKYGVTKARLKGRGLMQGIDVVSGEIADEITTKAFEKGLIIETAGNLSQVIKVFCPLTITMEKLNAGLDIVESAFAEVLGDKLRNVS

SEQ ID NO: 28079 - protein, 481 aa, Microbulbifer degradans 2-40
MKIHNMKNFINGEYIASQADGAIDVLSPSTGKKVGDIPAGCVEDAQLALDTANAAQKLWAKKTNRERAKILRVFAANIRAAADDLAKLLVSEQGKLLSVAQMEVEATATFIEYACDNALTIEGDILPSDNPNEKIYIHKVPRGVVVAITAWNFPLALAGRKIGPALVTGNAIVVKPTQETPLATLALGELANAAGIPAGVLNIVNGRGSVVGQHLCESPITRLITMTGSTPAGQRIYRTSADHLTPVMLELGGKAPFIVMEDANLESAVEAAFTTRYANCGQVCTCAERLYVHESIYPAFMDKLLEKVKAIKVGDPMAADTDMGPKVNQSEIENIDALVKKGIEQGATLLHGGKRAHVPGFEGGNWYEPTLLGDVQQSNILVHEETFGPILPVVKINSIEQAIEYTNDSEYGLSTYLFTQNLKYIHQYIAEVEAGEVYVNRGIGEQHQGFHNGWKLSGAGGEDGRYGLEQYLEKKTVYFAE

SEQ ID NO: 28080 - protein, 243 aa, Microbulbifer degradans 2-40
MKKLPLVTAMCAVIALAGCNKEEASVKKELVLETSEQKVSYLIGQNLGSNMGQDKFELDMDAMVAGLEEGLAGKESRISEEDARAVMMAFQAEQRAKMEAAQQEEAQKTLAEAQAFLAENATKEGVVQTESGLQYKELKAGDGATPTASDTVVVHYSGTLLDGTEFDSSHKRGKPAEFMVGALIPGWVEALQLMQVGDEWELYVPADLAYGPGGTPNIPGNSTLIFKMELLDIKAKEAPAEAK

SEQ ID NO: 28081 - protein, 1163 aa, Microbulbifer degradans 2-40
MKKLSQFAGAIPFFCAVFLNAFVDLGHKIVIQNTVFKLYDGPTQVVLTAIVNGLILLPFLLLLSPAGFLSDRFAKPRVMQLAAWIAVGLCGGITAFYYLGWFELAFAMTFLLAAQSAIYSPAKFGFIKELFGKERLGQANGIVSALSIVAILAGIFAFSILFEIWYPKGSNLTDSDILQAIAPIGWVLLACAIVELVMMYRIPNIPASAAPSTLNWSRWLTGRLFADDLQPLSQSRVIRLSVIGLAMFWSVGQVMLAAFPAFIKEQTQVDNTILVQGVLACAGIGIAIGSIIAGRMSRDHIETGFLPIGACGIALGLLFLPHTDSLALAALTFLWIGTMGGLFIVPLNALIQFTAASNALGKTLAANNWVQNLGMLSFLILTVVFSLLGWSSESLLNLIAIVALLGGLYTIYQLPQSLTRFVLTWVLSRHYKLQVQGIKNLPAKGGVLLLGNHISWIDWAILQLASPRPIRFVMIKNIYSRWYLTWFFDLFGCIPIEQGPRSREALKTVSEKLNNGDVVCLFPEGTISRTGHLAEFRRGFEKACEDVNDDVVIVPFYLRGLWGSQFSRSSERLRKQQSNGMHRDLVIAFGHPMPKTASAEEVKQRVLDVSIASWKEYVNNLPTLPQQWVRAAKRHSTLPVVSDTLGTDLNGLQALTGSLLFAKRIKRHSRKQTVGLLLPTTAGAMVCNMATLMAGKTLVNLNYSAGASAMLSAIEQADIDCVFTSEKFLRKLEGKGLDTAELKAKTHLVYVEDIKTNISGVEKIVTATVCKLLPARLLQALYCPCTTLESTAAIVFSSGSEGAPKGIQLSHKNIMANVKQVADVLNMEANDIMLANLPLFHAFGLTAAQFLPLLEGIPVIAHPDPTDALGSAKAIAKNNATIMFGTTTFLRMYIRNKKVHPLMLNSMRLIVAGAERLTPEVREQFKLKFNKDIYEGYGATETTPVASVNLPDRLSQQDWKVQLGNKLGTVGMPLPGSSFKIVDPNTFEELPVGESGMILLGGSQVMQGYLNQPEKTAEVIKLINDTRWYVTGDKGRLDEDGFLTIEDRYSRFAKIGGEMVPLGKLEQALQVLLPQIDGSDETATTPELVAVNLPDAAKGEKVILLTTSPLAKDAVRNCISEAGLTSLANPSAIIEVTAIPKLGSGKTDFGSAKKLAAEQCEGK

SEQ ID NO: 28082 - protein, 1432 aa, Microbulbifer degradans 2-40
MNAIRNMLKVSTLILLAVGLYACGGGSTVESGKELLTCSVPQVPNSAGTECVDPEPIQCAIPTVPDEKNETCIVGANPDAPDPIVFPGPNQAILFFNKADGDYEGYRLHNWNSETCNAYAEGSLAASWSNGLVHSGVDPVYGAYWLLDLVEGHDDCGHFIIHVGTDDAGKEMGGGDWIMPLAQDDPKFTRMNFTFSGVGSVFEFPVPSLGPQKVAIAGAAAHWLDIDTLVWNLDTTDVADVKLHYSATAGITVDDDSNVSGSTADLTFATLSEELQQLVPHMASWPAFGNMLTASDVKPIVKGQLIAVAYNADGKAIAATKVQRARVLDALYTAGENDADEATLGVVYDGANINVSVWAPTATSVTLRVFDAAKTEVSSHTMNEDTSTGIWSFAGDSNLDRVFYQFELSVFHPLTQAIETVTTSDPYSVSLSTNGEYSQFVNLADDDLLPENWNGHTVPTIANFEDAVILEAHIRDFSIRDETVSEANRGKYLAFTETESNAVKYLQRMAESGVTHFHMLPANDIATVNEDESEQINLTSTVAELCAVKADAPVCGEESDSATLISVLESYQYEPLAAQALVESMRSLDGFNWGYDPHHFNAPEGSYASDPDGVARIKEMREMNKALHDLGLRVVLDVVYNHTSASGLWDNSVFDKVVPGYYHRYDENSGGIITSTCCDNTAPENRMMHKFVVDSLVLWAEAYKFDGFRFDIMGHIPKSTILEAREAVLAVDPNTYFYGEGWNWGEVENNRLFVQATQANMAGTEVGTFNDRPRDDIRSAALFNEDGSLDAQDHIRLGLAGTQADFILESNRGNMGTGSTYARASYGLDPADIINYVSKHDNETLWDQLQYGLPESMSLEDRVRAHNIAATIPVMSQGIPFFQLGVDMLRSKSMDRNGYDAGDWFNFVDYTMASNNWDVGLPLAQDNEVRWEEIDAISGRISAPGMFELDYSSQVFSEFLQIRKSSPLFRLTTSADIIDRVGFHNIGNRQQQGLIVMSIDDGTGLADLDPANDAIVVVINGTNESQSHTVATAAGFQLHSIQQSSVDSVVAGSTFTAGEGEGTFTVPALTTAVFVKPQGEAQGAGLSADVTQGAPDVVPFGDTVVYIRGDMNTWSTDNPLTYAGNGVYSTTIALTGGTTYGFKFADAEWGALGVNFGGAEGGDGVVTEGVDKNLFATNTNLSFTPAVDATYVITFDASDSAAPVANIVNEEPYPGSTILLRGDMNSWGETDAFTYEGGRIYTFETTLDAGTYGFKVATGDWNTVNFGAAAEDENVVSLGENVYLGSTNFNLSLTLAESTELVFIFDMTNLDEPKLRVMNKAFFGDTAVYIRGDMNSWGATDEVAYVGDGAYATTLTLAVGSYSFKVADADWADVNFGPTSAEAAPIVLGATNATLFNSPNNFSLTVETAGDFTFTVTGPDATNPSLTVTAAN

SEQ ID NO: 28083 - protein, 489 aa, Microbulbifer degradans 2-40
MGVSSRTAFQFAAIVAMGGFIFGLDAALISGTVRFVTAEFGLNDLQLGSVVSAPGFGVLFALIAAGPLCDRIGRKYTLIIIAALYVLSAVFSVIAPSYEALVAARFIGGLAFASLSLASMYIGEIAPADMRGKLVSMNQITIVVGLTAAYFFNYFLLELAGSGAQWVQTVGLQQNLWRWMLGVEILPALVWLLLLLRIPESPRWLIAKNRIDDAKHALQRLVPAEKVEENLASICNAVHGEVLAPSFAKQFSMLFDSRLKRAMIVGLAFAIVQPITGVNAILFYAPMVFEQTGVGTNAAFMQTIIVGLVSLVFTVVALSCIDKFGRRPLVIVGLLWSVLSLFMCFWAFNEATYLLEASHLAELAGTLDQAQLGALQNMIGVQYSSDLEYKAALALNLGAESARAYEGVLIQLAATMNGWLVILGIIGFIAAFHLSIGPIMWVVFSEIVPIHVRGVAIPMFAFVTSLVSFFVQKLSSMAVKCYGARQKYF

SEQ ID NO: 28084 - protein, 312 aa, Microbulbifer degradans 2-40
MTSTLIIGESMVELTHHTDDLLRKSFAGDTHSAAVYLKRLAGDSEDVSLLSAVGLDGLSNELIEALNKEGVSTHTVLQHPTRTIGLYMVHTDSQGERSFQYWRSQSAARATMALLEQQPALLADLAPTRVFFSGITLAIFDSTARAQLRELLEQLKMRGTQVIFDPNYRPALWQNKEETKAEYQWAFAVSDVVLPGLDDLNKLYGTSSMQSAVALVKTLCSGEAIIKNGEHGVTYLNADTQFSVEVAPVAKPVDTTAAGDSFNAALMAARSKGLPPQQAIEFAASVAAIVIQHKGAIIPRTELQHAINQLNT

SEQ ID NO: 28085 - protein, 235 aa, Microbulbifer degradans 2-40
MCGDFRTNQKRLEDLSSLWFGVHQTEVSVSPAYPYLAQAAGMLENTNISLCAQDVSTRENGAFTGEVSAAMLADMGCRYVMVGHSERRHYHNEGYDLIAEKFQAVCEAKMIPILCLGETTADREADRTFDVIGRQLLKVVNACGLEGLAKGVVAYEPIWAIGTGRAATPEQAQDVHSYIREILGPEGEQIRILYGGSVKPDTAEGLFAKKDIDGALVGGASLDARDFVAICRAAE

SEQ ID NO: 28086 - protein, 468 aa, Microbulbifer degradans 2-40
MSEKTLNLIKESEATWLDLRFTDTKGKEQHVTIPASYVDEEFFENGQMFDGSSIAGWKGINESDMILMPDDSTAMLDPFTDEATVILRCDIVEPSTGQGYERDPRSVAKRAEEFLKSTGLGDTAFFGPEPEFFVFDDVKWGADMSGSFVKINSEEAAWSSGSKFTDGNLGHRPRVKGGYFPVPPVDSLHDIRASMCNAMMQMGLDVEVHHHEVATAGQCEIGVKFNTLVKKADEVQILKYCVHNVAHAYGKTATFMPKPIVGDNGSGMHVHQSYWKDGVNQFAGDGYAGLSETALYYIGGIIKHAKAINAFSNPGTNSYKRLIPGFEAPVMLAYSARNRSASIRIPYVPSPKGKRIEARFADPIANPYLCFAAMLMAGIDGVKNKIHPGDAADKDLYDLPKEEADKIPQVCGSLREALDNLDKDREFLTQGGVFTDDMIDAYIELKMEDVFKIEHTTHPLEFDLYYSV

SEQ ID NO: 28087 - protein, 466 aa, Microbulbifer degradans 2-40
MAEFQYDFLVIGAGPAGEAAAMAAAKSDLRVGVIESQGMLGGNCTHRGTIPSKSLRHTVKQVIQFGSQPIFRNIGGARPLTYPAVLDAASQVIPKQVELHTEFFARNRVRVHSGNARFLSNTQVEVMDSHGVRDVISAERVLIATGSRPYRPDDVDFTHPRVYDSDTILDMQHTPRTIIIFGAGVIGCEYASIFAGLGLKVDLINTRERLLEFLDDEISDALSYHLRDNGVMVRHSEECASVDATSKGVTLNLKSGKRIRADALLWCNGRTGNTDMLDLENAGLEANHRGQVKVDNNYCTEVDNIYAAGDVIGWPSLASASYDQGRAVVAAMLQKEMRFVEDAPTGIYTLPEISSVGKTEAELTSARIPYEVGRAFFKDTARGQISGEDVGMLKILFHIDTLEILGIHCFGAEAAEIIHIGQAIMNQPNGANTVKYFVNTTFNYPTMAEAYRVAALNGLNRVNRHS

SEQ ID NO: 28088 - protein, 307 aa, Microbulbifer degradans 2-40
MDAIDYKKIFSEIVNELSSEDEKGSVATYIPELANVDPNKLGMHLTTVTNQHFAYGDAEEAFSIQSIAKVWSLTLALKHLGADTWQRVGVEPSGTAFNSLVQLEYEMGIPRNPFINAGAIVVCDILVSCLKNPKEDLLDFIRTSSGIPSIEYCPVIAESEVKTGHRNYALAHMMKGFGNIHNDVDCVLDLYFSLCSIKLTCKQLAQAFLFLAAGGVNPATQQQVITPKRTKRINSIMQMCGFYDEAGEFAFKVGLPGKSGVGGGIVAVHPGKYCIAVFSPRLNASGNSVKAMKVLEALTTKTELSIF

SEQ ID NO: 28089 - protein, 317 aa, Microbulbifer degradans 2-40
MLYDNILATIGNTPIVRLNKLAPEGQNIYVKVESFNPMASVKDRLAFAIIDDAEKRGVLKPGQTVVEATSGNTGIALAMVCAAKGYPFVATMVETFSVERRKLMKALGAKVILTPAAEKGTGMVKKAAELAEKHGWFLASQFENEANPAYHRNTTGPEILRDFAGKDLDYFVSGWGTGGTMTGAGQMLKLARPDLKVIVAEPQNAAMLSGNPWSPHKVQGWTPDFVPAVLDKTVADEIVTVSDDDAIATAKALATQEGIFCGISSGATLAATIAYAKQAPTGSTFVVMLPDTGERYLSTPLFADITEESDDEWLSQQ

SEQ ID NO: 28090 - protein, 351 aa, Arabidopsis thaliana
MKGFFKTESETRKHSDKNGSLLHEELIACSDGKYNPIRMFSSDQILKATNNFDADHIIAKDRFIWYKGTIEERRVLIKKWEGDYVLFSSPENVYRDIAVLSMMSSHKNVLKLLGCCVEFYKPVLVCELAEKGPLKLEDMDGTPLPWSARLKIGKDIANAVAYLHTAFPRVIINRDVRPQNIFLDEDGTAKLSSFCLRISIPEGESSVYDDKVVYGVSVDPEYNGTGLVSEKFDVYSFGVTMLFLLGGELGLTWLSAIIGEFGFPFPGCGEELADQFMYVIDSNIWNGESEASAVQVETFFGLALRCIRFWPGQDVLTMIDVAKELKGIEELFKASSSEQDKEQIDQVNYSV

SEQ ID NO: 28091 - protein, 174 aa, Microbulbifer degradans 2-40
MLACTFTASTHAAEESAQCPSYLDHSFKKLHSTQTVNLCELYTGKPLLIVNTASHCGYTKQFGGLEKLYQSYKDQGLQVIGFASDDFKQAAKSEMEAATICYKNYGVTFTMLAPTTVTGEKANAVFSHLNANTSAPSWNFNKYLITKNGQNIEKFNSDVTPLASDLEKKVQKAL

SEQ ID NO: 28092 - protein, 229 aa, Microbulbifer degradans 2-40
MTDQKVIMIRHAQSEWNAKGLFTGWADPVLTPLGRKEAAEAASNLAKLGLKFDRIYTSVLQRATETASIIAKSLNCQVPLTKSWQLNERHYGVLQGKSKEALAKQVGAEQVWRWRRGFEDMPPPMPLASPMHARFDTKYDGVEPTSLPSVESLKHTQIRAVNYWQKEVLPSIRNNSSVLVAAHGNTLRALIMYLANMSVQEVEGFEIPTGIPIELNINKHGRCSSWRYI

SEQ ID NO: 28093 - protein, 234 aa, Microbulbifer degradans 2-40
MHALVEGGADIIEVGVPFSDPMAEGPVIQRGHERALEHNVSLKGTLALVKEFRKANSDTPVVLMGYANPVERMGYELFAAQAKAAGVDGLLTVDLPPEEAVELNKELVANGLESIFLLAPTTTEERMKKVVGLASGFLYYVSLKGVTGAGHLDVNAVKERVEKISSLTDLPVLVGFGIKDPESAKSIGANADGVVVGSVLVDAMGNAASESDEVICEKIINIVAPIRAGLDSLA

SEQ ID NO: 28094 - protein, 464 aa, Microbulbifer degradans 2-40
MENVVPVILSGGSGSRLWPKSRKAYPKQLHRLYGDATMLQHTVKRVDHLGAPIVVCNNDQRFMVADQLQETCGDASQIILEPIGRNTAPAIAVAAMRAVQQVGDNAIIVILAADHLIKDMPGFRATLDIAIKKATEGKLVTFGVVPTHPETGYGYIKAAEPLAGNTQGATVAEFVEKPNLETAQKYLAEGSYTWNSGMFVFPAKTLLEELTRLNAELVKQSQISLDKSEQDLDFIRLNEQAFAQCQDISIDNALMEHTNKAWVVPLNAGWSDLGSWQSLWESSDKDEYGNVVVGDAYMRNCTNSLIHSDGRLVAAIGLDDVVIIDSDDALLVVNKNKTQDVKHVVDWLKANNRSESQHHREVHRPWGSYDSIDSGERYDVKSLKVKPGASLSLQMHHHRAEHWVVVRGTAQVERGDEKFLVTENESVYIPLGEPHRLTNPGKVPLYLVEVRSGEYLGEDDIVRL

SEQ ID NO: 28095 - protein, 198 aa, Microbulbifer degradans 2-40
MEAYGVPQISTGDMLRAAVKAGSPLGLKVKDIMTSGGLVSDDIIIDLVKERIAEPDCQKGFLFDGFPRTIPQAEALVAAGVNIDHVLEIFVEDEEIVSRLSGRRVHEASGRVYHVKHNAPKTEGVDDETGEPLVQRDDDKEETVRKRLAVYHEQTEPLVDFYKKLSAESSDSLPVYSRVDGIGSLDDIQARVFEALKK

SEQ ID NO: 28096 - protein, 312 aa, Microbulbifer degradans 2-40
MNNSVAVIGESMLELMRAESDSSCRSMPAMLSYGGDTLNSSVYMSRLGAKVEYITAVGKDKNSEWLVKQWQSEGVGTRFVRTDEKKVPGLYMVTNDESGERYFTYWRNDSAARYIIDSEEKKQALYADLEGFDWIVISGISIAILDEASKKRMYELLQQCKARGAKIAFDGNYRPALWESKEQTRQAYQTVTAFADIILPTIDDEFQLYGEEPKDEVIDRLLSYGAKEIVLKMGGEGCYTVADNERTLVPGRKVVVVDTNSAGDSFNAGYLTGRMQGMSVEESALRGHLLASTVVQYRGAIIPKTAMPKMVG

SEQ ID NO: 28097 - protein, 454 aa, Microbulbifer degradans 2-40
MAKQKTGYVCTDCGADYSKWQGQCAECGQWNTVQEVRLGAATSSRSASQAGYAGQGLSKVTPLAEIDLAELPRIASGMDELDRVLGGGFVPGSVVLIGGNPGAGKSTLLLQTLCHLSQKHPALYVTGEESLQQVAMRAQRLGLPTDKLQLLSATDVDALLASADQVKPKLMVVDSIQVMHHADIQSAPGSVSQVRESAAALTRYAKQTGTVLILVGHVTKDGSLAGPKVLEHIIDCSIMIEGSNDSRFRTLRGSKNRFGAVNELGVFAMTEQGLKEVSNPSAIFLQRSDEVASGSVVMVVWEGTRPLLVEIQGLVDMSSLGNPRRVAVGLEQNRLAMLLAVLHRHGGIMVGDQDVFVNVVGGVKIVETSADLALLLALVSSFRDQPLPRDLVVFGEVGLAGEIRPVPSGQERLREAAKHGFKKAIVPANNVPREPIKGLEIVAVKKLSEALEAI

SEQ ID NO: 28098 - protein, 170 aa, Microbulbifer degradans 2-40
MIDADGFRPNVGIILTDDQGRLLWARRVGGQDAWQFPQGGIKHNESPENALYRELEEEVGLCKADVEVLGVTQGWLRYRLPRRLVRDKEPKCVGQKQKWYLLRLVSNDSAIRLDASSPAEFDTWNWVSYWYPLGKVVAFKRDVYRRALKELSPVYNQYFLSTLGEGRALC

SEQ ID NO: 28099 - protein, 411 aa, Microbulbifer degradans 2-40
MENSIFELQYALDTFYFLVCGALVMWMAAGFAMLEAGLVRSKNTTEILTKNVALFAIACIMYFVCGYAIMYGGDYFLTTITGDGVTGAEEPASYAPSADFFFQVVFVATAMSIVSGAVAERMKLWAFLAFAVVMCGVIYPVEGGWTWGGNSVFGMYTLGDLGWSDFAGSGIVHMAGAAAALAGVLVLGARKGKYGPNGQINAIPGANLPLATLGTFILWMGWFGFNGGSVLATASVESANSVAIVFMNTNAAAAGGLVSALILARILFGKADLTMALNGALAGLVAITAEPSTPSALQATLFGGLGGLLVVFSILTLDKLKIDDPVGAISVHGVVGLLGLLLVPVTNDASSFSGQIIGALTIFTWVFGTSLAVWFLIKLVIGVRVSEEEEFEGVDLSECGMEAYPEFTNGK

SEQ ID NO: 28100 - protein, 254 aa, Oenococcus oeni PSU-1
MAHIDTILAQGGNGSDDQKTGAVVAPIYFSTAFRHPGLGESTGFDYARLQTPTWQILEKQLAEIEYGDNAFAVSSGMAAIDLLFSTFLKKGDNFITSDDLYGGSFRYFDDLVEKNGIDYSLWDGTDFSYLKQKISPKTRLIWLETPSNPTMKIIDIKKVADFVHKIDSKILVAVDNTFLSPILQNPIKLGADLVVHSATKYLGGHNDILAGVVVSSRSELSKSLQENLITRGQVLDPFSCWLLLRSLKTLSLRV

SEQ ID NO: 28101 - protein, 265 aa, Oenococcus oeni PSU-1
MSDTQIKKIIEDFGSATKRAIDCGFDGVEIHGANHYLIQQFFSKWSNKRNDFWGGSLEKRMNFAKAVTDKVFKTAKKYAPKDFIIGYRIPPEEIHDTVGYTWHESTQLIKTLTSEFDFDYIHLSLPEYNSKPNDSDKSFAELFQPALGDAIKEIIVGNIMNESDAEDAIRYADLVAVGRATLIDPQFGLKIQEGRGNEIIEKISPEQVKKSHLTPGLINIFSDPKMEPHLSGRESIYDLHQKGTLDESVIKNGTGASYNLDNFKK

SEQ ID NO: 28102 - protein, 485 aa, Oenococcus oeni PSU-1
MTNGQLLEAVDQAVKTFNKAGLKVGDLLLLALPNSTAYVISYLAAMRTGLAIYSMNPKMPEKQAKNEFRKRNYKAAILDDDYQELFNQIVKNPKIKTLSNYGDYSIKLTSWETIKANNDVNDFDEIPKHSGIVIYTSGTTGKPKGVLLDHSQMYTAGDNVVQSHKLTENDRVYIVLPFYHINAQNIALMSALISGGSIVVQKHFSAHKFWPVVENQEVTWVSAAPAIILILLNTEINPNNLQKLRFIRSTSAPLAIAAMDQFEERFKVPILNSYGMTEAPSQIAVDPMPPLHSPAGSSGKPFNIAIKISDKKLTKELSIGEDGEIWIKGTNTITSYLHNRDQESFVNGWFRTGDVGHLDKDGFIFLAGRSKEMINKSGDKISPYEVEDIIDKLPFVDSAAVIGYPDKIYGETVAAVIILKDSTDKKTALIDFAKQIRKIVSLQEEKFKVPQYIFFMKDIPRGATGKIQRTALKNKIIENKEIDKY

SEQ ID NO: 28103 - protein, 404 aa, Oenococcus oeni PSU-1
MTKLTVKDLDLKGKKVLMRVDFNVPIKDGVIGNDNRVVAALPTIKYVLEQGGKAILFSHLGRIKKAEDKPGLSLAPVAKHLSDLLNQEVVFPGKTEGKELEDAIDKLKDGQVLMVENTRYEDVDANGEYVKRESGNDPELGKYWADLGDDLFVNDAFGTAHRSHASNVGIASNVSKTAAGFLMEKEIKYLDEAVNNPKRPFVAVLGGAKVSDKIEVIKNLLSKADKVIVGGGMSYTFSNAKGVKIGNSLFEADKVSLAKEIMKEAGDKLVLPEDSVAAESFANDVPTKVFENGIPDGWMGLDIGPKTIEKFKNTLKGAKTVVWNGPMGVFEMSNFANGTLELGKFIGSLTSEGAATIVGGGDSTAAVSQLGIADQFTHISTGGGASLEYLEGKTLPGIAAISDK

SEQ ID NO: 28104 - protein, 323 aa, Oenococcus oeni PSU-1
MEVFDYENVQLIPNKCLISSRSEADTSVEFGGHRFKLPVVPANMASVIDDKLAIWLAENGYFYIMHRFEPGKRFNFVTDMKQRGLISSISVGVKEEEYRLIDELVDAGLTPDYITIDIAHGYANTVIDMIHYIKKHLPKAFVVAGNIATPDAVRELEDAGADATKVGIGPGRACITKLKTGFGTAGWQLAAVRLCAKAARKPIIADGGIRHNGDIAKSVRFGASMVMIGSLFAGHKQSPGSDLVIDHRHYKQYYGSASAKQKGVYKNVEGKDLLVPYRGDIANTLNEMAQDLQSSISYAGGNNLQALRTVNYVIVQNTIMNGD

SEQ ID NO: 28105 - protein, 240 aa, Oenococcus oeni PSU-1
MRKPIIIANWKMNFLRDQANLYVKKLIKKLGNKENIEVGIASQDLFLTDLIKLTENTPISIVAQNAYWENFGPFTGETSPKALANVGVDYVMLGHFERRELFNETNSTVNLKVRTALNNGMDVIVDVEELEQVAPVLEGVSEEQMQQIIIGFEPTFAIGTGMSASTKGAEDVAEQIRKTVRKLYGSDVADSTRILYGGSVNRDNLKSLIKQKDIDGVLVGKAALDFQSFWELVEIIENSL

SEQ ID NO: 28106 - protein, 464 aa, Oenococcus oeni PSU-1
MKQAIETIPANKKLKYIKKIAILATFGAFLFGYDTGVINGSLSFMARGDELNLSPFMEGLVTSSLLFGAAIGAVIWGRLADRYGRKSILRVLAIIFFFSTLGSSIAPNSYVLIIGRLFMGLAVGGVAGIVPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 28107 - protein, 458 aa, Oenococcus oeni PSU-1
MKAHHLNIFFIFVFGALGGLLFGFDTGIISGASSLIESDFSLNIEQTGFITSSVLIGSSIGALSVGSLSDKFGRKKLLILASVLFLIGSGLSMSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 28108 - protein, 325 aa, Oenococcus oeni PSU-1
MYAVFEDEVPYIEEFANRTGHEIVQETDYLSEKNVDLAAGFDAVVTQQTVNIPDMVYSRLAELGIRQISIRQVGYDILNIDAIDKAGLRASNVAAYSPRAIAEYTLTQLLNLIRDNKRYYQATESGNWLWSAAPQGKEIHDLTVAVIGAGRIGSALAEMLHVLGAKVLAVDPVYHAQNEAFLDYTNLDDALKRADVITFHTPLNKQTNGMADKDFFQKVKKNAYILNFARGGIIQTSALLENLRSGKLAGAALDVLPNETEFMGKIQNPDKLPADVQELMSRDNVLLSPHVAFYTNLAVKNMVEIALNDAIALSQGKHIENEILY

SEQ ID NO: 28109 - protein, 446 aa, Oenococcus oeni PSU-1
MKRELSNRHIQLISIGGTIGTGLFLGASRSIAFTGPSIMLVYLAAGIFMFLVTRAMGEMLYMDPDQHTFINFISKYLGKPFGFFSGWTYWLSIIFTGMGELTAVGIYFQFWFPKMPMWIIQLMFLAAIMSINLITVKFFGEAEFWFAMIKISAIVALILTSIFMLATDFKTPIGAVGLTNISKNFQLFPNGFKNFVMAFPMVFFAYQGIEFVGITTSETKNPRAVLPKAINQIIIRILIFYIGSLIAIMLIYPWQSLDPKQSPFVWIFKLLGISWAAGLINFVVLTAASSALNSILYSSGRHLYQLASDSSGKFNKNCAVISKNGVPARTICLSALAVAVSPIINSIPTIKDAFSVIASVSSGAYLLIYILTLFAHRKYTQSKDYLANGFLMPKPKFFGPLTIAFMVFILISMLFQKETCPGVVTALIWLVVFGGYSLAKYKNENS

SEQ ID NO: 28110 - protein, 439 aa, Schizosaccharomyces pombe [sequence omitted]

SEQ ID NO: 28111 - protein, 462 aa, Oenococcus oeni PSU-1
MEPKKSKFNNSFLKYSTYIISIGGFLFGYDTGVINGALAFMSKPDQLNLTPGLQGVVSSSLVLGAFFGALGCGRIADKFGRKQTLRWIAALFTSSTILCALSMNFLFMSFFRFALGLSVGAASSLSPMYLAEISPEPVRTINVNKNAIFIVLGQLSAFCMNAFLGNIWGNWNPIWRIMIVSASIPAIILWINSFHIVGSPHWLLLKKRFKKARKLFSKLGFEKSTFDGIEQESKTKSKKDDDISWKSILKKPSLVYLLISGILIALIQQISGVNTVMYYGTILMEKVGMGQSGSLYANILIGLVSFVASIFGTRLIARFDHHRMLLISLFGNILFLALLGLVLRLSLFTQTITNALVLIFLALFLASHQGIVSPVTWLIMSEMFPGKIKARFMSIATATTWITNFIISLIYPLLISAVGTAVVFFIFAASNGVSALLSIFVLNAKEIQRAYRKNDLMSQESN

SEQ ID NO: 28112 - protein, 241 aa, Oenococcus oeni PSU-1
MICYDHIEWFFDSAEARMVKILVVEDDENFNSLVSRYLASNGFEVISCADAQKAYDALYNNLFDLIVTDVMMPGIDGVEFAKTVRQLNENIPILFVTARDDIKTKKAGFRVGIDDYLVKPIDLDELKLRISAVLRRANISQNQKIEIGNLLLKSEEISASINGVPIPLTVREFNILFKMLSFAGRAFSRAELLDDFWDTESNASLRAVDVYITKLREKFKSTNAFEIKTIHGLGYKTVIRS

SEQ ID NO: 28113 - protein, 337 aa, Oenococcus oeni PSU-1
MNALVLDKMNHLELENLEKPTPKNNEVLIKVAYVGVCGTDKALYQGLPGSADAVPPIVLGHEDSGTVVEIGESVTNFEVGDRVAIDPNIYCHKCDFCRTNRPELCTNLSAVGVTRNGGLEEYVAVPEEVAYKLPDNVSFKQAALTEPLSCVVHGVDLLAIKPFQEAIVLGDGFTGQLFVKTLKAYGVSKVTISTRHLDDEKHVDFLKKVVGADEVVDARSNDFDKDYDVVVEAVGSADVQEQAVKAAAHGGQVLMFGVGKPEQKFSVSSYEIFQKQLTVQGSFINPYTFKAAIAMIAAGKIDPSELVSMELKAAKMNDYLSGKIRTNKAVLNIEAAF

SEQ ID NO: 28114 - protein, 214 aa, Oenococcus oeni PSU-1
MGGNMTTIYISSKQAHNFDDYTINKIGVPSSVLMERAALAVCQRLLESRNFNLKKVLVVAGIGNNGGDGIAVARMLYLKQVPVKIYLLGDREKISKDSRIQLKIAENYGVPFVSNIDDLSSYTTIVDAVFGVGLSRDVTGEIAGIVDFINNSPASVMAVDMPTGLNADNGNIMGTAVKAAETVTMSYNKLGLISETGRKFAGVVTVADIGIYEP

SEQ ID NO: 28115 - protein, 470 aa, Oenococcus oeni PSU-1
MWGGAVAANQLEGGWDQDNKGLSVADIMTAGANGKAREITDGIVKGKYYPNHEAIDFYHRYKEDIKLFAEMGFKCFRTSIAWTRIFPNGDEEQPNEAGLKFYDQLFDECHKYGIEPVITLSHFEMPYHLVKAYGGWRNRKLIDFFVRFAKTVFKRYKDKVSYWMTFNEIDNQTDYTNRFLMATNSGLILKNDQSDAESLMYQAAHYELVASALAVKLGHSINPNFQIGCMINMTPVYPASSKPADIFQAEKAMQRRYWFSDIHALGKYPENMEVFLKQNNFRPDITSEDRIVLKEGTVDYIGLSYYNSMTVQSKESNPGFHFIGPELTVDNPNVEKSDWGWPIDPLGLRYSLNWLADHYHKPLFIVENGLGAYDKVENSQQIHDPYRIAYLKAHIQAMIDAVQEDGVKVIGYTPWGCIDLVSAGTGQMSKRYGFIYVDKDDQGKGSLKRLKKDSFFWYQQVIQSNGSQLD

SEQ ID NO: 28116 - protein, 358 aa, Oenococcus oeni PSU-1
MFGAIFGGALAGQLADRLGRRKMILISAIIFAVFSVLSAIAPNNGSYYLIIMRIFLGLAVGAASALVPAYISELAPAAIRGRLSGLNQTMIVSGMLISYIVDYILKGLPNQIAWRLMLGFACIPAIILYLGVMKLPESPRYLIKNGRLDEARKVMSYVRSSEGEINNEINQIKETAHKEQEAQKTSWSALFSGKYRYLVIAGVGVAAFQQFQCANAIFYYIPLIVQKATGQAATSALMWPIIQGVILVIGSLVFMWIAEKFNRRTLLMFAGTIMGLSFILPAIIRWIDPHASQMMIVVFLCLYVAFYSATWAPLTWVLVGEIFPLAIRGRAAGLASSFNWIGSWAVGLLFPIMTASMS

SEQ ID NO: 28117 - protein, 331 aa, Oenococcus oeni PSU-1
MKIYAYGIRDDEKPSLKEWETAHPEVEVAFTQELLTPETAKNAAGADGVVVYQQLPYTRETLQALADQGIHQMSLRNVGIDNIDLKAAKELGFKISNVAAYSPNAIAEHAAIQLARILRRSKELDAKVAKRDLRWAPTIGREVRMQTVGVVGTGRIGRVLIQILQGFGAKIVAYDIFKNPDIDKQGLYVDSLNELYAKSDVISLHVPSVKENIHMINKDSIAKMKDGVVLVNVARGDLVDTDAVVAALDSGKVSGMVMDVYENEIGIFNEDWEGKKFPDARLDDLIDRPNVLVTPHTAFYTTKAVLEMVHQSFDAAVAIANGQETRNLVKF

SEQ ID NO: 28118 - protein, 156 aa, Haemophilus influenzae 86-028NP
VTEIGLGTQDSAGVAVINKQNELQRIRCLGKVKALDEAVSEKPLIGGTGIAHTRWATHGEPSETNAHPHSSGTFAVVHNGIIENHEELRELLKSRGYVFLSQTDTEVIAHLVEWEMRSTDSLLEAVQKSVKQLTGAYGMVVMDSRHPEHLVAARSG

SEQ ID NO: 28119 - protein, 274 aa, Haemophilus influenzae 86-028NP
MAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVA

SEQ ID NO: 28120 - protein, 316 aa, Haemophilus influenzae 86-028NP
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVKLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 28121 - protein, 395 aa, Haemophilus influenzae 86-028NP
MQQHNLSTTFVHAGRQKRFSQGSVNPVLQRASSLLFDSIEDKKHATQRRAKGELFYGRRGTLTHFALQDLMCEMEGGAGCYLYPCGTAAVTNSILSFVKTGDHVLMSGAAYEPTQYFCNIVLKKMQIDITYYDPLIGADIATLIQPNTKVLFLEAPSSITMEIPDIPTIVKAARKVNPNIVIMIDNTWSAGVLFKALEHDIDISIQAGTKYLVGHSDIMIGTAVANARTWDQLREHSYLMGQMVDADSAYTTARGIRTLGVRLKQHQESSIKVAKWLSEQPEVKTVYHPALPSCPGHEFFLRDFSGSSGLFSFELTQRLTSEQVSKFMDHFQLFAMAYSWGGFESLILCNQPEEIAHIRPNIKRNLTGSLIRVHIGFENVDELIADLKAGFERIA

SEQ ID NO: 28122 - protein, 103 aa, Haemophilus influenzae 86-028NP
ETPHCGGGAVRRGLIDAELAQLAVDNGWEGIIVYGAVRQIQQLENLDIGIHALAPIPVSADESSAGESDIPVNFGGVTFFPEDYIYADLTGIILSQEPLDLED

SEQ ID NO: 28123 - protein, 307 aa, Haemophilus influenzae 86-028NP
  misc_feature (302)..(302): Xaa can be any naturally occurring amino acid
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILXGRSIT

SEQ ID NO: 28124 - protein, 173 aa, Haemophilus influenzae 86-028NP
MAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTAQPMSNEGTESEFEN

SEQ ID NO: 28125 - protein, 268 aa, Haemophilus influenzae 86-028NP
MSRFETQFATLNAKNEGAFVPFVTLCDPTFDCSFEIICTLVDNGADALELGFPFSDPLLDGPVIQAANNRALTAGHSSEDSFKLLEKVRSKYPEIPISLLLCANLIFAKGLDAFYQRCAEVGVDAVLVADIPLLAKEDYVQAAKKHGIQPVFICPPNADEKTIQGVAKNSEGYTYLVSRAGVTSAENQAHAANLDTLVEQLKAHYAPPILQGFGIAQPAQVKEALALGAAGAISGSATVKIIERNLDNHEPCLAELAEFVQTMKAATK

SEQ ID NO: 28126 - protein, 101 aa, Haemophilus influenzae 86-028NP
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDGYRVD

SEQ ID NO: 28127 - protein, 373 aa, Haemophilus influenzae 86-028NP
MHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCVIEPLADLLKKKGSEIAALILEPVVQGAGGMYFYSPTYLVKAQALCKQYGVLLIFDEIATGFGRTGKLFAAEHAGISPDIMCIGKALTGGYLTLSASITTTEIAQIICSGEAKCFMHGPTFMANPLACAIAAESIRLLLESPWQQNIQRIEHSLKQQLSPLAEKDYVKEVRALGAIGVVEMKSAVNMKTLVPRFVEQGVWIRPFGKLVYVMPPFVIKDDELQKLTEGMILALIQEYEH

SEQ ID NO: 28128 - protein, 464 aa, Haemophilus influenzae 86-028NP
MNFRLLSQYHADIKKLIKISLPILLAQIAQNSMGLADTIMAGRVSSTDMAAISIGASIWMPLMLFGQGLLLALPPTISYLNGSGQRHRIAHQVRQGIWLVLGVSIPLGLLIYFCEIPLQYMQMESKMSDLARDYLHAMLWGLPAYLMLINFRCLNDGIAKTKPAMVITFLGLLINIPLNYIFIYGKFGIPAFGAVGCGIATAIVNWAMCLMMIFYSYTNAQERSLKVFSQLIEMPNLKTLKKLLRLGLPIAIAICCEVALFALTSLMLSPLGATIVASHQITLNTSSFIFMFPMSIGMAATILVGQALGTGSPQNAKKIGYAALLLGLTVTIITALITIFFRYEIASIFVTDEIVIAMAANLLLFAALYQFSDTIQMVVGGILRGYKDTKMILYITLFSYWVIGVPLGYTLGRTDWLIPHIDAKGFWIAFVVSLTFAAFLLSLRMKKMQAMSDNAILQRLEKLK

SEQ ID NO: 28129 - protein, 263 aa, Haemophilus influenzae 86-028NP
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 28130 - protein, 259 aa, Haemophilus influenzae 86-028NP
MKIVFLDSTAIPKHISIPRPSFEHTWTEYDHTSSAETIERAKDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKDLINTETLSKMKKGAFLINTGRGPLIDELALVDALKTGHLGGAALDVR

SEQ ID NO: 28131 - protein, 216 aa, Haemophilus influenzae 86-028NP
MNQNLIEVKNLTFKRGDRVIYDNLNLQVKKGKITAIMGPSGIGKTTLLKLIGGQLMPEQGEILFDGQDICRLSNRELYEVRKRMGMLFQSGALFTDISTFDNVAFPIREHTHLPESLIRQIVLMKLEAVGLRGAAALMPSELSGGMARRAALARAIALDPDLIMFDEPFTGQDPISMGVILSLIKRLNEALNLTSIVVSHDGRKYEYGVPSPIFGT

SEQ ID NO: 28132 - protein, 196 aa, Haemophilus influenzae 86-028NP
MIDFDGYRPNVGIVICNRKGQVLWAKRCGQNSWQFPQGGINDNESAEQAMYRELHEEVGLQPKDVRLLYVSKHWLRYKLPKRLLRYDSKPMCIGQKQRWFLLQLVGDEKNINMKTTKSPEFDGWRWVSFWYPVRQVVSFKRDVYRKVMKEFASVLFTDNPPIFSASREANSQSNSANKKYSQTKYTKRHFYKSKGQ

SEQ ID NO: 28133 - protein, 174 aa, Haemophilus influenzae 86-028NP
MFNPFQIFDLPVDFQLDEKVLNARYLKLQKALHPDNFVSSSALEQRVAMQKSTEVNDALKTLKDPILRAEAIIALNTGEQLDLEQKSTQDVAFLMQQLQWREQLEDVESQQDERALNVFAKEIKQETQSLLTALFESLKSQQWARASQYCDKLRFTHKLSEEIERVEERIFELD

SEQ ID NO: 28134 - protein, 363 aa, Haemophilus influenzae 86-028NP
VSNIGLGTQVCTNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 28135 - protein, 435 aa, Haemophilus influenzae 86-028NP
MFAVEPKYAATNNPLAEFKAMVKAFHNEGIEVILDVVFNHSAESEQTYPTFCQRGIDDQTYYWRNDQGRYINWTGCGNMLNLSSDVGRKWVVDCLRYWVEQCHIDGFRFDLASVLGRDTPDFNSSAQLFTDIKNEPSLQNIKLIAEPWDIGHYGYQVGNFPSYFAEWNDRFRDDLCRFWLWKSGEIGAFAERFAGSIDLFKKNDRLPHTTLNFITAHDGFTLKDLVSYNQKHNEANGEENHDGRNENYSYNHGVEGSTESLSEPQKSAVENNRTFAQSGLLMSLLLANGAPMLLAGDEFGNTQYGNNNAYCQDNEITWLKWANFNEELFELTKQTIALRKRMGSLNQDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 28136 - protein, 229 aa, Haemophilus influenzae 86-028NP
MFKIYNNGNPIPMGYSQAVENNVQITNFALFSAAAIGVELCLFDEQNQETRLPMVRTENVWHLAVTGVKTGTEYGFRIHGEFANPNKLMLDPYAKAVNGKPDLSSEESCSWFLLSDNRDNAHLAPRAVVISEDFNWENDTLPNTPWAETIVYELHVKGFSQFNEKIPAALRGTYTGLAHPVNLAYLKELGVTVVELLPVNFHINEPHLQARGLQNYWGYNPLSDVCGGT

SEQ ID NO: 28137 - protein, 488 aa, Haemophilus influenzae 86-028NP
MSLRIKQEALTFDDVLLVPAHSTVLPNTANLSTQLTKEIRLNIPMLSAAMDTVTETKLAISLAQEGGIGFIHKNMTIERQADRVRKVKKFESGIVSEPVTVLPNLTLAELAEMVKKNGFAGYPVVDEENNLIGIITGRDTRFVKDLSKTVSQVMTKKEDLVTVKEGASREEILELMHQHRVEKVLVVNDSFKLKGMITVKDFQKAEQKPNACKDEFGRLRVGAAVGAGPGNEERIDALLKAGVDVLLIDSSHGHSEGVLQRVRETRAKYPNLPIVAGNVATAEGAIALADAGASAVKVGIGPGSICTTRIVTGVGVPQITAIADAAAALKDRGIPVIADGGIRFSGDIAKAIAAGASCVMVGSMFAGTEEAPGEIELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 28138 - protein, 202 aa, Haemophilus influenzae 86-028NP
MAYPIKHCVLVNDKTDLSQIDTLYSHPQVIQQCSQFIHSLDRVHIEYCESSSHAMQLVASLNKPNIAALGNEDGGKLYGLSVLKTNIANQENNITRFIVVAKDPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 28139 - protein, 458 aa, Haemophilus influenzae 86-028NP
MAKAPKTAYVCNDCGAEFSRWQGQCSACKAWNTITEVRLISTAKSKNDRFSGYAGETQAKIQTLSEISLQETPRFSSGFNELDRVLGGGIVPGSAILIGGHPGAGKSTLLLQVMCGLAKNMTALYVTGEESLQQVAMRASRLGLPNDQLKMLSETSVEQICNLSDQLKPQIIVVDSIQVMHLADIQSSPGSVAQVRECASFLTRYAKTRQVAIIMVGHVTKDGTLAGPKVLEHAIDCSLLLEGEADSRYRTLRSHKNRFGAVNELGVFGMTEQGLREVKNPSAIFLSRGDEITSGSSVMVLWEGTRPLLVEIQALVDHSMLANPRRVAVGLEQNRLSLLLAVLHRHGGLQMADQDVFVNVVGGVKVSETSADLALLLALISSFRNRPLPQDLVIFGEVGLAGEIRPVPSGQERISEAAKHGFKRAIVPFGNKPKSAVENMQVFTVKKLTDALAVLDNL

SEQ ID NO: 28140 - protein, 454 aa, Haemophilus influenzae 86-028NP
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQAKDAIGAYPRDCELAAAIQKACFKNKLLLERGGRGGNVVRVLCAVNINQSECEEFIKRFKQSVVDALKVVRS

SEQ ID NO: 28141 - protein, 228 aa, Haemophilus influenzae 86-028NP
MNITKIDWQKVNGLLPVIIQNISTREVLMLGYMNEEALTKTIKERKVTFFSRTKQRLWTKGEISGNFLNVEEMSLDCDNDTLLILVDPIGATCHTGEYSCFHQFTSPQSENKKQQFANWAWFIKLEQHLKEKKNADPSNSYTATLHAKGTKKIAQKVGEEGVETALAAVAQDKAEVISEATDLVYHLTVLLHNQDLQWYEIIAKLQERHQGIGLHPEGGNNKKMVRQY

SEQ ID NO: 28142 - protein, 217 aa, Haemophilus influenzae 86-028NP
MTQKHLKLNNLNQHLHDGMSIMFGGFMGIGTPAKLVQQILDSGVKDLTLIGNDTAFIDTGVGPLIVNNRVKRLITSHIGTNPETGKKMIAGEIDVELVPQGTLAERIRAGGAGLGGILTPTGVGTVVEEGKQKIQIDGKEYLLELPLKADIAIIHAQKGDMNGNLAYELSARNFNPLVALAAKTVIAQVDNLLEVGQLPPDEVITPAALIDYIVCSE

SEQ ID NO: 28143 - protein, 221 aa, Haemophilus influenzae 86-028NP
MNAKELIARRIAMELHDGDIVNLGIGLPTQVVNYLPDNVNITLQSENGFLGLTAFDPENANSNLVNAGGQPCGIKKGGATFDSAFSFALIRGGHVDACVLGGLEVDQEANLANWMVPGKMVPGMGGAMDLVTGAKKVIIGMEHCAKSGSSKILKKCTLPLTASKKVAMVVTELAVFNFIEGRLVLKEHAPHVDLETIKAKTEADFIVADDFKEMQISQKGL

SEQ ID NO: 28144 - protein, 410 aa, Haemophilus influenzae 86-028NP
MTNKVSLDKSKIKFVLFEGVHQSALDTLHAAGYSNIDYYKKALDGDELKEAIKDAHFIGLRSRTHLTAEMIEAAPKLIAVGCFCIGTNQVDLNAAKARGIPVFNAPFSNTRSVAELVLGEILLLMRNVPQANAEVHRGVWNKSATGSYEVRGKKLGIIGYGHIGSQLSIIAESLGMDVYFYDIENKLPLGNAKQVRSLEELLSSCDVVSLHVPELPSTKNLMNATRIAQLKQGAILINAARGTVVDIDALAQALKDGKLQGAAIDVFPVEPASINEEFVSPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 28145 - protein, 285 aa, Haemophilus influenzae 86-028NP
PLASEFRYRKFVTRPNSLLITLSQSGETADTLAALRLAKEKGYMAALTICNVAGSSLVRESYLAFMTRAGVEVGVASTKAFTTQLAALLMLVTALGKVKGHISVEKEREIIKAMQSLPAEIEKALAFDREIEALAEDFAEKHHALFLGRGAFYPIAVEASLKLKEISYIHAEAYAAGELKHGPLALIDADMPVIVVAPNNELLEKVKSNIEEVRARGGQLYVFADKEAGFTPSEGMKIITMPKVNDIVAPIFYTIPMQLLSYYVALIKGTDVDQPRNLAKSVTVE

SEQ ID NO: 28146 - protein, 263 aa, Haemophilus influenzae 86-028NP
MSVIKMTDLDLAGKRVFIRADLNVPVKDGKVTSDARIRATIPTLKLALEKGAKVMVTSHLGRPTEGEFTPEDSLQPVVDYLKNAGFNVRLEQDYLNGVDVKDGEIVVLENVRINKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGFRVL

SEQ ID NO: 28147 - protein, 264 aa, Haemophilus influenzae 86-028NP
MDKSLKANCIGEFLGTALLIFFGVGCVAALKVAGASFGLWEISIMWGMGVALAVYATAGLSGAHLNPAVTIALWKFACFDGKKVIPYIISQMLGAFFAAALVYALYRNVFIDYETVHNIVRGTQESLSLAGTFSTYPHPSLSIGGAFAVEFVITAILMALIMALTDDGNGVPRGPLAPLLIGILIAVIGGAMGPLTGFAMNPARDFGPKFFAYLAGWGELALTGGRKIPYFIVPMVAPVLGALAGAWLYKKAIGGNLPCNCGCE

SEQ ID NO: 28148 - protein, 467 aa, Haemophilus influenzae 86-028NP
MSNFNQISRRDFVKASSAGAALAVSNLTLPFNVMAKETQHLNENSQERIVWSACTVNCGSRCPLRMHVKDNRITYVETDNTGTETYNLDHQVRACLRGRSMRRRVYNPDRLKYPMKRIGKRGEGKFKRISWDEALTEIADALKRNIKKYGNESIYLNYGTGTLGGTMAKSWPPASTMIARFMNCIGGYLNHYGDYSTAQIAVGLDYTYGGGWALGNGMADIENTKLIVLFGNNPAETRMSGGGLTYCIEQAKARSNAKMIIIDPRYNDTGAGREDEWIPIRPGTDAALVSALAYVMIQENLVDQPFLDKYCVGYDEKTLPADAPKNGHYKAYILGYGNDGIAKTPEWAAKITGIPAERIIKLAREIGSTKPAFISQGWGPQRRSNGELISRAIAMLPILTGNVGIHGGNTGARESAYSIPFVRMPTLKNPVKASIPMFLWTDAIIRGTEMTALTDGIRGVDKLSSPN

SEQ ID NO: 28149 - protein, 392 aa, Haemophilus influenzae 86-028NP
MSVKGDIGVIGLAVMGQNLILNMNDHGFKVVAYNRTTSKVDEFLQGAAKGTNIIGAYSLEDLASKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLCFLRFR

SEQ ID NO: 28150 - protein, 241 aa, Haemophilus influenzae 86-028NP
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 28151 - protein, 224 aa, Haemophilus influenzae 86-028NP
MKPYLIAPSILSADLARLGDDVQNVLNAGADVIHFDVMDNHYVPNLTFGPAVCQALRDYGITAPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 28152 - protein, 169 aa, Haemophilus influenzae 86-028NP
MVTLHTNFGDIKIKLDFDKAPVTAENFLNYCKEGFYNNTIFHRVIDGFMIQGGGMESGMHEKATKAPIQNEANNRLSNKRGTIAMARTSDPHSATAQFFINVADNDFLNYRSKEMFGREVVQEWGYAVFGEVVEGMDVVDKIKKVKTGNKGFHQDVPTEDVVITLVSIE

SEQ ID NO: 28153 - protein, 335 aa, Haemophilus influenzae 86-028NP
MEQTMKIAIYSTKSYDRKYIELINAKYNFDLEFFDFMLNESTVRLAEHCEVVCIFVNDNGSRKVLEKLAALGVKIVALRCAGFNNVDLKAAQELGIQVVRVPAYSPEAVAEHTIGLMMTLNRRIHRAYQRTREANFSLEGLIGFNMYGRTVGVIGTGKIGIAVMRILKGFGMNILAYDPFKNPLVEELGGQYVELDELYAKSHVITLHCPATPENYHLLNREAFAKMKDGVMIVNTSRGSLIDTQAAIDALKQRKIGALGMDVYENERDLFFEDKSNEVIQDDIFRRLSSCHNVLLTGHQAFLTEEALTNIADVTLSNVYKLKSGKVCENIVLPS

SEQ ID NO: 28154 - protein, 369 aa, Haemophilus influenzae 86-028NP
MTQQYAIDTLLAQAGNRSDERTGAVSAPIFLSTAYGHCGIGESTGFDYTRTKNPTRTVLEETIAKLENGDRGFAFSSGMAAIQVLMTLFTAPDEWIVSSDVYGGTYRLLDFSYKNNNSVKPVYVNTASASAIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKAQPQVESVLYPNKGGMLSFRLQDEAWVNTFLKSIKLITFAESLGGTESFITYPATQTHMDIPEPERVARGITNTLLRFSVGIEDVEDIKADLLQAFANLK

SEQ ID NO: 28155 - protein, 480 aa, Pediococcus pentosaceus ATCC 25745
MKMTKLPENFLWGGAVAAHQLEGAWQADGKGVSMADVMTAGANKVPRKITDGVVPGENYPNHEGIDFYHHYREDVKMFAELGLKAFRTSIAWTRIFPNGDDAEPNEAGLKFYDDLFDECLKYGIEPVITLAHFEMPYHLVKKYNGFSDRHVIDLYVRFAETCFKRYKDKVKYWMTFNEINNQSMYNNDFLMATNSGLVFKGDENREAAMYQAAHYELVASAKAVKLGHEINPDFQIGCMINFTPFYPLNAAPNNIMLAERLMQRRYWFSDVHVNGVYPENVETYLQQKGYRPDITEADREILKAGTVDYVGFSYYNSNTVALPEGRSIDENLAPEDVTVENPYLATSDWDWPIDPVGLRYSLNWLNDRYHLPMFIVENGLGAYDTVESDGAIHDPYRVDYLRAHIQEMEKAVELDGVNLMGYTPWGFIDLVSAGTGQMSKRYGFIYVDKDDDGNGTLQRSKKDSFGWYQKVIRTNGEDLD

SEQ ID NO: 28156 - protein, 452 aa, Pediococcus pentosaceus ATCC 25745
MIKAKNVYIGFGKAAKTLAFRQAQRGESVVVIEESDQMYGGTCINIACIPSKLLYELSDKPQVGGLKDNYKMAITKKRSVIGKLRYSNFHKLADQKTVKVLNGSASFIDQHTLNVKYLNGATEEVVGERIFINTGATSTIPDIPGLKESSRTVTSTDLLDQDHFPQSLAIIGGGYIGMEFATTYSQFGSKVTMINRNAEFMRGMDQDVSQAVKQNFDKAGIEVLQSAEVIRVQDQGSHAVLTVASDGSESQIMVDMILVATGRKPNIQGLNLEQAGIRYTEAGVAVDDHLRTNVQNIWAMGDVRGGAQFTFLSLDDYRIVYNQLYASGTKTTEEQVIVPKTIFLMPPLSQIGMSEREALDKKIEYRTGKVAVAGMPKAHILGHPNGFYKVLIDKEDHILGATIYAPEAHEIINIISLAMHANLPYQMLRDQIYSHPTMAEGLNDLFETIGMN

SEQ ID NO: 28157 - protein, 446 aa, Pediococcus pentosaceus ATCC 25745
MAKKNYSQADIRQMAKDENVRFLRLMFTDLFGIIKNVEVPISQLDKLLDNKLMFDGSSIDGFVRIEESDMYLYPDLSTWMVFPWGSEHGKVARIICEVYSNDRKPFVGDPRNNLIRVLQEMKDAGFTDFNIGPEPEFFLLKLDENGKPTTNLNDKGSYFDLAPVDLGENCRRDIVLELENMGFDVEASHHEVAPGQHEIDFKYADALTAADNIQTFKLVVKTVARKYNLHATFMPKPMDGINGSGMHLNMSLFNKEGNAFYDEKGDLQLSQNAYWFLGGLLKHARSYTAVCNPIVNSYKRLVPGYEAPVYVAWSGSNRSPLIRVPSSKGLSTRFEVRSVDPAANPYLAIASVLEAGLDGIRNKIEPEDSVDRNIYRMNIQERNEEHITDLPSTLHNALKEFQNDDVMRKALGDHIFQSFLEAKKLEWASYRQEVTQWERDQYLEMF

SEQ ID NO: 28158 - protein, 381 aa, Pediococcus pentosaceus ATCC 25745
MMSNWDNKFTKQGLTFDDVLLIPGESHVLPNEADVSTQLADNIKLNIPIISAGMDTVTESAMGISMARQGGLGVIHKNMSAEQQASEVSIVKNADVNLEDNPHAAVDDQGRLLVAAAVGVTSDTFERAQGLIDAGADAIVIDTAHGHSAGVLRKVAEIREHFPKQTLIAGNVATADGTRALFDAGVDVVKVGIGPGSICTTRVVAGVGVPQITAIYDAANVAREYGKKIIADGGIKFSGDIVKALVAGGDAVMLGSMLSGTDETPGSIIEDNGKKYKAYRGMGSVGAMEKGSADRYFQGGVNEANKLVPEGIEARVQYKGSVATIIFQMLGGLRSGMGYVGAATIAELAEKAQFVQITNAGLVESHPHDVQMTKIAPNYHK

SEQ ID NO: 28159 - protein, 229 aa, Pediococcus pentosaceus ATCC 25745
MAKLVLIRHGQSQWNLSNQFTGWVDVDLSDEGVKQAQNAGKLIKEAGIEFDQAYTSVLTRAIKTLHYALEGSDQLWIPETKTWRLNERHYGALQGQNKAEAAEKWGDDQVHTWRRSYDVLPPLLDADDEGSAANDRRYANLDPRIIPGGENLKVTLERVIPFWEDEIAPKLIDGKNVIIAAHGNSLRALSKYIENISDEDIINLEMATGEPVVYDFNEKLEVQSKTKLN

SEQ ID NO: 28160 - protein, 440 aa, Pediococcus pentosaceus ATCC 25745
MSLITDIYAREVLDSRGNPTVEVEVYTEDGGFGRGIVPSGASTGEHEAVELRDGDKNRFSGKGVEKAVANVNGPISKEIVGFEVTDQIAIDKAMIKLDGTPNKGKLGANAILGVSLAVARAAADELQVPLYNYIGGSNAHVLPTPMMNVINGGAHSENKVDFQEFMIMPVGAPSVKEAIRMGSETFHALKSLLSADGKATSVGDEGGFAPDFANNEEPLQYLIKAIEKAGYKPGKDVAIAVDVAASELWNDEDKKYKLRWSTGEEFTTEEFVKYLEGLVNKYPIISIEDPIDENNWDDWASITKELGKKVQLVGDDFFVTNTEYLAKGIKMGAANAILIKVNQIGTLTETMESIEMAKEAGYTAIVSHRSGETEDTTIADLVVATNAGQIKTGSMSRTDRIAKYNQLMRIEDQLEGVAEYKGINSFYNLSADAREEISNK

SEQ ID NO: 28161 - protein, 251 aa, Pediococcus pentosaceus ATCC 25745
MRTPIIAGNWKMNKNPQETQEFLDAIKGKLPDASVVESVIAAPAIDLSTLVAFSKDEQLKTAAENSYFEDEGAFTGETSPKALNEMGVNYVVIGHSERRQYFGETDEDINKKAKAIFNNNMTPIICCGETLEQREAGETNEWVAGQITNALKDLTAEQVAASVIAYEPIWAIGTGKTASSDQAQEVCHVIRETVAKLYDQTVADKVRIQYGGSVKPANIAELMGKEDIDGGLVGGASLDPESFLELVNYKG

SEQ ID NO: 28162 - protein, 400 aa, Pediococcus pentosaceus ATCC 25745
MAKLTVSDLDVKNKKVLMRVDFNVPVKNGVIGDDNRVVAALPTIKYIIENGGKAILFSHLGRIKTEEDKKELTLRPVAQRLSDLLGKPVTFVPVTRGAQLEDAVNGMNDGDVLLFENTRFEDLDGKKESKNDPELGKYWASLGDMFVNDAFGTAHRAHASNVGVAEAMKADGKQVAAGFLMEKEIKFLGEAVDEPKHPFVAILGGAKVSDKIGVIDHLLNKADKVIIGGGMTYTFYAAKGMSIGNSLVEADKIDVAKEILAKGGDKIVLPSDSIVAEKFDNDVPNKVVEGDIPDGYMALDIGPKSVAEFKDVLKDAKTVVWNGPMGVFEMSNYANGTLEVGKFLGTLSDATTIVGGGDSTAAVKQLGVGDQLTHISTGGGASLEYLEGKELPGIAAISNK

SEQ ID NO: 28163 - protein, 458 aa, Pediococcus pentosaceus ATCC 25745
MKEDLPQLKRSLTSNQMQMIALGGTIGVGLFMGSSSTIKWTGPSVLLAYGFAGLILYLVMRALGEILYVNPSTGSFADYATNYIHPLAGYLTMWSNIFQFIVVGISEVVAVSQYLNYWWPNLPGWVSSVVVIATLTLANLVSTKAYGAIEFYFALIKVLTIILMIIIGVLVIFMGLGNHWRPVGLSNLWAHGGFFTGGVKGFLFALSIVVGSYQGIELLGITAGEAANPKKAIVASVKSIVWRILIFYLGAIFVIVAIFPWNQLATVGSPFVETFSKVGITGAAGIINFVVLTAAMSGTNSGIYSASRMLYKLSQEGKVPKIFGKLSSHRVPSVAILTISFGILLGIILNIFLSSFKGGAVNLFVLIYSSSVLPGMVPWFVILLSELRFRRANPEIIQNHPFVMPLYPMSNYLAIISLLLIVVFMFINPDTRASVTVGFVFLMVLTINFIIKFRRKRG

SEQ ID NO: 28164 - protein, 331 aa, Pediococcus pentosaceus ATCC 25745
MKIIAYGIRDDEKPYLEEWVKDNKIEVKAVSELLDSNTIEQAKGYDGVVAYQQKPYTDDLFDKMNEFGIHAFSLRNVGVDNVPVEALKRNNIKITNVPAYSPMAIAELSVTQLLALIRRIPEFDAKMARGDFRWEPDIALELNQMTVGVIGTGRIGRAAINIFKGFGAKVIAYDVFRNSELEKEGIYVDSLEELYRQVDVITLHVPALKDNYHMLNDEAFAQMHDGVFVLNFARGSLIDTKALLKALDSGKVAGAALDTYEDEVGIFDVDHQNDPINDPVFNDLYSRRNVKITPHAAFYTKPAVKNMVQIALENNKALIEKGAARNEVKFD

SEQ ID NO: 28165 - protein, 215 aa, Pediococcus pentosaceus ATCC 25745
MIKVAPSILSADPANLMGDINKVEGADYLHVDVMDGSFVPNLSFGLNTVQGLSKDTDIKLDVHLMIQNPENYVEQFVKAGASIVGVHVESTQHIARAIQIIKNAGARAEVVVNPGTPLTELEELLPEIDQVLIMSVNPGFGGQKFLESSISKVKRLSALRQARGLEFDIEIDGGISDKNIKAVYDAGVDVAVAGSYVFGAEDYTKQVQLLKELTK

SEQ ID NO: 28166 - protein, 484 aa, Pediococcus pentosaceus ATCC 25745
MKNQYAYFPKDFLWGGAQAASQADGAYLENGKGLNSSDVQPFLKGLSNEEIQEMESEGMTLEKVRENINDKSHYYPKRYGIDFYHTYESDIDLLSEMGFKTFRTSLDWSRIFPNGDDEEPNVEALEHYSKMIDYMVKKGIEPIITMNHYETPINITLKYGGWPNKKVIPMFEKFGKILLDWFGEKVKYWIVVNQINMVQVEPWLSVGVAIDQYENLDEALYQSTHNQMVAAAWIKKYAKSLNIPNLNIGTMVADGTVFPATGKPSDVVLAMQQNRMQYMFTDVQFRGAYPKFARNYFEEHEVHLDITLQEMELIKNNPMDFLGISYYYSKMVDATKNRYEANDTLPNPYLKTSPWGWAIDPEGFYNTLSQYADRYGKPIIIAENGIGMYDELTEDKKVHDEYRTEYLSQHIEQLGRAIHDGANVIAYCAWGPIDIVSCSSQQMSKRYGFVYVDLDDEGNGSGVRYKKDSFYWYQKVISTNGDEI

SEQ ID NO: 28167 - protein, 339 aa, Pediococcus pentosaceus ATCC 25745
MTKYTKFMHFEGTKMKVFDYEDIQLIPAKCIVRSRTECDPTVVLGEHRFKLPVVPANMQTIINEEIAEKLAEDGYFYIMHRFEPERRMDFVKKMKDKGLISSISVGVKDDEYALIDQLAEENLTPDYITIDVAHGHAQSVIDMIHYIKEKLPAAFVIAGNVGTQEGVRELENAGADATKVGIGPGKVCITKIKTGFGTGGWQLSALRWCAKVARKPLIADGGIRTHGDIAKSIRFGATMVMIGSLFAGHIESPGETKVEDGVKYKEYFGSASQYQKGEAKNVEGKKIWIHQRGHLRDTLQAMREDLQSSISYAGGRDLEAIRKVDYVIVKNSIFNGDVL

SEQ ID NO: 28168 - protein, 446 aa, Pediococcus pentosaceus ATCC 25745
MKIAIVGCTHAGTFSAQQILTEHPDYEVTVYERNNNLSFLSCGIALWVGNHVSDPNKMFYSSPEALTKLGATMNMEHDVLSIDPDNKTLEVKDLKTGEIKTDTYDKLVVTTGSAPIIPPIDGIDNKRVKLCKNWAHAAELKRIDDDINSVIVIGAGYIGAELAEQYALTGREVTLIDGLPSVLAKNFDPEISDRVAKDYTDHGVKLAMNEMVQGFSGDDQITVKTDKGSYTADYAVLCVGFRPHTELLKGKVDMLKNGAIITNEYMQTSNLDIFAAGDSSVVHYNPTGKDDYIPLATNAVRQGILIGHNIEKPTMKYLGTQASSAVALFGKTMASSGLTVGAAKARGVEVDSVTLEQDYRPEFMLSTTPILMRLVWDPETRVVLGGSFYSEYDCAQSANVISLAIQNKMTIDDLSMVDMFFQPNYDQPLNYINALAMTAVAQADAK

SEQ ID NO: 28169 - protein, 481 aa, Pediococcus pentosaceus ATCC 25745
MTEKHYKMPENFLWGGAVAAHQFEGGWQEGGKGVSIADVMTAGNKDTARKVTDGIKDGEVYPNHWGIDFYHRYPEDIKLFNEMGFKCFRTSIAWTRIFPNGDETEPNEAGLKFYDDMFDELLKYNIQPIITLSHFEMPYHLVKEYGGWTNRKLIDFFVRFAETVMKRYKGKVKYWMTFNEINNQTDWSNPHHLLQDSAIKVKAGTPGMEEMMYQAAHNEMVASAKVVELGHQIDSEYQIGAMIAMCPIYPLTAKPEDIMMAERAMQTRYYFGDVQANGEYPNWLPKYWERQNIHVEISDYDREILKKGAVDYIGFSYYMSFTTKSTDENTDYAYKEARDLVDNPYVQKSDWGWQIDPVGLRYSMNWMQDRWHKPQFIVENGFGAYDQKEADGAVHDDYRIKYFHDHILEMEKAVALDGVNLIGYTPWGCIDLISASTGEMAKRYGFIYVDQDDQGNGSLERSKKDSFDWYKQVIASNGEDL

SEQ ID NO: 28170 - protein, 397 aa, Pediococcus pentosaceus ATCC 25745
MMILNGISNYKKLLAASGVAWLFDAMDVGILSFVIAALTSEWHLTESQVGMIGSISSLGMAVGAILFGALADRYNRKTILIISLLIFSIFNGISAFTTTYAAFVMIRFIVGCGLGGELPVASTLISESAPAHVRGRAVVLLESFWAGGWLISALISYFIIPSWGWRIAVFITSLAALYALVLRFSIREADSNHSFTPKARLALRLKNIWSRPYAKATLMLWIVWFMVVFSYYGMFLWLPSVMVMKGYSIVHSFGYVLIMTVAQLPGYFMAAWLIERWGRKWTLMVFLFGTAVSAIAFGFAQGLMMLLLAGILLSFFNLGAWGALYAYSPEQYPEEIRGTGSGLAAGIGRIGGIVGPLLVGFLTEKGVALSTTFIIFFISIMIAVIAIGFLGKETMEK

SEQ ID NO: 28171 - protein, 511 aa, Pediococcus pentosaceus ATCC 25745
MKTALLSVSDKTGIVEFARGLVKADFRIISTGGTKKVLEEAGLSIVSVEAITNFPEMLDGRVKTLHPAIHGGLLARRDLPEHLAALKEHNIDLIDLVCVNLYPFKSTIMQNGVTEAEAIEQIDIGGPSMLRSAAKNFASVLPVVDPKDYQPVLAALAHQTDNVKFRRALALKVFQHTAAYDTLIAQYLGQNGEIFPDELTKTYTKKQVMRYGENSHQKAAFYEDALPVPFSIAQAQQLHGKELSYNNIKDADAALKMSAEFNQPAVVAVKHMNPCGIGLGQNIEEAWDRAYEADSMSIFGGIIVLNRPVDLATAEKMHKLFLEIIIAPSFEKEAFTVLAQKKNLRIMTVDFNQHQDAKELETVSVMGGLLVQEQDAVVETATDFKVVSKRQPTESELKAMVFGQTVVKHVKSNAIVITTDQQTLGIGAGQMNRIGSVEIAVKQAEGSANFKNAVMASDAFFPMEDCVEYAAKHGIKAIVEPGGSIKDQASIDKADELGISLIFSGRRHFRH

SEQ ID NO: 28172 - protein, 311 aa, Pediococcus pentosaceus ATCC 25745
MKAIAISAYGDVDQLHEEELDIPQIANDEVLVKIKATSINPIDWKARMGFLKQMYDWQFPVVLGWDLSGIITQVGKDVKHFKVGDEVFARPDIYEDGTKGTYAEYAAVKEDKLALKPSNVSFEAAAAIPLAGLTAWQVIVDRLKIKKGDKVLIQAGAGGVGIFAIQIAKHLGAYVATTASAKNAEFLTNLGADEVIDYHEHQIGEVLNQYDAVFDTVDDLEAGLAILKPTGKLVTIAGRPTQAQQDAQPSATSWWLQPNGKQLAELGDLVAEGEVKVIIDSTFPLTEDGLRAAHERSQTNHARGKIVINVE

SEQ ID NO: 28173 - protein, 444 aa, Pediococcus pentosaceus ATCC 25745
MKKYDVVIIGAGPGGLGLAYPLKEAGLEVAVVEENLWGGTCPNRGCDPKKVLLAAIEAKKQNQYLLGNGIKNETQIDWPALMQFEKTFTDPVSRSSRSGLTDAQIDVYDGHAEFIDHHTLKIDQTTITSEKFVIATGQRPSRLTNIENQEMMQTSTDFLKMDHLPNELALVGGGYIAFELAMIASGAGAKVHIIHHNQRPLKAFPKAYVDDLVDQLKTQGVEVHLGIDLKRVEPKDERFELSDGQGFKQIVDQVFVTAGRKPNDDSLNLEKIGVQTDRGGIVVNEYLETSVDNIYAMGDVVSKALPKLTPVSGFEARYLAKKLTNATQAAIDYPAIPTVVYGMPKLAKVGVELDEAQQHPEQYEIKTAEMTEWFTYRRLQDPFAKISVIHEKSSGKIVGAITMSSEAEHLINDLTMIINQGGLVDQINNQILAYPTEASDLGYM

SEQ ID NO: 28174 - protein, 453 aa, Pediococcus pentosaceus ATCC 25745
MTEKIIVVGCTHAGIAAVNEILKYHPQADVTVFERHDTISYLSCATYLTLGKTISNLDEAMYADPDYYRAQGIDMRLRHDVIDINVEEHTVFAQDLETKEFTTESFDKLIMATGSLTSIPTIQGVENPKVKLCKTYEEARDLCDEAQNDERIAIIGGGYIGVELAEGYNKSNHEVILFHKKETPLDRHIEPEIADKITNLLEDKGIQVKTGTIVKSFEDGANDTLIVKTADEAFEVDMAVICTGLLPQADLLQGKVDQLTNGAIVVNDYMETSNPDIFAAGDAASVKHNGLQTDVYMPLASQAVRQGALAGINVLDKRLRSIGTQSTTGMLIFGRTLACSGVTLAMALDAGINATKVAYKGSYRPDFMPNAHKVEIELVYDRNSRKVLGVQLWSKHDVSQAADTISALMHYHGTIDELSFIDMLFSPNFDQPFNYLNLVGQLAVKQENGYLRT

SEQ ID NO: 28175 - protein, 437 aa, Pediococcus pentosaceus ATCC 25745
MILKQIAKYFQFDKLKTNYKTEIIAGITTYISMVYIMFVNPNVLGASGMDKGAVFTATALASAIGCFLMGIIANYPIASAPALGINAFFAYSVVIGMHVPWQTALAGVFVASLIFVLITVFKLRELIINAIPVDLKHAISSGIGLFVAFLGLSQGGIVVANKSTMVGLGSFLVPSTWLTVFGLVVTIFLMVRKVPGAIFVGMILTTVFGLLTGLIHAPAHIVSAAPSLKPTFLTAISHVGDINTLQLWVVVLTFLLVTFFDTAGTLVGLATQAGFMKDNKMPRVGKALMSDSASMLTGSLLGTSPVGAFVESSAGIAVGGRSGFTVVVTGIMFLLGLFFSPLLTVVTSQVTAPALVIVGVLMAQQTREIAWDKLEIAIPAFLIIIGMPLTYSISDGIALGFITYPIAMIAAKRGKEVHPLMYALFFVFIGFIAILNA

SEQ ID NO: 28176 - protein, 137 aa, Pediococcus pentosaceus ATCC 25745
MSEEFNYQAINGIALAYLGDAEYEVFIRRHLIKQGLTRPNRLHHVATRYVSAKAQAALINAMEAENFLTEKEIEAFKKGRNAKSHTSAKNTSVLTYRISTGFEAIVGYLSLTNQTERLAEFAQWCIEKVEEGNLRIE

SEQ ID NO: 28177 - protein, 456 aa, Pediococcus pentosaceus ATCC 25745
MAKVKTQFLCSECGYVSPKFLGRCPNCGRWNTLVEERISEPKNERKSRVSFEGKSSKPQLISEVKMHEEPRVKTGMEELNRVLGGGVVDGSLVLIGGDPGIGKSTLLLQLSGQLAATDRDVLYVSGEESASQIKMRAERLQVNSERFYLYPETDMSNIRAVIEELHPQYVIIDSVQTMQEPDIDSAVGSVSQIREITAELMQIAKTNNITIFIVGHVTKGGAIAGPKILEHMVDTVLYFEGDLHHTYRILRAVKNRFGSTNELGIFEMREEGLREVANPSEIFLEERLQDANGSAIVVSMEGTRPILVEIQALITPTIFGNAQRTASGLDRNRVSLIMAVLEKRANLTLQNQDAYLKAAGGVKLDEPAIDLAIAMSIVSSFKNQGTRPTDSFVGEIGLTGEIRRVNRIEQRVAEAQKLGFQRILIPKNNLKGWNPPKGIEVVGVTTITDAIRKAFN

SEQ ID NO: 28178 - protein, 248 aa, Pediococcus pentosaceus ATCC 25745
MNNNEVELNDKIELILSRERKELAKLVLIRHGESTANRDNIYTGWSDVPLTPLGIKQAQRAGKLIAKLGINFDMVHTSMLKRAIVTANIVLDDLNQNWLPINKTWRLNERHYGALRGQNKDETRQIYGKEQVALWRRSFDAVPPLLEHPDDDRRYAVNGILNEPLGESLHMAYNRLLPYWIDQIAPRLMEGQNQLVVAHGSSLRALIKYLENISDQGIDGVEVENGEPIIYELKSDLSIQNKIILKEA

SEQ ID NO: 28179 - protein, 487 aa, Pediococcus pentosaceus ATCC 25745
MVKEFPDDTLTLHTDAYQINMIQTYWNKGIHNKTAIFEVFFRNMPFDNGYAVFAGLDRIIDYISNLHFSESDIEYLKDVAGYPDDFLAYLKDFHFRGTIRSAVEGDLVFNNEPILQVEGPLADCQLIETALLNIVNYQTLIATKAARIKSVVGSDKLLEFGTRRAQEMDAALWGTRAAYIGGFDATSNVRAGKKFGIPVSGTHAHALVQYYMNDYDAFKAYATTHRDCVFLVDTFDTLKSGVPNAIRVAKEMGDKINFLGVRIDSGDMAYLSKRVREQLDEAGFPNAKIFASNDLDEKTIQNLKMQGAKIEVWGVGTKLITAYDQPALGAVYKMVSIERDGKMVDTIKLSNNAEKVSTPGKKQVWRISRNSDGKSEGDYITLWDEDPRVEESLYMFHPNYTYINKTVTDFKARPVLQTIFEDGKLVYDRPSLAEIKEFARRSLDSLWDEYKRDLNPQDYPVDLSQDCYDNKVAIIKRVREYVGKLKF

SEQ ID NO: 28180 - protein, 446 aa, Pediococcus pentosaceus ATCC 25745
MDQKLDDNASYGLLDRTFHLTEQHTTVKREILAGLTTFVSMAYILFVNPTILGQAGMDKGAVFTATAISAIIGCALMAFLANYPIAIAPGLGDNAFFTFSVVLGMGIPWEKAMAGVFIASVLFTILSFLKVREIVIDSISKDLKLAMAAGIGIFIAFIGLQGGGLVTASKTSLVEMGSLSVPTTWLTIFGIFVIAILMAKKVPGSIFIGLVSTAILGLVTGLIKMPEHLISLAPSMKPTFGVGIAHLPSIADPEMWAVVLILLLVAFFDTAGTLIGLAQQAGIMKNNKMPRIGQALMADSISMLAGSVMGTTPTATYVESSAGIAVGGRTGLTSLTVGILFVFSMFFSPLLTVVTTQVTAPALIVVGVLMASALREINWDKFEIAMPAFLTIIGMPLTYNISYGMAFGFLTYPILMTVAGRRKEVNYVVWILMVAFALMLYVLNKL

SEQ ID NO: 28181 - protein, 287 aa, Pediococcus pentosaceus ATCC 25745
MKIGFIGTGVMGSGIIHNLLKNGHDVAVFTRTKSKADPLLEEGAQWASSPAELTQQVETVITMVGFPQDVEEVYFGDHGIFSTVTSGQILIDMTTSSPILAEKIGKKADELAVMALDAPVSGGDIGAQNATLTIMVGGNQTAFETMKPIFGQIGHATNYFGTYGAGQNAKMANQIMIAGTMTGLTEMLVYAKAARLDLKTVLETLSNGGASNWSMENYVPRILKNDYTPGFFAKHFLKDLKIALDQAKQMQVDLPATRLATQLYDNLVNQQGLGDDGTQALIKLWWK

SEQ ID NO: 28182 - protein, 340 aa, Pediococcus pentosaceus ATCC 25745
MTNESMQYAKLGKTDIEVSKICIGAMSFGQPGTMHDWTLDYPESEKVIRHALNLGINFFDTANVYSKGTSEEFLGRALKENNIARDQVVIASKVYFNEGRLSKDAINREIDGTLRRLGTDYLDLYIIHRFDYQTPIEETMSALNDLVVAGKVRAIGASAMYGYQFYNMQQVAKDHGWAQFQTMENHYNLLYREDERELIPICQQMDVSLMPYSPLAAGHLSRRTWQTDTLRSKTDRVAMGKYDRTEAEDIKIVKRVGELADRYDVTMSQIALAWQWAKGVTAPIIGSTKAKHLDDAVAALSVKLTNDDVKYLEEMYIPHPIVGAVAENPAAGTVLVDEKK

SEQ ID NO: 28183 - protein, 472 aa, Pediococcus pentosaceus ATCC 25745
MDQPQIGVVGMAVMGKNLALNIESRGYTVAIYNRTASKTEKVMQDHSEKKLVPAYSIEEFVNSLEKPRRIMMMVKAGKPTDAVIAELLPLLDKGDVLIDGGNTNFEDTMRRNKELDESGINFIGTGVSGGELGALQGPSMMPGGQKEAYDLVAPIFEQISAKAKDGDPCVTYIGPNGAGHYVKMVHNGIEYGDEQLIDESYDLMRKLLGLPVKEIADIFADWNQGELDSYLIDITADILTRTDDLGSDKPIVDLIMDKGGNKGTGKWSSQNALELGVPQSLITESVYARYISVLKDERVAASKVLAGPEKKIDVDKDEVIEKIRRALYFSKIMSYAQGFEQMRVASENYDWNLNFGEIAKIWRAGCIIRAQFLQNITDAFDKNPELNNLLMDSYFQEIAAKYQEAVRDVVALAVKAGIPVPALSAAVAYYDSYRSAVLPANLLQAQRDYFGAHTYERVDREGIYHFPWYEEQ

SEQ ID NO: 28184 - protein, 281 aa, Pediococcus pentosaceus ATCC 25745
MTKQTFEFDSELEVNRLGFGAMQLPGTGVWGPSTDEENAVAVAKAVLNSDVNFIDTADSYGPFYANLYIKAALKDYQGPHKLIASKVGFTRPGPNQWSVVGDPDYLRQQVELNLRTLGLDSIDLMQLHRVDPRFPIEEQVGVLADMQKEGKIRHIGLSQVTVEQIKRAQAVAKIASVQNRYNLIERDNEDVLQYAEENHMAFIPWFPLATGRLAQEEHGILSQIANNHLATPSQIALAWLLQKSDVILPIPGTSNIQHFESNIQAAYITLSDAEFNALEQL

SEQ ID NO: 28185 - protein, 296 aa, Pediococcus pentosaceus ATCC 25745
MHVLCWFAIYYLYEVITMLKINQDGLNNLWPVRSNDSHKGSYGRILIVAGNDQYGGAGILSSSAAVYAGGGLVTLATDKTNFTAVRSTLAEVMLLDFLDFDALKAALKKSTGVVIGPGLGTNATSLKILKFVLDHVQPQTPLVIDGSAIDLIATHQIQVDHPQTIFTPHQMEWQRLSGIKIVDQNPSLNQRAVDRLKAMVVLKHYETEIYAPHTDFRQIMAGNPGMATGGSGDALTGVIIALVNQVDSLALGVTLGTFLHSYTADQIYQKEAVVLPHRLIRRLPFTLKQLQKNKLL

SEQ ID NO: 28186 - protein, 376 aa, Pediococcus pentosaceus ATCC 25745
MNMAANKDYYDILGVSKDASDDEIKKAYRKLSKKYHPDINKAPDAEQKFKDVNEAYEVLGDSQKRAQYDQFGSADPNAGFGGGGFGGQGGFSDFGGGFEDIFGSFFGGGQRQSPNQPRQGEDLQYQMSLKFEEAIFGKKTTIKYSREALCKTCGGSGAKEGTSPVTCHKCNGTGTIQVTQNTPLGRMVRQQTCDVCNGTGKEIKEKCPTCGGTGHTSQQHEVKVSVPAGVEDGQQMRLQGQGEAGFNGGPYGDLYIIFQVQPSDMYERDGSEIYYNQTISFVQAALGDEIEVPTVHGKVKLKVPAGTQTGTNFRLKGKGAPRLRGNGTGDQHVKVKVTVPKKLNSGQKEALKQFAKASGEEPSGHGKSGFFDKFMN

SEQ ID NO: 28187 - protein, 373 aa, Pediococcus pentosaceus ATCC 25745
MKIKAAVVDQQNSDFKIKDDIELAEMGPDDIQVHMVASGICHSDEALRVGDAIIDYPIVLGHEGSGIVEKVGPEVTQFKPGDHVILSFYACGNCDNCLRGIPTQCRNYAANNLSGVRPDGSSHFTENGKHVADMFDQSSFTSTTVVRERNAVKIDDDIDLRKVGPLGCGYVTGSGTVLNTLQPRPGDTIAVFGTGAVGLAAMMAGKISGCTKVIGIDIVDSRLALAKELGATDIINSKNVDVVEEVKKLTGGLGVNWAVDTTGITKVMEDSIKVLTQGGTTATIAVTPNHIDLDTWNDLCVDDKKIVGVNMGDSIPQIDIPRLIEFYKAGMFDFDKTEKFFNFDEINEANAASRSGEVIKPVLIIDPDYVPGK

SEQ ID NO: 28188 - protein, 456 aa, Pediococcus pentosaceus ATCC 25745
MSKEKKIPSGFIYFFGSFGGILFGYDIGVMTGALPFLQTDWNLQNNAGVIGWITSAVMFGAIFGGALAGNLSDKLGRRKMILISSLVFAIGSLLSALSPHDGQIYLIAVRIFLGLAVGAASALVPAYMSEMAPARLRGRLSGINQTMIVSGMLLSYIVDFLLKDLPEQMAWRLMLGLAAVPAVILYFGVLKLPESPRFLVKSNDIDGARRTLSYIRPENEVDAELKTIRETAAEEESANTSSTFLDLLSGKYRYLVIAGVGVAAFQQFQGANAIFYYIPLIVEKATGNAASSALMWPIIQGVILVLGSLVFLWIADKFKRRTLLTMGGTVMGLSFILPAVLNMFIKDMNPMMIVVFLCIYVAFYSFTWAPLTWVIVGEIFPLAIRGKASGVASSFNWIGSFLVGLLFPIMTANMPQEAVFAIFGIICLLGVLFIRTRVPETKGHTLEEIEEQGLGK

SEQ ID NO: 28189 - protein, 444 aa, Pediococcus pentosaceus ATCC 25745
MTESYQFDVLYLGAGHGAFDGAVPLANSGKKVAIVEADKIGGTCPNRGCNAKITLDNPVQLLRHQERLDGIVNGDLKLDWTANVEHEHEVIDGLPDMITGLLDSVDIEIIHGRGKFVDAHTIEVDQQRYTADKIVIATGLRPHHLDVMGSELTHDSTDFMNLKHLPENIVIIGAGYIGMEFATIANAAGANVTVLLRHNRALRKFNQDYVKQVIADLEKRGVKFIYNAQVDRFEEDGSHFTVSYNDHETLTTDWILDATGRIPNIENIGLDEVGVSYNANGIEVNDHLQTNIDNIYASGDVLDKEQPKLTPTAIFESSYLTQLFTGKTTDAINYPAIPTIVFTSPQIAQVGMSVEEAQQNPDYTIKTNHLPDGWFRQVDKETIGNNTLIYDQDHHLVGAAEVSEHAADAINVLLPAIEFQYTAEQLGRIVPLFPTLGADVWSQI

SEQ ID NO: 28190 - protein, 254 aa, Pediococcus pentosaceus ATCC 25745
MINQVKTVVIAGCTGSMGQQTVQLIQNLPGFELVGGYAPHAIPQTSDYLVTNQLAELPQADIWIDFTVPSVVFQNIKYAITHGYHPVVGTSGLSTSEMHELQTLAATKELGGLIAPNFGLSAVLLIQFAKQAAKYFPEAEVVEMHHQDKQDAPSGTAIATAKAISASRTHANDYDEIETIPGARGGKVDGVPIHSIRLPGYVAHEQVLFGGPGEALTIRQDSFDRQSFMSGVRLACQKVTDLNTLVVGLENILD

SEQ ID NO: 28191 - protein, 245 aa, Pediococcus pentosaceus ATCC 25745
MSTKIEVQNLKKSYGSNEVLKGLDLIVKDNEVVVMIGPSGSGKSTFLRTLNKLEEPTAGKIIIDGHDLKDPRVNMNQVREKIGMVFQHFNLFNNLTVGENVMLSPVELGKMSKADAELEARELLKEVGLEDKFNAKPQSLSGGQKQRVAIARTLAMKPDMILFDEPTSALDPEMVGDVLAVMKKLAKAGMTMIVVTHEMGFAKEVADRVIFMADGHIMEEGKPEEIFGNPQNERTQEFLNKILNV

SEQ ID NO: 28192 - protein, 460 aa, Pediococcus pentosaceus ATCC 25745
MNANKKRISPYVILISCAAALGGLLFGYDTAVISGAVGFLQIKFTLSSAQVGWVTSCILIGCALGVSIAGILSDLFGRKKILALSAVIFALSSLGAAFAGSYMILVIWRMLAGIGIGLTSLITPLYIAEMAPSNVRGKLVSVNQLAITIGIFIVYFVNAAIASNATQLWNVSTGWRWMMGVGVIPSLLFLIALIPAGESPRWLSQHGKSEAAYKVLQKVEISDEAAEKSLEEIQMSEEVVDDTKFRDLFNKTWLPVLIIGVLLALFQQFSGSNAIMYYAPEIFKGAGFGQSGAFMATVSIGVINMVITIVALGLVDKIGRKKLLGWGSFAMSCCLLVVSICFFVHAATSITLTFVLLAIAAYAVSLAPVTWILISEIFPLKIRGRAMSICTAVLWLSDFTLSYTFPILTQNIGEGWTFMLYVVVTALSAIFVWKLVPETRGKSLEEIEVYWHAKSKTHVK

SEQ ID NO: 28193 - protein, 460 aa, Pediococcus pentosaceus ATCC 25745
MKGKLPDNFLWGNSTSSMQTEGGVHEGGKGPSVYDTYEATETTSNWDVAIDNYHHYEEDLDLMANQGMNCYRFQISWSRVNPTGDGDFNEEGIQYYDRLINDLLKRGIKPMICLYHFDMPLHLAEKYNGFMSRHVVDAFVRFGKKMVDCFSDRVKLWVTFNEQNLYSQTEAFHIAGYLKGDQTDEELQLIAHHVMTAHAQVANYVHETSDAQIGGMLAYVESYPKNCRPRDVYVARQIDEFLNRNLLEAWVHGHYSTEVTQYIKNHHFDIDFTEQDQIAFEKLKSDFISFSYYASNVVDSTKIPQGTMPNRYLDYGGVENPYLKATDWGWNIDPLGFRDVITKTYNEYGIPMFPIENGIGYREKFDGTEIQDDYRIEYHRDHIQAMIDAVVEDGVPVLGYLGWGLIDIPSSSGNMEKRYGMVYVNRGNHELRDMKRVPKKSYKWFKKVIETNGNDLENDL

SEQ ID NO: 28194 - protein, 468 aa, Pediococcus pentosaceus ATCC 25745
MVVGTQAINVDTLIIGSGPGGYVAAIRAAELGQKVVIVERDYIGGVCLNVGCIPSKALIQAGHLYSTLQHGNPFGVSVSESKIDFTKTQEWKQNQVVNKLTGGVELLLKKHKVAIVRGEAYFNDNETVNVINGDDSHVYRFKRALIATGSRPVEIPHFKFSGRVIDSTGALNLKDVPEHLIIIGGGVIGAELAGAYMNLGSKITIIEGLDHILNGFDGELIQPVLNNFKKNGVEIVTEATAVEANQTDKDVTVTYEADGTTKTVNGDYCLVSVGRRPNTDQLGLNNTNIKLSKRGLIEVNDSMQTSVKHIYAIGDVVAGPALAHKASFEAKVAAAAMGGEDAHDTHYVLPAVAYTNIELATVGETPQSIAEKKLDAKSSKFPFAASGRAMTMDQTEGFIRLITDNPTGGIIGAQIVGPEASNLISELTLAIENGLTIKDIELTIHPHPTLGEEIMDAAELAAGLPIHV

SEQ ID NO: 28195 - protein, 239 aa, Pediococcus pentosaceus ATCC 25745
MDNSLSLQLLGEFIGTFVLVLLGDGVVAGVSLRKSKAEGSGWIAITLGWGLAVTLGVYASSFLSPAHLNPAVSVGMAIAGKFPWSSVIPYSIAQILGGLVGGIIVWIHYYPHWKETKDKDAILGTFATEPAIRNYSMNFISEVVGTAVLIFGLLAFTRGQFTQGLNPIAVGVLITAIGLSLGGTTGYAINPARDLGPRLAHAMLPIANKGGSDWAYSWVPILGPVVGAILGAICFNLIP

SEQ ID NO: 28196 - protein, 304 aa, Pediococcus pentosaceus ATCC 25745
MLNQIKIGKSAVETTTLGLGTNKVGGHNLFEGLEDQDGYEVVRTALDSNIKLLDTAYAYGYGRSEEIIGDVIKDYDRSNITIATKAAQDVNHDYKPNNNPEFLTQQIDHALKRLKTDYIDIFYIHFPDETTNKAEAIEALVKARDAGKIKAIGVSNFSLEQIKEANADDVIDVVEDHYSLVHRDAEKELIPYLNERNITFVPYFPLASGILTGKYAKTDSGKFNQYSQAEFDQIIDAVEKVRGIAESKDATVAQVVLAWYLKNPNLGVVIPGARKAEQVKSNVKATAIELSDQEYHQIDAWFKF

SEQ ID NO: 28197 - protein, 456 aa, Pediococcus pentosaceus ATCC 25745
MDKVKVIIVGASHGGHESAIELLDKYDNVDVTIYEMGDFVSFMSCGMQLYLEDQVTDVNDVRNFRPEDITSKGGKIYNNHQVTAIDVDQKQVTVKDLKAGSEEQVAYDKLILSSGVTPKNLPVPGTDLKNVYLMRGYDWATKIKAALTDDSIKNVAVIGSGYIGIEAAEVFAKKGKHVTLFDFIDRPLGNYLNHEMTEIIDKTLTDNGIQVEMSQSITAFKGDDKVASVETKKGSYPADLVIQAAGVQPNTEWLKGVVDLTDRGFINVDGYLRTNVPDVFAIGDAILPLSIPAGKPSPIALATTARREAQYVVNHIFEKKPTQIFKGVVGSSALHVFDEHFASTGVNEFTAERSNVEIVNSHYVDHIRPAYVPKAEGNVRVDVDITFDPHTHIVLGGAVLSTADMTAQGNVLALAVEHRLTVEDLAEADFFFQPGYDRQWSLINLAAQHALGYARF

SEQ ID NO: 28198 - protein, 476 aa, Pediococcus pentosaceus ATCC 25745
MKDKKFSDGFLWGGAMAANQCEGAYDIDGKGMSIMDIMTVGNSSKRRRATPEIDPQEYYPNHRGIDFYHKYKDDIKLLKEMGLKCFRTSIAWTRIFPKGDEASPNEKGLAFYDELIDTLLANNIKPVITISHYEMPLYLVEKYGGWKNKKLIDFYLNYCRVLFKRYSGKVKYWMTFNEINSTWFVPAISGVKISNDDPKYLQVKCQTMHNLFVASARAVQMGHEINSNNQIGCMVLTTVGYPKTTNPKDALAADDYITRGTLAFTDVHVRGHYPSFVKRMVQKNHLELDITDEELLDIQTGVVDYIGLSYYSSSVVSSEIDKNADSSIGGNFSMGLKNPYLKANEWGWQSDPDGFRLILRWLGQRYEIPLFVVENGYGHEDEVLSGHIIHDDYRIDYLRKHVNALAEAINEDGVDIIGYTPWGCIDLISASTGEMKKRYGMVYVDLDNTGKGTLSRYKKDSFYWYQKVIESNGGEL

SEQ ID NO: 28199 - protein, 508 aa, Pediococcus pentosaceus ATCC 25745
MGKVINVIEQIDSIAVKHPDWIAYDYLGTKNTYGELKAYSDSLAAYILTQGLEEDAPIMVYGAQTFDMIAAFLGVVKSGHAYVPIDRHSPAERLTMINEIANPGMCIAVEDLPVNLGDLPVLEGQELNDVFNANKNVTPNSFVTKDDNYYIIFTSGTTGKPKGVQISHNNLLSFVNWEIGNLGLPERPVTLSQPPYSFDLSVMDLYPTLVMGGTIKAVPKQVTDDFKKLFEILPTLGLNVWVSTPSFMDICLLQPTFDAEHLPALSRFLFCGEELTHATAQALKLRFPDAKIFNTYGPTEATVAVSAIEITDEVLKQYDRLPIGYLKEDTLGFILDDNGRMANAGAEGELVLSGPSVSKGYLNNPEKTDEAFFEYEGQRAYKTGDLVKIDDTGMLYYHGRTDFQIKLHGYRIELEEVNHYLNNDPLIQAGVAVPKYGKDQKVAQLVAYVVPEKNEFDSQIQLTVAIKDSLKDNMMEYAVPNRFVFVESLPQTANGKIDIKSVIAEVNA

SEQ ID NO: 28200 - protein, 178 aa, Pediococcus pentosaceus ATCC 25745
MDNDIARVLYSKADIKEACERLGKQLTKDYAGKRPLILSVLTGAMFFTTDVVREFDVYSEIDFIDVSSYKGGMESTGTVDLVSDLSEDVNGRDVLIIEDIVDTGRTLSYIVDLLYSRNAKSVKICTFLDKPAGRVVEAKADYVGFTVPKEFVVGYGLDYQGYYRNLPYVGVLKPEVYE

SEQ ID NO: 28201 - protein, 454 aa, Pediococcus pentosaceus ATCC 25745
MEENGNNELARNLKSRHVQLIAIGGTIGTGLFLGAGSSIHLAGPSILLAYIVTGLVCFWLMRALGELLLSDLESTSFVTFVTKYLGKKVGFVTGWTYWVCWITIAMAEITATGMYVRYWFPSVPQWIPGFIILILLIGLNLITVEAFGETEFWFSIIKIIAIVALIAIGFIMVLLHSKTNVGHADLTNLIHFGGIFPQGLKGFILSFQMVLFAFVGIEMVGMTAAETRDPKSVIPKAINEIPVRIGIFYVGALFFLMAIYPWNEINPNGSPFVQVFKNIGIPGAGGIINFVVLTAAASACNSSLFTTGRMLFSLTYGSSNKLGKRLGTLSKSQVPKNAILLSSLVIAVAVILNILMPEGVFTLISSIATTCFLFIWGTIVLAHLKYKKGQKQAKKEFSMPFFPISNYIVLTFLSFVGVVLLLQKETAIALIGSLIWFGVMFTVAKIKGKGELMD

SEQ ID NO: 28202 - protein, 243 aa, Pediococcus pentosaceus ATCC 25745
MEYSFFAKLAAEFLGTAILVLLGNGSVANVELKGTKGNGSDWLVIAVGYGCGVMVPALMFGTISGAQINPAFTIGLAVSGMFSWSQVLPFIIAQMLGAIFGQLVVYFAYKPHYDLTTNTESILGTFSTIDASHSSWNGFANEFIGSFVLFFGATAFTHAPYFEANKGSVFIALGFLVGTLVASLGGATGPALNPARDLGPRLVHAMLPIKHKGSSQWGYASVPVVAPILAGICAVALYKGLFL

SEQ ID NO: 28203 - protein, 473 aa, Pediococcus pentosaceus ATCC 25745
MHNFIKNFIKKENPAIYEDKDSHLTRTLVVKDFLALGVGTIVSTSIFTLPGVVAAQHAGPAVVLSFLAAAVVAGLVAFAYAEMASAMPFAGSAYSWINVILGKGFGWVAGWALLAEYFIAVAFVASGLSANFRGLLSSIGIQIPKQLANPLGTNGGIIDITALIVVIAVALLLAHGTTGAARIENALVVLKVVAILVFIIVGLSAIHIQNYLPFIPKYHTNPDGTSFGGWKGIYSGISMIFLSYIGFDSIAANAGEAKNPEKTMPRGILGSLIIAVILFIAVSLVLVGMFHYTNYANNAEPVGWALRHAGHGVIAGVIQAIAVIGMFTALIGMMMAGSRLLYSFGRDGMLPKWLGQVNPKGLPNHALSLLTIIGIIIGSMFPFAFLAQLISAGTLIAFMFVSLGIYVLRPREGKDIAIPSFKMPLYPVLPALAFLGSLAVFWGLDAQAKLYSLVWFIIGIIVYTFYGARHTTD

SEQ ID NO: 28204 - protein, 449 aa, Pediococcus pentosaceus ATCC 25745
MAHISFDSSNVADFVHENELAEIQPLVTAADQILRDGSGAGSDFRGWIDLPSNYDKDEFARIKKAADKIRNDSEVFVAIGIGGSYLGARAAIDFLNNTFYNLLTKEQRNGAPQVIFAGNSISSTYLADVLNLIGDRDFSINVISKSGTTTEPAIAFRVLKEKLIKKYGEEEAKKRIYATTDRAKGALKTEADAENYEEFVVPDDIGGRFSVLSAVGLLPIAVAGGDIDQLMKGAEDASNEYKDADVTKNEAYKYAALRNILYRKGYTTELLENYEPTLQYFGEWWKQLMGESEGKDQKGIYPSSANFSTDLHSLGQYIQEGRRNLMETVINVEKPNHDIDIPKADQDLDGLRYLEGRTMDEVNKKAYQGVTLAHNDGGVPVMTVNIPDQTAYTLGYMIYFFEAAVAVSGYLNGINPFNQPGVEAYKSNMFALLGKPGYEDKTAELNARL

SEQ ID NO: 28205 - protein, 299 aa, Pediococcus pentosaceus ATCC 25745
MKIGLIGLGKMGLNLAENMLDNNIEVLAFDVFDKARENAEKHNIITVDSIEQLVKQLDQLRIIWIMVPAGAPTNDTIGQLSNLLSKNDVVIDGGNTYYQDSLHHNQVLSKAGIYFFDVGTSGGMSGARHGGNFMIGGDKDKFGEIEPLFKAIAEKDGYLYTGQAGSGHYLKMVHNGIEYGMMQAIGEGFEVLSKSEFDYDNEAVAKVWNHGSVVRSWLMELAQSAFSNDPNLDEIKGVMHSSGEGAWTVEEAIRLHVPTPVISSSLMMRYRSEEDDTMTGKVVSALRNGFGGHKVDHKE

SEQ ID NO: 28206 - protein, 211 aa, Pediococcus pentosaceus ATCC 25745
MGLPGAGKGTQAQRIIEDFKIPHISTGDIFREAMKNETEMGVEAKKFIDKGELVPDSVTNGIVEDRLAMDDVNDGFMLDGFPRNIDQAKALDEMTSRLNKPLTAVINIHVDPEVLVERLSGRFICKNCGATYHKLYNPPKVEGTCDVCGHHEFFQREDDKPETVKNRIAVNTKLNTPLISYYEEKHLLYNINGDQDINDVYSEVKKVLEAL

SEQ ID NO: 28207 - protein, 483 aa, Pediococcus pentosaceus ATCC 25745
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 28208 - protein, 203 aa, Trichodesmium erythraeum IMS101
METKPLQFFLRVKLGGLILRGIIISLGIAIVCGLVLIISQIIGSGKDVVASQNTPDTIGSTEIQEQVAEGTILNPTITMAENIMAQDDEKVTTTDSGLQYVDVVEGDGATPQRGQTVVVHYTGTLEDGSKFDSSRDRNQPFQFKVGVGQVIKGWDEGVGSMKVGGRRKLIIPSDLGYGSRGAGGVIPPNATLIFDVELLRIAN

SEQ ID NO: 28209 - protein, 457 aa, Trichodesmium erythraeum IMS101
MIKLPGPKSPALTQILQWTAKPIKFMEKCAREYGDTFEVKLNYPIVFISHPKAIEEIFKANPKKFDCGSSNKLAQPLLGDYSLLLLDDIPHQRQRKLLMPPFHGKRMQAYGELICNVAQEVASKWEIGQVFSMREFTAEISLKVILQAVFGLYEGERYSKLEKLLGSLLESLSSPLKTSMLFFQFLQIDLGPWSPWGNFIKNREEIYELLCAEISERRQKLDPERSDILTMLLLARDEEGEGMSDIELRDELMTLLIAGHETTATSLSWAFYWIHHQPEIYQKLSRELETFGDDLNPMTVINLPYMNAVCSETLRIYPVVIIVSPRKTKLPITIMGQTYPAGTALTPCIYLTHHREDLYPEPKKFKPERFLERQYSSYEFLPFGGGNRRCIGAAFAMFEMKIVLATILRRYSLALAEKQEVKPLRRGLTLAPAGGVKMVMTGKLMQTEKKFPSVATV

SEQ ID NO: 28210 - protein, 323 aa, Trichodesmium erythraeum IMS101
MKENHKSTVVITGASSGVGLHAAKALAKTGEWYVVMACRDISKAEKVAQEVGMTQDSYTVMHLDLASLEVVKRFVKTFRESGRSLEALVCNAAVYLPLLKEPMRSIDGYEISVATNHLGHFLLCNLMLEDLKKSPAKDKRLVILGTVTANPKELGGKIPIPAPPDLGNLQGFEQGFKTPISMINAKKFKSGKAYKDSKLCNVLTMRELHRRYYKSTGIVFSSLYPGCVADTPLFRNHYPLFQKLFPLFQKNITGGYVSQDLAGERVAAVVKDPEYKESGIYWSWGNRQKKDRKSFVQEVSDEASDDDKAIKLWELSSKLVGLS

SEQ ID NO: 28211 - protein, 204 aa, Trichodesmium erythraeum IMS101
MVFSLAIVRKIYKDKSYKWRQVYIIFNCLVVLIFFGEGITGGRDLLKVSLSWQQKYLYNCDWQNQVCLDSKSQSKSPEVLVASISNYPTLVQANQVLASGKFVTVTRGENTKGRAEIIRVGGKTQVRLGENFSTMVGPAVKLVLHKQSRPESYTGENYVPLGDLKSFTGEQVYNIPEGISWQDFPNVVVWCERFDVTFGSAKLN

SEQ ID NO: 28212 - protein, 130 aa, Trichodesmium erythraeum IMS101
MQQLNPIILTSAEVQKISPSAWAYLGDAVYELYIRNYYLIPPKRSGYYHQLVVSQVRAESQAHQLHNLKPHLTDVELDILKRGRNAAFRKPKRLDPEVYQQATSLETLIGYLYLTDPQRLNQLLSYIELD

SEQ ID NO: 28213 - protein, 230 aa, Trichodesmium erythraeum IMS101
MYKTQLEAKEFLEGLMSQLTKTPEEREVVLCTPFTALDFMSKILHGSLIRLGAQNVHWEDEGAYTGEISGLMLKDVGVSYVIVGHSERRQYFGETDETVNMRLKAAQKHGLTPILCVGETKQQRDSGETESHIFSQLANDLVDVDQENLVIAYEPIWAIGTGDTCEAKEANRVIGLIRGKLNNSNVTIQYGGSVKPNNVDDIMAQEEIDGALVGGASLNPESFSRLVNYQ

SEQ ID NO: 28214 - protein, 472 aa, Trichodesmium erythraeum IMS101
MVLIGCQVALANGGSDDFVKVDNIWLLLAGALVFFMNAGFALLEAGFCRSDNSVNVLAKNLIVFCVAAIAFWMFGFGLMFGDSSYHLPCRGNFEQKNEKVQSYHGHFSPTMEYNEFEQKSQFILPPKNDTPLGYPSKGFSCLQRQFPKRSIASIFFFQLAFAGTAATIVSRAVAEKMKLWVFFCFSFILVGFLYPIVGHWVWSEYGWLKQGLNFIDFAGSTVVHTVGGTAALAVAILLKPRWSWLGYDPWEDLETDEGSEALSPQGQKESYDQRNLTSATLGCLILWLGWLGFNGGSTTELKEVGHIIITTIMSAATGGIIAILLSPLFSQRSSNNSEIGKLDLSSLINGILGGLVGITASAAYVDIPIAIFIGAVSGVVVVLTRKLLKWIKLEDPLGAIPVHLFCGCWGTIAVSFSLRGTIVYEKTYNFLERLEWQFSGWGVVFITTFLVSCIIWIFIGLTLYLFEKILRK

SEQ ID NO: 28215 - protein, 135 aa, Trichodesmium erythraeum IMS101
MKTYVNSLFCSSSTINRTMPLIKVKTSVAQLEKDKIDNLLKQLSSSMAKHFSKSESYVMTAFESDIPMTFGGNSDEPTCYIEIKSIGSMKPNQTKEMSQDFCEQINKTLGVPKNRIYIEFSDAQGYLWGWNSSTF

SEQ ID NO: 28216 - protein, 349 aa, Trichodesmium erythraeum IMS101
MIPVILAGGKGERFWPLSRKHRPKQFLSLDGSGKSLLQTTAQRLLPLSNDWGGLWVVTSAMLAAGVAQQLPQIPQENILAEPEGRDTAPAVAWTTIEAAHRYGEDIVVGFFPADHWIGEPEIFHKTLEAAAELATNQEAIVTLGVKPSFPSTGYGYIEQGKKAGNFGGFDVYQVARFTEKPNREKAEEFLATGRFSWNGGIFVFRVGVMLAELRKYVPTMMTVLETMGPGGYSQLEKKSIDYAVMEKTDKAFVLPVAFGWDDLGDWNGLERLVKGDSVNVELANHLGLDTKRSIFFATDDDDTIVTIGLEDVVVVRDGNVTLIVKKERSQDIKKVLKSLANHPKFKDLL

SEQ ID NO: 28217 - protein, 452 aa, Trichodesmium erythraeum IMS101
MSSSEFSYLTNKKIKNLIKIANPRTPSKVLISESNPTEFISSFLAAVGANCQVFLCNPKWGQLEWEKVLKLVEPDMILGNILNHKSLEKSLEKISSLSRDNPCKKTLTTEENLIMIPTGGSSGKIKFAIHTWETLMSSVRGFQGYFQVQEINSFCVLPLYHVSGLMQFIRSFTTGGNLIILPSYKDILEQKEWNINPNEFFISLVPTQLHHLLQKAETANWLSNFKIVLLGGSAAWEELFDAARKYQIKLAPTYGMTETASQVATLKPQDFLAGNNSNGQVLPHAKIIVKNESGKILYQNQIGNISIKANSLALGYYPDIFNNYESLVTDDLGFFDHQGYLKIVGRSSQKIITGGENVFPAEVEAAILTTGLVDDICVIGLADKYWGEVVTAVYVGNYFEVSKEKLLAAIDKKLSKFKQPKYWLRVESLPRNSQGKINREFLKEIAIQRIGE

SEQ ID NO: 28218 - protein, 322 aa, Trichodesmium erythraeum IMS101
MSPSKNTSETNPPLNYPTLGIIGCGNIGGRQAANFIAQGYPVYVYDINLDRMTELESLGAHITHSCAELATYSDVIFTSLPTPADVVRAVLEGDGNLSQGLRSRSIYIDITTNSPETIFKLSKAMEELGVEMLDAPFNDCPEGAKSDGGMGLAVMASGSRKTFERVEPILQLMADRVIYCGTLGNGTRCKLIHNAVNAVAVQAVTEGITLGLAQGIPLETIWDALRFGAFGQNAGDIHGLPHYWFSRRCDDLSQHPDFTVKLLHKDLQLALEMASQQNISVPQFSLTVKDYEEAVRRGFSDYSTTKVRCLQEEQARVMAKTT

SEQ ID NO: 28219 - protein, 269 aa, Trichodesmium erythraeum IMS101
MGFTPENFDSGITYQAQEKDTFIVTYPKCGTTWTQHIIWMLSHDGKPLPLDKNINLEVPHLEEVGGDFVKYLSKPRFIKTHLTYNLTPYNPDTKYIYVARNPFDCAVSFYYHTQGFIKHYDFAEGTFDDFFECFITGEVDWGDYFDHLLSWVQHKNDQNVLFLTYESMKNDPKMNIIAMAKFLGDNYLEKIENLQILESILHHTSFTSMSQNQSRWSSQRPVNMTPFIRQGKVGDWRSHFSVSQTQRLSQKLRMKTAGTEAENLWQIPE

SEQ ID NO: 28220 - protein, 433 aa, Trichodesmium erythraeum IMS101
MASTPQLRREIGVFGATLMGNGSILGTGVFVSIGIAASIAGPSVIIAVAVAGVVATCNAFNSAQLAANHPVSGGTYEYGYKYLNNWLGFIAGWMFLFAKSASAATAALGFAGYFLNAFGVNNNTWLVLTALTAVVVLTIVVLSGIRRSNVTNIIIVSITLFSLVLFILAGVPQVVFSEGKNLMPFFPGDKPIASLLQATALMFVAYTGYGRIATLGEEVKEPRRTIPRAIALTMIFTCVLYISTAIVSVFAGQEVIQKLSQADVSLVAPLEVIAKVGGLGIPVIPKLIAIGAITAMLGVLLNLILGLSRVLLAMGRRRDVPKVVARLDSGQTTPYIAVVIVGVAIACLVLIGDVKTTWSFSAFNVLIYYAITNFAALHLSPEERLYPKWLGWLGLASCLFLAFWVEKQIWLVGLGLILIGLIWHSLIHRFITD

SEQ ID NO: 28221 - protein, 328 aa, Trichodesmium erythraeum IMS101
MANYAPAIETMTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 28222 - protein, 246 aa, Trichodesmium erythraeum IMS101
MWAFFFSDRLIFLPRPSSYQKNQDFVKLQSRDRTQITGIYLPLPKAEYTILYSHGNAEDLGEILPRLRDLRDIGFSIFSYDYQGYGTSQGKPSVDGAYQDINAAYEYLTKKLGIPANKIIVYGRSVGGGPSIDLASRQPVAGLVIESSFTTAFRVVTRIPIYPFDRFPNIDKIKSINCPVLVMHGNADQVIPFSHGQQLFAIANQPKLSLWVDGAGHLNLLEIAGQKYVKVMGEFIRLVQNNNQNY

SEQ ID NO: 28223 - protein, 173 aa, Trichodesmium erythraeum IMS101
MPRTQRNDNFIDKSFTVMADLILKLLPTNNQAKEAFAYYRDGMSAQADGEYAEALENYYEALNLEDDPNDRSYILYNIGLIHASNGEHDQALEYYHQALENNPRMPQALNNIAVIFHYRGEKAKETGNSRDANSYFDQAAEYWKQAISLAPNNYIEAQNWLKTTGRSNKEVFF

SEQ ID NO: 28224 - protein, 3145 aa, Trichodesmium erythraeum IMS101
MSKPMDIKFDDGEIKQAFKKYQSGNWEETINICHKIIKRQPNNFLVLELLGLCAYKNNQIEQAIAYYQKSLKVNYNYAETHNNLAVALQDNQQIDAALRHCKIAIKLCPNYAEAWHNLGLILRDKGQFEAAIEHYQKSLEIKPNNAEVYHSLGTISLELGKLSESQKYYQEALKLDKNYLNAHFGLAAVLLKQGSLMQGFSEYEWRCKRQDYINHSFSQPVWDGSKFPGKTLLVYTEQGLGDSIQFIRYIPLVKKLGGRVIVGCNKDGLKLLFTTVSEIDELFVIGKKFPDFDLQIPLMSIPRIFGTNLENIPTEIPYLFVPESKKNQFLETVNSFKIGIAWKTDSQTKTSKKRSCSVKDLQSILNVDNAKFYILQKKVSPEDLEWLNSQTKIHNLSSSFNDLADTAAVIKELDLVITIDTVIAHLAGALGKPVWVMLNFDSDWRWLIDREDSPWYPTMRLFRQKKMGDWQGVSQEVFGALYSKLLTFYKYEKTDYPSIIKPGLSVTTQDLLTIALEKYQVENWKEAEEICHFIIQKQPNCTSAFEILALCAKKTDKIDLAIVYYQKAINLNPNNYKTHLGLAIVLKKQQKLDEAIVHNQRAIELKPNEASGWHNLGVIFKIQGNIPEAICCYQKSLEIQPNNTYIYYSWANILKQQGNLTEAKVLYEKCIELNPNHINAHFARGFIILKQGDLLVGFSEYEWRCQRQDYITRSFAKSTWDGSNFAEKTLLIYTEQGLGDSIQFIRYIPLAKKLGGRVIVECNQPGLKLLFTTVLEIDELFVEGEKLPDFDFQISLMSLPRIFQTTLETIPGEIPYLSVPKSINFPIPLSPENNLKVGIFWQTSSTNETGQVRSCSVEYLEEIINIDTVNFYALQKEVSVADNEWLKCQTKIHNLGSSFNDLTDTAAAIEQLDLVITIDTVIAHLAGALGKPVWVMLNFDSDWRWLTDRKDSPWYPTMRLFRQPKIGDWNSVLIEVKEALMEFIESQKNLPDLPANFENAYQYYQQNNLVEAERICRLILEEKPQDFQVLHLLAVLENLAGRNDIAIQLLNQVINLYPGFTEAYSNLAKLMKKEGRLEEAIAHYQKAISLEPNNSSNYSNLGFIFLEKGQIESAIINSEKSIEINPNNSQGNFNLGFAWAEKGDLSKASTYYQKAINLQPDYAQAHNNLGLIFQEKGNLSKASNYYQQALEINPNYAEAWCNLGVILLKQGQIELAIEYFRKSLELNPDYAQAYNNLGFVFQEKGNLSKASNYYQQALEINPNYAEAWCNLGVVLRKQGQIELAIEYFRKSLELNPDYAMTHNSLGVTFEEEGNFTASIASYQKALELEPNFPEVHLNLSLVWLLLGDLKLGFQEYNWRWQASKALFLIQPEKLWDGSNLEGKKILIYAEQGYGDTIQFIRYIPLVKKQGARITLACQKPLVRLLEKIPEIEQCLEEIVNLTFDVNAPLLELPRIFGTTLDNIPPPIKNLNIPEIPSIKLESPERNYLKVGIVWMTNQDSPTAVKRSCKLMNFQYLLDVAGVSFYSLQKEPGVDLKLLKTLPILDLSSQLNDFADTAGIITKLDLVITVDTAVAHLAGTLGKPVWILLPFVPDWRWMLDRNDSPWYPTARLFRQPKRGDWNSVLIEVKEALMEFIESQKNLPDLPANFENAYQYYQQNNLVEAERICRLILEEKPQDFQVLNLLAVLENLAGRNDIAIQLLNQVINLNPGFTKAYSNLAKLMKKEGRLEEAIAHYQKAIELEPNNSSNYSSLGWIFLQKGQIDLAIINYKKSRKINPNSSWININLGFVWEKNGNLPKANTYYQKAIEIHPNHAEAWCRLGNILQKQGQFELAIEYCQKSLELNPDYIEANHSLGYIFFQLGKLAESQKYYEQAIKKYYEQAIELNTNHVNAHFGLANALLKQGNFIPGFSKYEWRWKTQGFIGRNLSQPVWDGSNFPGQTLLVYTEQGLGDSIQFIRYIPLVKKLGGRVIVECNQAGLKLLFTTVSEIDELFIKGEKLPDFDLQIPLMSLPRILQTTPETIPTEIPYLSVPKSIDFPIPLAPENNLKLGICWQTSSTTETSQRRSCPVEYLEEIINIDTVNFYILQKEVSVADNEWLKSQTKIHNLSSSFNDLADTAAAIKQLDLVITIDTVIAHLAGALGKSVWVMLNFDSNWRWLTDREDSPWYPTMRLFRQAKIGDWHSIIKQIKNSLIDLVENAAHVEKKSRIISLKLPESGVKKALGKYTSNKLKKTVNNYSKLLQTALEKYKAGNFEEAEQICHLIIQDKPDVAGAFEILGLCAQKTDKTNLVITYCQKAISLNPNNEQTYLNLAIALKNQHKFNAAIIHNQKALSRKPNYAEAWHNLGQIFKGKGEITESIRCYQKALSIRPNYIDAHFGFSLIFLKQGDFIQGFSEYEWRCKRQDYETRSFGQPVWDGSNFPGKTLFIYTEQGLGDSIQFIRYIPLVKKLGGRVIVECNQAGLKLLFTTVSEIDELFVKGEKLPDFDLQIPLMSLPRIFQTTLETIPTEIPYLSVPKSIDFPIPLAPENNLKVGICWQTSSTIKTSQRRSCPVEYLEEIINIDTVNFYILQKEVSVADNEWLKSQTQIHNLSSSFNDLTDTAAVIKQLDLVITIDTVIAHLAGALGKPVWVMLNFDSDWRWLTDRKDSPWYPTMRLFRQAKIGYWNSVLKQVKESLENLLEHNSPTNKISERTAIKLPEEAIQKALAQYKSSKLPKNTPSSTFINSPKNLQTQGLIPATNSNIKEPEHSKKSTSEIIKIIAINWPLNHHTGWGIYGINLTLQLLQTPGYKPLLLTPPSIQPGTLNPLHQALLNPAFNEQKNLQNQLKNQQGKKLQVNLPILQALNSNFSISNNLIGTQNIGIIFSENTKFTSEQINRAQAYNLIITGSTWNTNVLESNGIKPLQKVLQGIDQTIFHPAPKSNTFSDRFVIFSGGKLEYRKGQDIVIAAFKIFQKRHPEALLITAWHNFWPQFMAGIEQTGNVVGLPKISPNKHLQITQWLLENDIPSSAVIDVGIIPNYMVGQILREADVAVFTNRCEGGTNLVAMESLACGIPTIISANTGHLDIINDSHCYPLRCQKSVKPTPLFPGVEGWGESDVEEVVEMLEKVYSDPKNAKLKSNAAVNFMQDLTWEKQIQRLLVTLQNII

SEQ ID NO: 28225 - protein, 144 aa, Trichodesmium erythraeum IMS101
MFFGERQRMVKYNQANLAPKLSIPSNLQGFTPTERPWGSFTILEEGNRYKIKRIEVKPGHRLSLQMHYHRSEHWVVVSGTAKVTCGNKEEILENNQSTYVPQCTPHRLENPGVIPLVLIEVQNGEYLGEDDIIRFQDDYARTNS

SEQ ID NO: 28226 - protein, 432 aa, Trichodesmium erythraeum IMS101
MVVTTLNTTKSEEIFAAAQKLMPGGVSSPVRAFKSVGGQPIVFDRVQGAYIWDVDGNQYIDYVGTWGPAICGHAHPEVLNGLKEVLEKGTSFGAPCALENTLAKMVIDAVPSIEMIRFVNSGTEACMAVLRLMRAFTGRDKVIKFEGCYHGHADMFLVKAGSGVATLGLPDSPGVPKHVTKNTLTAPYNDLETVKKLFEENPDQISGVILEPVVGNSGFIVPDAGFLEGLRMITKENGALLVFDEVMTGFRIAYGGAQEKFNVTPDLTTLGKIIGGGLPVGAYGGRQDIMSMVAPAGPMYQAGTLSGNPLAMTAGIKTLELLKKPGTYDQLNKITKRLADGLLNIAKETNNDIWGGHISAMFGIFFNKGPVHNYDDAKKSDLTKFSKFHRGMLEHGIYLAPSQFEAGFTSLAHTEEDIDRTLATAKKVMSSL

SEQ ID NO: 28227 - protein, 465 aa, Mycobacterium avium
MTSHYDVVVLGAGPGGYVAAIRAAQLGLSTAIVEPKYWGGVCLNVGCIPSKALLRNAELAHIFTKEAKTFGINGEATFDYGAAFDRSRKVAEGRVAGVHFLMKKNKITEIHGYGRFTDPHTLAVELNDGGTETVTFDNAIIATGSSTRLVPGTSLSANVVTYEEQILSRELPESIIIAGAGAIGMEFGYVLHNYGVEVTIVEFLPRALPNEDADVSKEIEKQFKKLGVKILTGTKVESISDDGSQVTVVVSKDGNSQELKAAKVLQAIGFAPNVEGYGLEAAGVALTDRKAIGITDYMRTNIEHIYAIGDVTGKLQLAHVAEAQGVVAAETIAGAETLALGDYRMMPRATFCQPNVASFGLTEQQARDEGHDVVVAKFPFTANGKAHGVGDPSGFVKLIADAKYGELLGGHLVGHDVSELLPELTLAQKWDLTATELARNVHTHPTMSEALQECFHGLTGHMINF

SEQ ID NO: 28228 - protein, 376 aa, Lycopersicon esculentum
MENKVVEEKQVDKIPLMSPCKMGKFELCHRVVLAPLTRQRSYGYIPQPHAILHYSQRSTNGGLLIGEATVISETGIGYKDVPGIWTKEQVEAWKPIVDAVHAKGGIFFCQIWHVGRVSNKDFQPNGEDPISCTDRGLTPQIRSNGIDIAHFTRPRRLTTDEIPQIVNEFRVAARNAIEAGFDGVEIHGAHGYLIDQFMKDQVNDRSDKYGGSLENRCRFALEIVEAVANEIGSDRVGIRISPFAHYNEAGDTNPTALGLYMVESLNKYDLAYCHVVEPRMKTAWEKIECTESLVPMRKAYKGTFIVAGGYDREDGNRALIEDRADLVAYGRLFISNPDLPKRFELNAPLNKYNRDTFYTSDPIVGYTDYPFLETMT

SEQ ID NO: 28229 - protein, 336 aa, Pseudomonas aeruginosa
MGRRYLSGAAGAIRRRGSTCHCRQRRMRAFLRGAGKSRCQIAALPGRSRPMSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTHEGLRRLPLETLRQRFRDSGIATRYYNADIHLGAFALPQYVLQAIGKQDND

SEQ ID NO: 28230 - protein, 511 aa, Streptomyces lavendulae
MKAMDRVDRAVERFPMYIDGQAVQAHDGAVLRTFEPATRRHLADLPSGGAEDVRRAVSAARRAFDEGPWPRMAPGERAGLLRKAAQRLREEAEPLAELEARDNGSTLRKALGADVPGAAAAFEWSAWWAEHVPERQPEAPGSGSYVVWRPVGVVAAIVPWNLPLLLAAWRIAPAIAAGNTCVIKPASFASLSTLRLVELLHECGLPPGVVNVVTGPGGVAGEQLVRSPGVDLVAFTGSDETGAAVREGAAAAGTSARLDLGGKSPNIVLADADLDRAVTGVTWGAFLHNGQVCMAGTRAVVHADVHDDFLRLLSERVGRLRVGDPLDPATDLGPLVSRNQARTARRFTELGLSQGAELVCGGRAPAADELPPGLDAGAYFLPTVLASVGADDAVAQEEIFGPVLAVVRAGSDDDAVRIANGSRYRLSAGVWSADPARARAVAERLRADRVWINDYRLVDLELPGTAGPRSAVWDRLTNELDAYRHKHVVHGGGAGAGGVPAPPTPYALLGG

SEQ ID NO: 28231 - protein, 361 aa, Yarrowia lipolytica
MRLAIQAVFLLATLMWLVAAQADFYAVLGLKKGASDKDIKKAYRTLSKKYHPDKNPRNEEAHQTFIEIGEAYEVLSDEEKRGKYDKFGHEGLKNGGGGGTNPFDLFAQFFGGGGGGQRRGVPKGPNTETHIDVSMKRMFKGFDMDLQVNLQGICSSCKGSGSADGVNHKCDGCDGSGVVIQVAQMGMMIQKFQQQCPKCQGKGHLISNPCNKCGGQKVQREDRKYNVYIEPGTPRVHSYSFEEEADKSPDHVAGDLIVQVREAPTENMGYRRRRNDLFRTEALSLKEALHGGWTRKIPFLDEESEVVLSRKKGEPTQHGHIEVIKNHGMPQMGVDDSHGDLYIKYVIVMPMGASSKVRDEL

SEQ ID NO: 28232 - protein, 107 aa, Chenopodium murale
MAAATDVPGPLKYQTWTLRVPIHCEGCEKKVKKILQKLDGVYMTTIDAQQHKVTVTGSIDAQTLLHKLAKSGKPAELCADNSVKNENMLEAPSSTKVTTPSTITSEF

SEQ ID NO: 28233 - protein, 254 aa, Streptococcus pneumoniae
LNIAKLKEIFNKWQTELGVEDGWNSLFWNNHDLPRIVSIWGNDQEYREKSAKAFAILLHLMRGTPYIYQGEEIGMTNYPFETLDQVEDIESLNYAREALEKGVPMQEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 28234 - protein, 348 aa, Escherichia coli
MTQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVPRAELKARVKEALAMVDLEGFEDRFVDQISGGQQQRVAWPRALILKPKVLLFDEPLSNLDANLRRSMRDKIRELQKQFDITSLYVTHDQSEAFAVSDTVLVMNKGHIMQIGSPQDLYRQPASRFMASFMGDANLFPATFSDGYVDIYGYHLPRPLHFGTQGEGMVGVRPEAITLSDRGEESQRCVIRHVAYMGPQYEVTVEWHGQEILLQVNATRLQPDVGEQYYLEIHPYGMFVLADAA

SEQ ID NO: 28235 - protein, 177 aa, Citrus unshiu
MSSRERDPLIVGRVVGDVLDNFTRTIPMRITYSNKDVNNGRELKPSEVLNQPRAEIGGDDLRTFYTLVMVDPDAPSPSDPSLREYLHWLVTDIPATTGASFGQEIVNYESPRPTMGIHRFVFVLFRQLGRQTVYAPGWRQNFSTRDFAELYNLGPPVAAVYFNCQRESGSGGRPVRR

SEQ ID NO: 28236 - protein, 217 aa, Clostridium beijerinckii
MNKLVKLTDLKRIFKDGMTIMVGGFLDCGTPENIIDMLVDLNIKNLTIISNDTAFPNKGIGKLIVNGQVSKVIASHIGTNPETGKKMSSGELKVELSPQGTLIERIRAAGSGLGGVLTPTGLGTIVEEGKKKVTIDGKEYLLELPLSADVSLIKGSIVDEFGNTFYRAATKNFNPYMAMAAKTVIVEAENLVKCEDLKRDAIMTPGVLVDYIVKEAA

SEQ ID NO: 28237 - protein, 360 aa, Hordeum vulgare subsp. vulgare
MVQPVFDAAVLSGRTDIPSQFIWPEGESPTPDATEEMHVPLIDIGGMLSGDPRAAAEVTRLVGEACERHGFFQVVNHGIDAQLLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNESIMRLNYYPPCQRPLETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQPASART

SEQ ID NO: 28238 - protein, 355 aa, Hordeum vulgare subsp. vulgare
MASLVFDAAVLSRKEDIPPQFIWPADEAPSVDGVEEIVVPVVDLAGFLAGDDAGLNELVAACERHGFFQVVNHGVDPALLAKAYRCCDAFYALPLAEKQRAQRRLGENHGYAGSFVGRFGSKLPWKETMSFNCSAAPESARKVVDYFVGVLGEEYRHMGDVWQEYCNEMTRLALDVTEVLAACLGLDRGALRGFFAGDDSLMRLNHYPPCKKPHLTLGTGPHHDPTALTLLHQDDVGGLEVFTGGAWRAVRPRSDAFVVNIGDTFSALTNGRHVSCLHRAVVNGSLARRSLTFFLNPQLDRPVTPPAELLAIDGRPRVYPDFTWREFLEFTQKHYRSDSRTLDAFVAWINQGHTG

SEQ ID NO: 28239 - protein, 381 aa, Hordeum vulgare subsp. vulgare
MPSTPPSQLNKDPHNRYFDLGAAREVPDTHAWDGQHELPVVDGGVGAGDDAVPVVDMRDPRAAEAVARASEQWGAFLLEGHGVPTELLARVEAGIAGMFALPTPEKMRAARHDGDLYGYGPPLIASYVSKNMWSEGYTLTPANLHAEFRKIWPDAGQHYRHFSGVMEEFLKEMRSLANRLMELFLVALGLTAEQIAGVEAEHNLTESMTETMHLNWYPKCPDPTRALGLKGHTDSGFFTFVLQSQVPGLHLFRHGPPVDRWVEVPAVPGALIVNIGDLFQILTNGRFRSVYHRVVVNRERERISVAYFLIPPADVKVAPLKEVVGGGKPAYRALTWSESIVVRKEAFANHGADLEFGKGRTALDMLSISSDEDDGAEHHRD

SEQ ID NO: 28240 - protein, 481 aa, Hordeum vulgare subsp. vulgare
ALAAKAGVVGAGRTTAPPAVPGLPLIGNLHQLKEKKPHKTFAKWSDIYGPIYTIKTGASSVAVLNSSEVAKEAMVAKYSSISTRKLPKALSVLTRDKTMVATSDYGDFHKMVKRLVMSGMLGSSAQRQFRDTRDMMMDNMLSTFHTLVTDDPHSPLNFREVFKDELFRLSLIQSLGEDVDSVYVKEFGREISKDEIYQITVVDMMMCAIDVDWRDFFPYLSWIPNKSFETRVHTAESRRTAVMQALIRQQKKRIANGEARASYLDFLLAEKALTDEQLMMLVWEAVIEAADTTLVTTEWAMYELAKNPEKQDRLYQEIREVCGDETVTEDHVPRLPYLSAVFHETLRLHSPVPLVPPRFVHETTKLAGYDVPAGTEIVINLYGCNMNKKDWEEPEEWRPERFMDGRFEAADMYKTMAFGAGRRSCAGSLQATSISCAAIARFVQDFAWRLKEGDEDNVDTVQLTSYKLHPLYVYLLPRGRK

SEQ ID NO: 28241 - protein, 486 aa, Mycobacterium vanbaalenii
MISANLIINGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFLKLAPALVAGNTVVLKPAANSPLVLAEIIRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTAADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 28242 - protein, 1456 aa, Yarrowia lipolytica
MKHGKQKLANNNTDHDSLSSLDRALATRRDMFGRTLLHNACICGDAQAVEQLFANPHVDVTAVEYESGSSALHLALAAGSLHCAQLLIKHSRELLRLKDRDGCPAFETALYYHKWHTTDPGLPSEYFSFGSNTNHTLGFPDSDDRQTPETVKVLRPATTDIRSSLAPVRVVDCAIGGYHTAILTSDETANLYVCGVSSRGRLGLGPHVSTQFTPTLVASLASEKIVSVGVGKDHTACVTAKGVVYTWGCNRDSQLGYPTGGATGEEQLQISPRRVGGPTLKKAHITHVTCSNVHTVCWRENTSDMYVWGANNGQMGGMAPGQDCAIPTMVALVPGKISAVCASDYYTACIIDESYIQVYMNGGHFRVFLPAPGGTAREESQSGFDVFKPRLLVNRPQQLYASAGGPTICVSSLGHVYELPLQRFLNVKPALVARQMPVTALWVPRRDYMVATHAAVGDDGSVIICTSSGSAWKRERKENRLGGGTLKEYKFSRIPKVTNAYRVACDPLFRSFAALRYATQVDAIDVDMESLEFDVAERHAINRKMAYFTLDGDKESSEEFEDSPNLGALNWLVEAFEGVVSGTAQRTGLEEEAEMMGLNRFEETVMYKAVEMNKSDPHRGYDCELVCENSTVKLPCHSYMLRSSNLKAAVAKNSPLKCSLLTLVILHHYLYNDNVLSVWTLSGGCSIPREYVEAKAELLALAKEFELSSLVCKLSFGETADQLPVDMAKLFSSDTGDVAIEVDGGQILHAHRFILTQQSEFFQSCLSERWSDDTKVVVDLCHLPAASVRLCLRFMYTHNLDSLFDQVSSKVSSKDFIATVSQLLSTADELLLTPLKEFCELILSELVTVKNAASLLFLASAYNCDKLMTFMFSYICVNMECLLEGGFLGAILADGELFGAIDHHYRVMTGREIVLKEVPESSAVVGVTQLGEGISEDAAEQEEVEEEVKPKTLALASRPSGWVESFLSDFDGHNELLCRVAPGSVQAPDAAAALTPHRQSFAALHRNSKSEETRPSISPMSSPDLRGHNQTDDVFEFELDECPAEQRKRHDSRHDDRRCSHSEWREVKTGSSVRTAQFSSSPFGKSPMAGSPLSVSPNHASGDRRRSSFATAASGVPLTPGEIRFNLKQQIEKDSDAVYWPTLGGLGSPGGAGSVGAAGATPGSHPRGSPGPSATPSGSSTPWGKGAGVSNATPGSAGSASTWGNSSANGASAPSASATSAGSALSDLFSVTPPSSKLSQKERRRLLKQQQEETLMRAQEKEKQAAEGPWKVKKKAPVGVSPFESTSSPASSKTPSKTPSRAPPRAPSRAGLPGPNVGVGISTVGNSSATATSSFASDFYAASQPVTALSLAEIRERQERSTQKAKNVKTIEEIQQEEMFQKWWDAEVARNKGEESRGPEGGPRGTPSKSSRRPNKKKNNNKGPANGSSNGGGGGSGSQDDNGKRHRPRPREQIKA

SEQ ID NO: 28243 - protein, 481 aa, Botryotinia fuckeliana
MRTTTFITAAVGLLSTCTDAIQLQKRTDGPARVVGLDVVRKSVENPLARDKLRKLRRRSKTVTATLDNEETLYFANGTLGTPAQSLRLHIDTGSSDLWVNTASSTLCSRKTNPCQTAGTYTANSSSTYAYVASDFNISYVDGSGASGDYVTDTFTIGSATLDKLQFGIGYTSSSPEGILGIGYEINEVQVGRAGKKAYNNLPAQMVADGLINSNAFSLWLNDLDASTGSILFGGVDTAQFHGQLETLPIEKESGYYAEFLITLTEVMLGDTVIAQDQALAVLLDSGSSLTYLPDAMAEAIYEQVEAQYDASEGAAYVPCSLATNTSALNFTFTSPTIQVTMNELVIPVTSTTGQQLQFTDGTAACLFGIAPAGDSTSVLGDTFIRSAYIVYDLDNNEISLAQTNFNATSTSVVEITTGTTAVPSATLVANPVTASSGSSGSEMSGSVTLSSGSKSKNAGAMQTPPPLAYGMAVLGAGLYYA

SEQ ID NO: 28244 - protein, 475 aa, Escherichia coli K12
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 28245 - protein, 479 aa, Escherichia coli K12
MISGRHDRKPYYAGEAAIMAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 28246 - protein, 498 aa, Escherichia coli K12
MHTDSNGGHYILRFDNERKTNQRRRIMETNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 28247 - protein, 500 aa, Escherichia coli K12
MMTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 28248 - protein, 457 aa, Escherichia coli K12
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRASR

SEQ ID NO: 28249 - protein, 322 aa, Escherichia coli K12
MAKRNNDMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGKALTEIFTQAKARQMIICADMIKPRLNETLDDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 28250 - protein, 455 aa, Escherichia coli K12
MSGDILQTPDAPKPQGALDNYFKITARGSTVRQEVLAGLTTFLAMVYSVIVVPGMLGKAGFPPAAVFVATCLVAGFGSLLMGLWANLPMAIGCAISLTAFTAFSLVLGQQISVPVALGAVFLMGVIFTAISVTGVRTWILRNLPMGIAHGTGIGIGLFLLLIAANGVGMVIKNPIEGLPVALGAFTSFPVMMSLLGLAVIFGLEKCRVPGGILLVIIAISIIGLIFDPAVKYHGLVAMPSLTGEDGKSLIFSLDIMGALQPTVLPSVLALVMTAVFDATGTIRAVAGQANLLDKDNQIINGGKALTSDSVSSIFSGLVGAAPAAVYIESAAGTAAGGKTGLTATVVGALFLLILFLSPLSFLIPGYATAPALMYVGLLMLSNVSKLDFNDFIDAMAGLVCAVFIVLTCNIVTGIMLGFVTLVVGRVFAREWQKLNIGTVIITAALVAFYAGGWAI

SEQ ID NO: 28251 - protein, 496 aa, Escherichia coli K12
MITEFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 28252 - protein, 461 aa, Escherichia coli K12
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 28253 - protein, 436 aa, Bacillus anthracis str. Sterne
MNTMQPSAPPHLESTKTIFSNSITKLVVFICWLAILADGYDLGIYGAVLPKLLEDNSWALSPAHAGTIASYALFGMFIGAILVGTITDLIGRKWTLICCLALFSITMGLAALAPSPELFGLWRFIGGIGLGGVIPTASALTVEYSPKKRQSFIYALMFTGYPLGIVLGAILSMFMLEDFGWRIMFGIGMIPLLLIPFIIRYLPESIQFLLSRNRQEEVDKILNRFQIEFYAKDETHQAPSNIRKKNGFLTLFSKEYIKATLLFWITYIMGMFLIYGLNTWLPQMMRQAGYPLGSSLSFLLMLNITAAIGALFAGAIADRIGAKIVISISYLMAAICIGLLTIKPSVSIIYLLIGLAGIGSVGITQILNAYVTQYFPSHIRATSLGWGLGLGRVGAIAGPILVGIIMTMQYDLAWNFYLFSFAGLLAAISVFFIPTK

SEQ ID NO: 28254 - protein, 267 aa, Bacillus anthracis str. Sterne
MTKIFILASTLSLSFFSGLNIGNAATENFSPITNAIVQNNDYFVEGNSKDNNKPPGNGGSQDDSGSDGNGSDGSGSGDNGSGDNGSGGNGSGGNGSGENGSGGNGSGSSGSGDNGSGGNGSGGNGSGSSGSGENGSGGNGSGSSGSGENGSGGNGSGSSGSGENGSGGNGSGGNGSGGNSSGGSGSGGSGSGDNGSGGSGSQGGNRVKGDSSSQGGNGSQGGNVKDNAKKQGDKLPNTATHYPASILMGLSTFLIGMLLFIRRKNAK

SEQ ID NO: 28255 - protein, 278 aa, Bacillus anthracis str. Sterne
MWRDTMSAFLGELIGTALLIVLGGGVCAGVSLKKSFAKDSGWIVITMGWGLAVAVAAYVVGSISGAHLNPALTIGLAFKGAFPWGDVPGYIAAQMIGAIIGAVIVYLHYLPHWKETEDPGTKLGVFATGPAIPNTFANLLSEMIGTFVLVFGILAIGANKFADGLNPFIVGFLIVSIGLSLGGTTGYAINPARDLGPRIAHFFLPIAGKGGSNWKYAWIPVVGPILGGSLAGLFHQVVFEGKQNAALIYVIIATVIVLAISYMTSKKSGSNTNSRKVA

SEQ ID NO: 28256 - protein, 400 aa, Bacillus anthracis str. Sterne
MMTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETEIQMAGATSYYMPLKKENDFLPNLELIPEEIADQAKMMILNFPGNPVPAMAHEDFFKEVIAFAKKHNIIVVHDFAYAEFYFDGNKPISFLSVPGAKDVGVEINSLSKSYSLAGSRIGYMIGNEEIVGALTQFKSNTDYGVFLPIQKAACAALRNGAAFCEKNRGIYQERRDALVDGFRTFGWNVEKPAGSMFVWAEIPKGWTSIDFAYALMDRANVVVTPGHAFGPHGEGFVRIALVQDKVVLQQVVENIRNSGIFALEKVDELVKN

SEQ ID NO: 28257 - protein, 478 aa, Bacillus anthracis str. Sterne
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 28258 - protein, 488 aa, Bacillus anthracis str. Sterne
MNSATNQTTSQTETTKGKGELRRGLKSKHLTMISLGGTIGTGLFLASGGVIHSAGPGGALIAYAAIGIMVYFLMTSLAELTAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 28259 - protein, 500 aa, Bacillus anthracis str. Sterne
MRTMQQLLQKRAMQSPNLEALVGGEKRYSFQQYNERVNQLAHYLLHSGVQRGDRIGILCKNNHPFPSVMMASLKIGAVFIPLNHQLTVYELETIVKEAKLKVLVIDEEFSEVLLKVDAVKEIPYVIETTKEGFGSFELTLQEQPMTEPNVEVHEEDDAIYLFTSGTTGQAKACVIGHKNLHHYFDEIAGQREIPAGERFLSVHPLFHMSGVLSILNCIYHGVTMIFLADSNPTLIWDKIEEEKITTMLAFPAVYSYMLDELNKKERNISTFKVAQSGGTKVPETLIQKYMEKGIYMVQGYGSTEGWVVTSWHPMMGKEKMSSVGKALKNVEVKIVHPETGHELTTNEVGEIHVRSPYMFKGYWNNEKATKKVIKDNWFNMGDAGMIDDDGFLHIMGRYKDVIIRGGDNVYPDQVEDVIHEMHGVLEVAVVGVPDGFWGEIPRAYIVKDGETILTEESIIQYCKEKLASYKIPEVVFVEELPKNALGKVLKRELRDVVLVK

SEQ ID NO: 28260 - protein, 472 aa, Bacillus anthracis str. Sterne
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 28261 - protein, 399 aa, Bacillus anthracis str. Sterne
MYWNDGNEGSEYRMISHLFQTYGRRTVEFVKGNGTKVIDNNGKQYLDFTSGIGVCNLGHCHPTVMKAVQEQLNDIWHISNLFTNSLQEEVASLLTENIALDYVFFCNSGAEANEAALKLARKHTGKSLVVTCEQSFHGRTFGTMSATGQNKVKEGFGPLLPSFLHTPFNDIKALKEVMNEEVAAVMVEVVQGEGGVIPADLSFLKEIETLCKKFGSLFIIDEVQTGIGRTGTLFAYEQMGIDPHIVTTAKALGNGIPVGAMIGRKELGTSFTAGSHGSTFGGNYVAMAAAKEVLQVSKRLSFLKEVQEKGEYVLQKLQEELQHVECIQNIRGKGLMVGIECTHEVASFIEQLEKEGLLVLQAGPNVIRLLPPLIVTNEELEQAVYMIKKVVCTKNVSII

SEQ ID NO: 28262 - protein, 482 aa, Bacillus anthracis str. Sterne
MMETMPNWLKQRAFLTPDRTAIEIEEEKVTFMQLHEKVVSVCEHLTHVGVNRGQKVAVLMKNGMEMITVIHALSYVGAVAVLLNTRLSREELLWQMDDAEVICLVTDQDFEAKDIPVYSFAEVMNGPKEEASIQEEFSLREAMTIIYTSGTTGKPKGVILTYGNHWASAVGSSLNLGLRDDDCWLACMPMFHVGGLSLLMKNIMYGMRILLVPKYDADFIHKALQTRGVTIISVVSKMLTDLLERLGEGTYPSSFRCMLLGGGPAPKPLLETCVDKGIPVYQTYGMTETSSQICTLSADYMLTKVGSAGKPLFQCQLRIEKDGVVVPPFAEGEIVVKGPNVTGGYFNREDATRETIQNGWLHTGDLGYLDEEGFLYVLDRRSDLIISGGENIYPAQIEEVLLSHPMVAEAGVVGMTDDKWGQVPAAFVVKSGEITEEEILHFCEEKLAKYKVPKKACFLEELPRNASKKLLRRELRQLVEEM

SEQ ID NO: 28263 - protein, 196 aa, Moorella thermoacetica ATCC 39073
MVKIMPDGEKNIASRARGMPPFIVMDILEKAKEMEAINGFSKLYAMTGWRLGYVIAPPEFIRPLQKLQQNLFICAGSFVQAAGIAALRECDEHVAQMVATYDERRRYLLARLKTMGLATRVEPTGAFYALANVKKYTGDSYSFAFEILEKARVAVTPGIDFGRNCEGYLRISYANSLENIKEGLDRLAEFLAGKKA

SEQ ID NO: 28264 - protein, 354 aa, Moorella thermoacetica ATCC 39073
MQWGRGAAGKSITGEGGPGELVRKGLAAEGRWLARAVFLGRWLNKHRTVTITVERYSHDAAWRDEYSGDPGENRGGMLMVFSYFFSEVIATIRVVVTGAAGRMGREMTRGLLQTEDIAVVGAVDRREVGVDIGSLNGLPPAGVIIQEDLAGVIASARPEVMVDFTVAAAALANARLAVEQGVSPVIGTTGISLERLDELHQLCEARQVGAVVAPNFSLGAILMMHFAEEAARYFPRAEIIEIHHDQKIDAPSGTALKTAELMAARVNRPLTPSPAEEKVAGARGATYQGLAVHSVRLPGAVAHQEVIFGGQGQLLTIRHDTTSREAFLPGLLLAIKKVRQLKGVVYGLENLLEF

SEQ ID NO: 28265 - protein, 487 aa, Moorella thermoacetica ATCC 39073
MALTTDKIIGEGLTFDDVLLVPGESEVLPREVDISSNFTRHIRLNTPLVSAAMDTVTEARTAISMAREGGIGVIHKNMTIERQAREVDRVKRLEHGVITDPISLSPDHKVREAIALMEHYHISGVPITDNGKLVGIITNRDIRFEDNHERPIKEVMTKDNLVTAPVGTTLAEAMAILRAHKIEKLPLVDADYNLKGLITIKDIEKTRRYPQAAKDERGRLRVAAAVGTSADTMTRVEALVAAGVDAIVVDTAHGQSRSVIETVKRIKAAFPAVELVAGNVATYDGARALAEAGFDAVKVGVGPGSICTTRVIAGIGVPQITAVMECARAAAEFGIPVIADGGIKYSGDITKAIAAGANTVMIGSLLAGTEESPGEIEIFQGRSFKSYRGMGSLAAMKEGSKDRYFQEEAEKLVPEGIEGRVPYKGPLSETIFQLVGGLRAGMGYCGARNIAELQARGRFIRITPAGLRESHPHDVMITKEAPNYRIS

SEQ ID NO: 28266 - protein, 288 aa, Moorella thermoacetica ATCC 39073
MGLNLALNMLDHGHEVRGYARTKATVDKAAAQGIKGAYSLEELAGQLKTPRLVWLMIPAGKAVDEVIEQLAPLLAPGDIIVDGGNSHYRDTLRRYKFLKEKGIHLVDSGTSGGVEGARHGACCMVGAEDEVFAYLEPLFKDITVPGGYLHTGPPGSGHYVKMVHNGIEYGMMQAIGEGMEVLAGAPFKLDLKEVARVWRHGSVIRGWLMDLMEKALAKDNTLDGIKDIAYSSGEGLWTIEEALRLKVPAPVITAALLMRYRSEQEESFATKVVAALRHEFGGHDVARK

SEQ ID NO: 28267 - protein, 280 aa, Moorella thermoacetica ATCC 39073
MKGIAYLGPRGTYSHEAATIWGQRAGQDSFLACPDLPGVLAAVLQGQAAAAILPVENSIEGAVNLTLDLVLENPELQVIGEVVLPVHHCLISRAGDLATIREVWSHPQALAQCRHYLAQNLPGVITRPATSTAAAADQARQQPYLAAIASNFAAEVYQLPVLAAGIEDYPDNKTRFWVLGRENLHLPGPYKTSLVVAAVANRPGSLYAILKDFAAAGINLTRIESRPTKQELGEYLFFIDCEGRATEPPLREVLVGLKAKTSLLSILGSYARDGGGTSGQ

SEQ ID NO: 28268 - protein, 260 aa, Moorella thermoacetica ATCC 39073
MGVERITAAFAARKKEGRKALIVYLCAGDPSLEVTGQAVRELAGAGVDLIELGVPFSDPVADGPVIQAASKRALAAGVTLPEILELVKSLRSGLAVPLILMSYYNPLLQYGLERLTADLAAAGVDGLIVPDLPLEENPPLRQTLEPAGLALIPLVAPTTPGERLARIAATARGFIYCVSLTGVTGVREGLPPGIDEYLAGVRAVTDLPLGIGFGIGSPDQARLLAPMGDGIIVGSALVDVLYQEGLPAALRLVERLRHAL

SEQ ID NO: 28269 - protein, 235 aa, Moorella thermoacetica ATCC 39073
MCDYDGTLVPLAPRPEDAVPDPGLLKLLRQLVSRPGLHLAVISGRPLADLRDLLPIPGLLLAGLHGAQVAGPEGPVINLLPPPPGKNPWPEIFSLARQLAAGVPGLLVENKGEGVALHYRLAEPDAAAGILEEFRHALEPFLQDGLELIPGHKVLEVRRRGVNKGLAVTYFTRRWPRAFPVYLGDDRTDEDAFAALPGNGLAIGVGQRQSGYAHYFLASPAEVIEFLQLLNRSRT

SEQ ID NO: 28270 - protein, 134 aa, Moorella thermoacetica ATCC 39073
MEKELKVVDFVANLSPLALAYVGDAVYELLVRAHLVGRGPAKPEQLHREALKYVRATAQARVVPALEEYLTPAEKDILRRGRNARPGHLPRTAAPAEYHSSTALESLLGYLYLQGDWARVEELAHLIFKLAEQD

SEQ ID NO: 28271 - protein, 143 aa, Moorella thermoacetica ATCC 39073
MTQQYWNNDEATTRAFQGGWFRTGDVARIDGDGYVYIMDRLKDMINRGGEKIYSLEVENVIYSHPGVKEVAVIGSVDPIYGEVARAVVVPNNHGSSITGREIQDWVRARLAKYKVPQYVNFVNELPKNANGKIDKKLLRQQFQ

SEQ ID NO: 28272 - protein, 437 aa, Moorella thermoacetica ATCC 39073
MTDSEAWPRSAAAFAEAVKLMPGGVNSPVRAFKSVGLTPPFIQRGEGAYLYDIDGHKYIDYVSSWGPLILGHRHPEVVDALEKTLREMGTSFGAPTELENELAREITTAMPAVEMVRLVNSGTEATMSALRLARGYTGREKVVKFAGCYHGHADYFLIQAGSGALTFGIPNSPGVPATVAANTIVAPYNDLAAVEDIFQKAGEEIAAVIVEPVAGNMGCVPPLTGFLAGLRTITKEYGSLLIFDEVMTGFRVAFGGAQALYGIRPDLTCLGKIIGGGLPVGAYGGRREIMERVAPSGPIYQAGTLSGNPLAVSAGLATLKVLKKPGTYERLESLSARLEKGLKEAAAEAGVPVTFNRVGAMFTTFFNPGPVTDYATATASDTRAFAAFFRAMLRQGIYLAPSQFEAAFMSLAHREDDIDCTIAAAREAFKGIAIGDS

SEQ ID NO: 28273 - protein, 1487 aa, Moorella thermoacetica ATCC 39073
MSAKKETTPAVGAVLVLGGGIAGMQSALDLANAGYLVHMVTESSSIGGHMAQLDKTFPTNECAMCLLGPRMTDTSNHPNIRLHTCATLEKVEGEKGNFTVQIREKPRYVNIQECTACGDCEQACPVSIPNEYNQEMGTRKAIHKMFPQAVPNKYLITKRGTPPCRSTCPAGTNVQGYVALISQGKFAEALEVVHRRMPFAGICGRICHHPCETECNRGRYDDPIAIATLKRAAYDYGWEAEASREKERRPELPSRKEKVAIIGAGPAGLTAAQDLALAGYQVTIYDALNQPGGMLRGGIPRYRLPMEVVDRETQRILNLGIKFVPNTVVGKDINLKDLQKEYNAVIIAVGLQQSRMLKLDGSELEGILPGVNFLREAALGGRPEVGEKVVVIGGGNVAIDVARTARRLGAREVHLACLESREEMPAHPWEVEEALEEGIILHPSWGPKRFLGAKGRVTGIELMQCTRVFDEEHRFNPQYNPEVTQTLTADTIIMAIGQAADLSLLGEKSPVATNRGLIKADPLTLATSVPGVFACGDIVRGPASVVEAVASGHEAAESVKRYLQGEDLATGRSLEKEPHLDPPPNVVPFPGRRQAQAMAPVEERVKDFREVYQGFTPEEAIAEAKRCLNCGICSECLQCEAVCKKKAIEHWQQEKVTKLKVGSIVLAPGFELFDATLAGEYGYGYYANVLTSLEFERLLSATGPTESHVLRPSDQRPPKKVAFIQCVGSRDCEREGSPYCSAICCMYSTKEALIAREHDANIEPTIFYLDIRAYGKNFDRYVESAKAGGVRYVRAMISRVEEDPQTKNLIIQYYTDGRVQREEFDLVVLAVGVKPPIDAEKIAAATGIELNPYGFAKTQPFEPVATTRDGIYVAGVFQGPRDIPETVVNASAAAACAGAAMAPGRNTMITPKEYPPERDVSREEPRVGVFICHCGINIAGVVDVKAVVEAAAKLPGVVHAEDNLYTCSQDTLKKIKDAIQEYRLNRVVVASCTIRTHQPLFREALREAGLNQFYFEMANIRDQCSWVHRNEPANATLKAIDLVRMAVAKVKRHEALHLQPVPVIQKALIIGGGVAGLTAALNVAEQGFEAYIVEREAELGGQVRNLRTTLEGEDLQALLRDLITRVQANPRIQVFTRARIEDFGGHQGHFTTTISLGEPGREHVRRTQTLEHGVVIVATGSQEIKTDAYLLGQDERVITNTRLEQALADGHWDQEKNKQVVFIQCVGSRDQEHPYCSRTCCAQTIKNALAIKRRNPEAQVYVLYRDIRTYAFMEDYYRQAREAGVLFIAYDPGDPPRVRQREIGLLEVMVKDPDSGKELVLWPDQLVLATGAVAPDGVEELASLLKLPLNEDRFYVETHAKLAPIDFPTAGIFLCGAGHAPKLAAEAIAQAEGAVARACTILARENLMVGGVVAVVDENKCAACLTCVRVCPFNVPRINERNVAEINAVQCMGCGTCAGECPAKAIQLQFYKDDQLLAKVAGLFGEV

SEQ ID NO: 28274 - protein, 313 aa, Moorella thermoacetica ATCC 39073
MLEIIPKYFTLWVIVFAALALLSPNSFQFLGKYISYLLGVVMLGMGMTLTMGDFAGVLQQPLNVVVGVALQFIIMPLLGFAIATILRLPPELAAGVVLVGCVPSGTASNVMTFIAQGDVALSVTISSITTLIAPFITPYLYLLLGGKFIPVEPLALLIDIAKIVLLPIIIGLVIRQVLGNERARVVNQVMPSVSVIAIVIIIAAVVAGSAAKLVNVAGAVILAVILHNGLGFLMAYFVARYLCRMTEAQARAVSFEVGMQNSGLGAALAMKFLTPVAALPSAIFSVWHNLSGSFLANFWARRAPAPAARLARR

SEQ ID NO: 28275 - protein, 317 aa, Moorella thermoacetica ATCC 39073
MAKVITIGEILVEIMTKYTGQEFTAPGELLGPYPSGAPAIFIDQVARMGVEAGIIARVGDDDFGLLNLTRLRDDGVDTSHIYKTKGYTTGTAFVTYYANGERKFIFHFPHAAAGQLGPADVDENYIKTAEYLHVVGCSLTASASLRQAIWKAVKIAKENKVKVSFDPNLRPELLNEQEIKNVYDDILDAADIILAGKSEMIALSGEGDLVKGIARLKKRDGTMLVLKDGARGASLYYGEECYHVPPVKVQEVDPTGAGDCFDGAFIAALACGKGLKEALQIANVAGALSVTRKGPMEGAAFKEDILALYSRHNSSKV

SEQ ID NO: 28276 - protein, 502 aa, Moorella thermoacetica ATCC 39073
MARLVEIALARGEGLLASNGALSVNTGKYTGRSPHDRYIVDTPAVHDSISWGAVNQPVSEATFERLYSRLTAYLQGKDLFVFDGFVGADPAYRMPIRIVNEYAWQNLFVHQLFIRPTAEELAGHEPRFTVICAPGFKAIPEEDGTRSEAFIILNFDRRLVIIGGTSYAGEMKKSIFTVMNYLLPEQGVCPMHCSANMGPAGDTALFFGLSGTGKTTLSADPERYLIGDDEHGWSDKGIFNFEGGCYAKCIKLSAEHEPQIWNAIRFGSVLENVMVDPDCRIIDYDSDALTENTRAAYPVDFIPNAVIPGVGGHPQTVVFLTADAFGVMPPIAKLTREQAMYYFLSGYTSKLAGTERGVTEPKATFSTCFGAPFLPRSPMVYANLLGERIARHNASVYLVNTGWTGGPYGTGRRMSLPYTRAMVRAALNGELDKVEFTPDPVFGFLVPKACPGVPAEILNPRNTWAETEKYDAMARKLASLFRENFAKFKDVPVSIQEAGVVG

SEQ ID NO: 28277 - protein, 471 aa, Moorella thermoacetica ATCC 39073
MAIKFGTDGWRAVIADEFTFANVRLVTQATANYLLREAGSGKIIIGYDNRFLAPEFARAVAEVLTASGFTVYLPSRAVPTPVTAWAIKHYQAMGALMLTASHNPPEYCGLKFIPEYAGPAVPAITSAIEKEIAAVINGGEVKTLNLDEARGRGLVRELEPEADYREYLHGLIDVEALRKAGLKVVVDPLYGAGIGYLEDFLRGAGCQVQAIHNYRDPLFGGDLPDPSARGLEELSRRVRETGAHLGLALDGDADRFGVVDGDGTYLTANQVLYLVLAHLIMDRHYRGPVARTVATTHNLDRLARAHDLEIIETPVGFKYIGEALREKGCILGGEESGGLSIRGHIPEKDGILATALVAELRAVRGRSLGEILADLHSSYGHLVNQRLDIKVDPATKERVLQELPDFAPAKVAGIPVTGRLTVDGVKLTLADGSWVLLRPSGTEPLLRLYAEAPDAGRLRLLQKEITTALRI

SEQ ID NO: 28278 - protein, 393 aa, Moorella thermoacetica ATCC 39073
MAKLTLKDLELNNKRVLVRVDFNVPLEAGRVTDNTRIRAALPTIEYLLDHGARVILMSHLGRPKGKVKEELRLDPVARELESLLGRQVHKVNDCVGPEVEAAAAALKPGEVLLLENLRFHPEEEKNDPGFARQLASLADVYVNDAFGAAHRAHASTEGVAHYLPAAAGFLLQKEIETLGKALADPERPFVAIIGGAKVSDKISVIRNLLTKVDTLIIGGGMANTFLKAQGYAMGKSLVEEDQVPLAQELIQLAAQKGVKMLLPRDLVVAQEFKADAPHQVVAVNAVPDGWMALDIGPETARAYAGALEGARTVVWNGPMGVFEMEAFAHGTEAVARAVAAVDGMTIVGGGDSVAAVEKMGVAGKIGHISTGGGASLEFLEGKALPGVVALTEK

SEQ ID NO: 28279 - protein, 238 aa, Moorella thermoacetica ATCC 39073
MHNTTEEARDLVTLLRPLVGTARAEVVVCPPFTAIAATVNAASGSNISVGAQDLFWEDKGAYTGEVSGPMLRDLGCRYVIIGHSERRQYFGETDATVNKKLLAAYRNELLPIVCVGETLAEREAGHTLEVVGRQVREGLKGLETGQARDLVVAYEPVWAIGTGKTATAADAQEVIAFIRKTLGEMYGETAAAIRIQYGGSVKPENIAELMAQPDIDGALVGGASLDAVSFAAIVNYDQ

SEQ ID NO: 28280 - protein, 502 aa, Moorella thermoacetica ATCC 39073
MILDGFGLGPEGEGNAISQGRLPNYRRLLAGYPHTRLRASGEAVGLPAGQMGNSEVGHLNIGAGRIVYQELTRISKAIRDGSFFSNAALVGAVRAAREHGGALHLMGLVSDGGVHSHLDHLYALLDLAKREGLERVYIHAFLDGRDVPPASAAGYLEQVEDECRQKGIGAIATIMGRYYAMDRDRRWERTARAYRALVAGEGHQASSPSEAIRASYERDITDEFVEPAVITRDGRPLATVREGDSVVFFNFRADRARQLTRAFVDRDFDAFERPGGRLDIQFVCLTQYDVTIPAPVAFPPQVLQNVLGEVIAGAGLKQLRIAETEKYAHVTFFFNGGVEEPFPGEDRLLIPSPKVATYDQKPSMSAREVTDAVLERLDKYDFIVLNFANPDMVGHTGDLAAAIAAVETVDECIGRIVQAMAERRAPLLLTADHGNAEEMREPDGEPHTAHTSNLVPFILVDDRYRGASLREGALEDVAPTVLDILHIQQPAEMTGKSLIVKG

SEQ ID NO: 28281 - protein, 428 aa, Moorella thermoacetica ATCC 39073
MTTISDIYAREILDSRGNPTVEVEVFLESGGWGRAAVPSGASTGAYEAVELRDKDPKRYGGKGVLDAVNNINAIIAPELVGSDALDQREIDRQLIEMDGTPNKGKLGANAILGVSLAVAKAAADALGLPLYRYLGGVNAHTLPVPMMNILNGGKHADNNVDIQEFMVMPAGASDFASALRMGAEVFHSLKAVLQSKGLNTAVGDEGGFAPNLRSNVEAIEVLLEAIAKAGYEPGKDCFIALDPASTELYKDGKYVFAGEGVTRTSDEMVEFWASLVDKYPIISIEDGLAEDDWEGWQNLTKRLGHKVQLVGDDLFVTNTERLSRGIEMGAANAILIKVNQIGTLTETLEAIEMAKKAGYTAVVSHRSGETEDTTIADIVVAVNAGQIKTGAPSRTERVAKYNQLLRIEEELDAAALYPGLKAFYNLKK

SEQ ID NO: 28282 - protein, 306 aa, Moorella thermoacetica ATCC 39073
MKIARDVTQLIGQTPILRLNRLVEDGMEVYLKIEFFNPGGSVKDRIALSMITAAEADGRLKPGDTIVEPTSGNTGIGLAMVAAVRGYRLILVMPETMSIERRKLLAAYGAEFVLTPGNLGMKGAVDKANELVRENPGYFMPQQFENPANPAIHRQTTAREILEQMDGKVDAFVAGVGTGGTLTGVGEVLKKEIPGVRIVAVEPAASPVLSGGQPGPHKIQGIGAGFVPPVLRREVVDEIITVTNEDAMETARRLAREEGLLVGISSGAAAFAALQVARRLGRGKRVLAIAPDTGERYLSTELFKIG

SEQ ID NO: 28283 - protein, 459 aa, Moorella thermoacetica ATCC 39073
MSYQIAIIGGGPGGYVAAIRAAQLGAKVVVIEQDALGGTCLNRGCIPTKALLAGAAMVRGIKGAAAFGIDVEDYRVDYARLAARKDAVVKQLTGGIAYLFKKNKVDLIKGRGFLKGPGQIEVATADGTIENLQAENIILATGSEPALIKALGYNGRTVVTSTEALAWTEVPAELLIIGGGVIGCEFATLFATLGSKVTIVEMMPAILPMIDSEISRRFSMLLKKTGVEIKTKAQITEVKEAGGRVQATLADGQTINADKVLISIGRQFNTRGLGLEDAGITLGPKGEIVVDEYLRTSVPGIYAIGDVTNKIQLAHVASAQGLAAVTTIMGRPTKVNYDAVPSCIYTLPEIAGVGLTKEAAEGRGMKVRVGKFPFQASGKALCSGETDGMVKIIAEAESDRVVGVFIMGPHATELIAEGALAVNKGITAGELAATIHAHPTLSEAVMEAAEAVHGLSIHS

SEQ ID NO: 28284 - protein, 442 aa, Moorella thermoacetica ATCC 39073
MVDSREAILQKATDLGVKFIRLQFTDIFGVLKNVAITLDQLPKALNNELMFDGSSIEGFVRIEESDMYLRPDPSTFTIFPWKPNGDAVARLICDVYNADGTPFIGCPRGTLKRVIAEAEALGYTMNVGPEAEFFLFHTDATGRPTLETHDRAGYFDLTPVDLGEDARRDMVLTLQQMGFEIEASHHEVAPGQHEIDFKYADALRTADNIATFKFVVRTIAQRHGLHATFMPKPIYGIAGSGMHCNISLFRAGQNAFYDPDDDLQLSQVAYYFIGGLIAHARGMTAITNPTVNSYKRLVPGYEAPVYIAWSPQNRSPLIRIPAKRGLSTRLEVRHPDPSTNPYLAIAVMLKAGLDGIKNRIQPPAPINANIFDMEATRLRAEGIDLLPGTLDEALDALEKDPVIREALGPHIYQRFMEAKRIECEEYRTRVHQWEIEHYLTKF

SEQ ID NO: 28285 - protein, 463 aa, Moorella thermoacetica ATCC 39073
MTGEKIISLETALQAGRQETRDLYRRYINPGLATMLALLDFDKAFVRAEGMAVWDKDGKRYLDFLGGYGALNLGHNPPEVLAAVKEAMGRPNLLQASLNPLAAALAHNLAQVTPGDLERVFFSNSGTETVEGALKLARASTGREKIIYCQNSFHGKSFGSLSVTGRQKYQRPFGPLLPGCEAVPYDDLEALEAKLSRRDAAAFIVEPIQGEGGVIVPHDGYLKGARELCDRYGSLLIIDEIQTGFGRTGYLFACEHEGVVPDIMCLAKSLGGGVMPIGAYIARPAVWDRAYGGMDKALLHTSTFGGNSLATAAGLAALQSILDQDLAGRAAAMGRYFLERLRQLKEKYDLIKDVRGRGLIIGLEFNQPVGGLLDKLTRGKVNELAGEYFGSLVAGELMNKYQVITAYTLNNPNVIRLEPPLIVGEEEIDHVVNALEAVLRGHGFLGVTLSSTRTALGSLFKRK

SEQ ID NO: 28286 - protein, 296 aa, Moorella thermoacetica ATCC 39073
MNNSAILEGFTRGQGFLASSDDFAGARAVLAGIPFDATTSFRPGTRWGPRAIRSVSEVLEEYSPYLQRELTGVPFYDAGDLDLPPGRVEASLERMEAAADAIFAAARIPFFMGGEHLVSYPLIRAAYRHYPDLAVLHFDAHADLREDYLGERFSHATVMRLVAEEIGPDRLYQFGIRSGTWGEFAYGQEETNFFMDVITPPLAKLVPELVRRPLYVTIDIDVVDPAFAPGTGTPEPGGCPPGEIFKAIQILQGANVVAFDLVEVCPAYDQSDITAILAAKILREAILAWGGKNDQA

SEQ ID NO: 28287 - protein, 285 aa, Moorella thermoacetica ATCC 39073
MALRGIWFSELQTPDLAISVRLNQTLHHEKTPYQELAVVDTEAYGRMLLLDNIIQTTVKDEFFYHEMIAHVPLNTHPNPRTALVIGGGDGGVVREIVKHPSIEKVTLVEIDARVVANAREYLPEIACGLDDARVEIRFEDGIEHVRQRENTYDVIIVDSTDPIGPAVGLFSAEFYRNVYRALKADGVFVAQTESPIFNSRLIRRIQRDLKEIFPIARLYLTTVPTYPGGLWAFSLGSKKYDPLEVDWRQAPKVATRYYTPAIHQAAFSLPPFVQEFLEAPEEEEF

SEQ ID NO: 28288 - protein, 475 aa, Moorella thermoacetica ATCC 39073
MSKTPGEVLEMARKNNIQMVDLKFIDLPGTWQHFSVPLDEFDEGAFTSGVGFDGSSIRGFKTINESDMILVPDPDTAFIDPFCDVPTLSLVCNVYDPMTGQNYNRDPRFVAKKAEAYLKETGIADTSYWGPEAEFFILDHVRFDQSQYAGYYFLDSDEGFWNSGVEMNGHPNLGYRPRYKEGYFPVPPTDTLQNLRTEMVLLLKQMGIAVEAHHHEVATAGQGEIDMKYAPLTRMADQLMMFKYVVKNVAIKHNKTATFMPKPVFQDNGSGMHVHQSLWKGNEPLFYDANGYAGLSELALYYIGGLLKHAPVLTAFCSPTTNSFKRLVPGFEAPVNLVYSQRNRSAAIRIPMYSSSPAAKRIEYRPPDPSCNPYLAFAALLMAGLDGIKNKIHPGEPLDKDIYDLPPEEAARVKSLPDSLEEAIAALEKDHEFLLQGGVFDEDLINAWIEYKQKREINQIKLRPHPYEFVLYYDV

SEQ ID NO: 28289 - protein, 402 aa, Moorella thermoacetica ATCC 39073
MDNAAIVSRGEKYVMRTYGRYPMALVRGEGARVWDADGKEYLDFVSGLAVNSLGHCHPRVVEAIREQAGRLIHCSNLYWIEPQVELARLLVENSALDKVFFCNSGAEANEAAIKLARKYAKEHRGPESYEIITMRRSFHGRTLATLTATGQEKFHHGFAPLPPGFRYAPFNDLSSLRAAVGPRTCAVMLEPVQGEGGVYAANKDYLQAVRALCDDEGLLLIFDEVQCGLGRTGYLFAYQYYEVEPDILTLAKALAGGVPIGAMLAKERAASAFAPGDHASTFGGNPLATAAGVAAFKALLQEGLVENARVLGQYFYQQLEGLVREFPQLIEVRGRGLLLGVEIDGPAGEVVAACQERGLLINSLHGHVLRFLPPLIVTREDIDRAVTILKEALHEVLGQGQK

SEQ ID NO: 28290 - protein, 316 aa, Moorella thermoacetica ATCC 39073
MLVKERILVGRIYQNITQLIGGTPIVKLHRMNPSEAEVLVKLELFNPGGSIKDRIALAMIEDAEERGLLDKDTVIIEPTSGNTGIGLAMVAAARGYKLILTMPETMSQERRQLLKGFGAELVLTPGAEGMKGAIRRAEELAATYPRAFIPQQFENPANPAAHRHTTAAEIYDATDGQLDILVCGVGTGGTITGTGEVLKERIPGLQVVAVEPASSPVLSGGMAGPHKIQGIGAGFVPEILNIDVIDEIIQVTDEEAIDTARRLAREEGIMVGISSGAACWAALRLAARPENAGKRILAVLPDTGERYLSTSLFQEI

SEQ ID NO: 28291 - protein, 487 aa, Moorella thermoacetica ATCC 39073
MPQQHREFATHPALIFQDRRVTYGELVEWIGAYAGMFQAMGVQPGERVTICAPNCPEFIYSYLGAIQAGAIVVPLNLMLTRDEIAYIVKDAGCSTLVIHRAIVERLNLVPQMATALGLKHLVVLDETTAARAKAAPPATMVAAKEEDICVFLYTSGTTGRPKGAMLSHRNFLADIKAMDAVSNLGPEDNFLCVLPMFHSFAWTTSVLLPLYLGSTITIKESFQPKDTLKTLSEGDITVFCGVPSIYAVLWRLAEEGQFKSLKFAISGGAPLAAEIQRGFETKFAFPLVEGYGLSEAAPVVCLNPLDGVRKPGSIGIPLPGMEVRLVDDDDREVPRGEVGELVVRGPNVMAGYYNHPEETAAALRGGWLHTGDLARQDEDGYFYIVDRKKDLIILGGFNVYPREVEEVLLAHPAVLEAAVVGVGDPVKGETVKAYVVLKEGESADRRQLQDFLKEHLALYKIPRLFEFVPELPKSPTGKVMKKLLKTR

SEQ ID NO: 28292 - protein, 252 aa, Moorella thermoacetica ATCC 39073
MIGMALLEVNHVYKTYTDANRSLTVLDDISFSIAKGEFVCLVGPSGSGKSTLLRMVVGLIQPSRGEIFYRGQQVRGVMDKMAIVFQSFALMPWLTVMGNVALGLEAKGISRPEREALASKYIDKVGLDGFEEAYPRELSGGMKQRVGIARALTMEPELLCMDEPFSALDAFTAQNLREEVLDLWLDVTLPVKSVLMVTHGIEEAVFMADRIIVLSRRPARVLADVRVDLPRPRNMKDEAFARVTDKIYSLLF

SEQ ID NO: 28293 - protein, 437 aa, Moorella thermoacetica ATCC 39073
MYKAKRRLGLVFFPAFDWAISPTHPEREERLLYTQDQVFEEGILDIEGIREYRPRLASTGDVERVHICVPDVQSRTTESHLIAAGGAIVAAEAVLKGEVDKAFAIIRPPGHHSFRIVHGARGFCNINMEAIMLEYIRRHYGPKRIAIVDTDCHHGDGSQDIYWHDKDTLYISLHQDGRTLFPGTGFLNEFGGPNAFGYTLNLPLPPDTGEEGFLYALEHFILPVLAEFKPDLVINSAGQDNHYTDPITNMRFSAQGYARLNDRLQPDIAVLEGGYSIEGALPYVNAGIILALAGLDYSRVREPDYTPEKVAQSPRVSEYIARLCDESYQAWQQRDTLREEYIRGKKEISRRRRIFYDTEGLMETQQETTRVCHDCGGVTWIDSRTDQGRHILAIFIPRDACPRCQEEGHALFESSQTIDYPDGVFLQDRLEDKLFKK

SEQ ID NO: 28294 - protein, 495 aa, Staphylococcus aureus subsp. aureus MSSA476
MAVNVRDYIAENYGLFINGEFVKGSSDETIEVTNPATGETLSHITRAKDKDVDHAVKVAQDAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 28295 - protein, 501 aa, Staphylococcus aureus subsp. aureus MSSA476
MNFDWIKTRSDFDDDKPAVIDHAKQTSWTYQQLNARADNMAHYLTSQGVKKGDVIGIFAPNDIAILDLLFACFKTGAVFLPLNWRLNPKEIAAIVEDAQLKLLFYAEKHLSSLTDIDQNLLHMDIDVAQYDEIVNPDYHQPFQATPVEPQDLAALIYTSGTTGSPKGVMFSYESFVHNGANLELTYKFNSNYITIVSTPMFHVLGFNDTVLPVLMSGGTLILQRYFNGEELNDMIAQYHPTFIIMIPTMYYSTLRASNFNPENFKAMDYIIQGGSQPLPSIQAAFKQYGINIINGYGLTEAPLVLVNTPENSKRKPMSIGKAVMFVDARILDDNGEEVPTGEIGELAIKAKNVTPGYWNKPAETAKAFHGRYLLTGDLAKMDDDGDIFIIERKKELIITGGENVLPSEVENALAEHPLVDRCVVVGYDHPKYGESIAAAIILREDEPHYAEILDQHMRSRLAGYKVPRMYVPVTHMPLNSTQKPDKLAIRQMMNDKVSQTL

SEQ ID NO: 28296 - protein, 478 aa, Staphylococcus aureus subsp. aureus MSSA476
MTKLPRNFMWGGALAANQFEGGYDKGGKGLSVIDVMTSGAHGKARQITKSIDQNHYYPNHEGIDFYHRYKEDIALFNEMGLKCLRTSIAWTRIFPNGDEDVPNEEGLAFYDRIFDELIAQDIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 28297 - protein, 399 aa, Staphylococcus aureus subsp. aureus MSSA476
MYRYKPLLQSIHLPNGIKISNRFVLSPMTVNTSTKEGYITKEDLAYAARRSNSAGMQVTGAAYIEPYGQLFEYGFNIDHDACIPGLTNMASTMKQHGSLAIIQLAHAGRFSNQAILNFGKVYGPSPMTLHSPIEHDVIAMSHEKINSIIQQYRDATLRAIKAGFDGVEISIAQRLLIQTFFSTFSNKRTDHYGADSLKNRARLCLEVMRAVQEVIDKEAPDNFILGFRATPEETRGSDLGYTIDEFNQLIDWVMDVSNIQYLAIASWGRHIYQNTSRTPGDHFGRPVNQIVYEHLAGRIPLIASGGINSPESALDALQHADMVGMSSPFVTEPDFVHKLAEQRPHDINLEFSMADLEDLAIPHAAFKDIVKMMDYGEGLKKHTRDALRQLEQNYHDSSS

SEQ ID NO: 28298 - protein, 342 aa, Staphylococcus aureus subsp. aureus MSSA476
MMNNKVLVTGGTGFVGMRIISRLLEQGYEVQTTIRDLSKADKVIKTMQDNGISTERLMFVEADLSQDEHWDEAMKDCKYVLSVASPVFFGKTDDAEVMAKPAIEGIQRILRAAEHAGVKRVVMTANFGAVGFSNKDKNSITNESHWTNEDEPGLSVYEKSKLLAEKAAWDFVENENTTVEFATINPVAIFGPSLDAHVSGSFHLLENLLNGSMKRVPQIPLNVVDVRDVAELHILAMTNEQANGKRFIATADGQINLLEIAKLIKEKRPEIAQKVSTKKLPDFVLSLGAKFNHQAKEGKLLLDMNRNVSNERAKILLGWEPIATQKEAILAAVDSMAKYHLI

SEQ ID NO: 28299 - protein, 301 aa, Staphylococcus aureus subsp. aureus MSSA476
MITYDLIGNTPLVLLEHYSDDKVKIYAKLEQWNPGGSVKDRLGKYLVEKAIQEGRVRAGQTIVEATAGNTGIGLAIAANRHHLKCKIFAPYGFSEEKINIMIALGADVSRTSQSEGMHGAQLAARSYAEKYGAVYMNQFESEHNPDTYFHTLGPELTSALQQIDYFVAGIGSGGTFTGTARYLKQHHVQCYAVEPEGSVLNGGPAHAHDTEGIGSEKWPIFLERRLVDGIFTIKDQDAFRNVKSLAINEGLLVGSSSGAALQGALNLKAQLSEGTIVVVFPDGSDRYMSKQIFNYEENDYE

SEQ ID NO: 28300 - protein, 341 aa, Staphylococcus aureus subsp. aureus MSSA476
MIEFRQVSKTFNKKKQKIDALKDVSFTVNRNDIFGVIGYSGAGKSTLVRLVNHLEAASNGQVIVDGHDITNYSDKMMRDIKKDIGMIFQHFNLLNSATVFKNVAMPLILSKKSKTEIKQRVTEMLEFVGLSDKKDQFPEELSGGQKQRVAIARALVTNPKILLCDEATSALDPATTASILTLLKNVNQTFGITIMMITHEMRVIKDICNRVAVMEKGQVVETGTVKEVFSHPKTTIAQNFVSTVIQTEPSTSLIRRLNDEQVGDFKDYKIFVEETQVTQPIINDLIQICGREVKILFSSMSEIQGNTVCYMWLRFNMDQQFDDTAINQYFKEKNIQFEEVH

SEQ ID NO: 28301 - protein, 454 aa, Staphylococcus aureus subsp. aureus MSSA476
MAKKKVIFECMACGYQSPKWMGKCPNCGAWNQMEEIVEKAANPKHGVKTKELAGKVQKLNSIKHETTPRVLTDSAEFNRVLGGGIVSGSLVLIGGDPGIGKSTLLLQICASLSQKKKVLYITGEESLSQTKLRAERLDEDSSELQVLAETDLEVIYQTVKEEQPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVNNPSEMFLEERSTNVPGSTIVATMEGTRPLLIEVQALVTPTTFNNPRRMATGIDHNRLSLLMAVLEKKENYLLQQQDAYIKVAGGVKLTEPAVDLSVIVATASSFKDKAVDGLDCYIGEVGLTGEVRRVSRIEQRVQEAAKLGFKRVIIPKNNIGGWTYPEGIQVIGVTTVHEALSFALHS

SEQ ID NO: 28302 - protein, 494 aa, Staphylococcus aureus subsp. aureus MSSA476
MEKKNKQIDRGDLKQNLSEKFVWAIAYGSCIGWGAFILPGDWIKQSGPIAASIGIVIGTLLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 28303 - protein, 440 aa, Staphylococcus aureus subsp. aureus MSSA476
MKTYDLIVIGFGEAGKTLAKYAASTGQHVAVIEQSPKMYGGTCINIGCIASKTLVHDGLEGKSFEASYNRKNDVVNALNNKNYHLLADDNNIDVLDFKAQFKSNTEVNLLDQHDDIADSITAPHIIINTGATSVIPNIKGLDQAKHVFDSTGLLNINYQPKHLVIVGGGYIALEFASMFANLGSKVTVLERGESFMPREDQDVVAHAITDLENKGITLHTNVETTELSSDNHHTTVHTNVGNFEADAVLLAIGRKPNTDLALENTDIELGDRGEIKVNAHLQTTVPHIYAAGDVKGGLQFTYISLDDYRIIKSALYGNQSRTTDNRGGVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 28304 - protein, 302 aa, Staphylococcus aureus subsp. aureus MSSA476
MEQIMINHYVHFSRLVQGFWRANEWKMTAKELNYFINELVERGITTMDHADIYGDYQCESLFGNALDLSPELRNKIQIVTKCGIILPSKQFDFTNGHRYDLSSKHIVKSVEQSLINLNVDYLDSLLIHRSSSLMDPEQVADALTKLVKQGKLKSFGVSNFNHSQYQLLNQYIMKERLHISINQLELSPYHVDSLQDGTMDSMYQNHVQIMAWSPFAGGKIFDKEDIKAQRIMKVVQSIADKYGVSDTAVMIAWLVKIPHRIMPILGTSQLKRIDQAIEGLQLNLDDQSWFDIYTAIIGQDIP

SEQ ID NO: 28305 - protein, 319 aa, Staphylococcus aureus subsp. aureus MSSA476
MVKIVVSRKIPDKFYQQLSKLGDVVMWQKSLVPMPKDQFVTALRDADACFITLSEQIDAEILAQSPNLKVIANMAVGYDNIDVESATANNVVVTNTPNVLTETTAELGFTLMLAIARRIVEAEKYVEADAWQSWGPYLLSGKDVFNSTIGIYGMGDIGKAFARRLQGFNTNILYHNQSRHKDAEADFNATYVSFETLLAESDFIICTAPLTKETHHKFNAEAFEQMKNDAIFINIGRGQIVDETALIDALDNKEILACGLDVLANEPIDHTHPLMGRDNVLITPHIGSASVTTRDNMIQLCINNIEAVMTNQVPHTPVN

SEQ ID NO: 28306 - protein, 375 aa, Staphylococcus aureus subsp. aureus MSSA476
MKSKYEPLFDKVELPNGVELRNRFVLAPLTHISSNDDGTISDVELPYIEKRSQDVGITINAASNVSDVGKAFPGQPSIAHDSDIEGLKRLATAMKKNGAKALVQIHHGGAQALPELTPGGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 28307 - protein, 325 aa, Staphylococcus aureus subsp. aureus MSSA476
MKIFDYEDIQLIPNKCIVESRSECDTTIQFGPKKFKLPVVPANMQTVMNEKLAKWFAENDYFYIMHRFDEEARIPFIKHMQNSGLFASISVGVKKAEFDFIEKLAQEKLIPEYITIDIAHGHSDSVINMIKHIKNHIPDSFVIAGNVGTPEGVRELENAGADATKVGIGPGRVCITKIKTGFGTGGWQLAALNICSKAARKPLIADGGIRTHGDIAKSIRFGASMVMIGSLFAAHEESPGETVELDGKQYKEYFGSASEFQKGEHKNVEGKKMFVEHKGSLMDTLKEMQQDLQSSISYAGGKDLKSLRTVDYVIVRNSIFNGDRD

SEQ ID NO: 28308 - protein, 302 aa, Staphylococcus aureus subsp. aureus MSSA476
MQKNILKSGISLSELGLGCMSLGTDLKKAEQIIDCAVENGITYFDTADMYDKGINESVVGKALLKYQQRDDIVIGTKVGNRLTKDGSTKWDPSKSYIKEAVKGSLKRLGIDHIDLYQLHGGTIDDPLDETISAFDELKQEGIIRAYGISSIRPNVIDYYLKHSQIETIMSQFNLIDNRPESLLDAIHNNDVKVLARGPVSKGLLTSNSVNVLDNKFKDGIFDYSHDELGETIASIKEIESNLSALTFSYLTSHDVLGSIIVGASSVDQLKENIENYHTKVSLDQIKTARARVKDLEYTNHLV

SEQ ID NO: 28309 - protein, 428 aa, Staphylococcus aureus subsp. aureus MSSA476
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRNITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 28310 - protein, 285 aa, Staphylococcus aureus subsp. aureus MSSA476
MFKDFFNRTKKKKYLTVQDSKNNDVPAGIMTKCPKCKKIMYTKELAENLNVCFNCDHHIALTAYKRIEAISDEGSFTEFDKGMTSANPLDFPSYLEKIEKDQQKTGLKEAVVTGTAQLDGMKFGVAVMDSRFRMGSMGSVIGEKICRIIDYCTENRLPFILFSASGGARMQEGIISLMQMGKTSVSLKRHSDAGLLYISYLTHPTTGGVSASFASVGDINLSEPKALIGFAGRRVIEQTINEKLPDDFQTAEFLLEHGQLDKVVHRNNMRQTLSEILKIHQEVTK

SEQ ID NO: 28311 - protein, 389 aa, Staphylococcus aureus subsp. aureus MSSA476
MQQHSSKTAYVYSDKLLQYRFHDQHPFNQMRLKLTTELLLNANLLSPEQIVQPRIATDDELMLIHKYDYVEAIKHASHGIISEDEAKKYGLNDEENSQFKHMHRHSATIVGGALTLADLIMSGKVLNGCHLGGGLHHAQPGRASGFCIYNDIAITAQYLAKEYNQRVLIIDTDAHHGDGTQWSFYADNHVTTYSIHETGKFLFPGSGHYTERGEDIGYGHTVNVPLEPYTEDASFLECFKLTVEPVVKSFKPDIILSVNGVDIHYRDPLTHLNCTLHSLYEIPYFVKYLADSYTNGKVIMFGGGGYNIWRVVPRAWSHVFLSLIDQPIQSGYLPLEWINKWKHYSSELLPKRWEDRLNDYTYVPRTKEISEKNKKLALHIASWYESTRQ

SEQ ID NO: 28312 - protein, 492 aa, Staphylococcus aureus subsp. aureus MSSA476
MDFWLYKQAQQNGHHIAITDGQESYTYQNLYCEASLLAKRLKAYQQSRVGLYIDNSIQSIILIHACWLANIEIAMINTRLTPNEMKNQMRSIDVQLIFCTLPLELRGFQIVSLDDIEFAGTDITMNGLLDNTMDIQYDTSNETVVPKESPSNILNTSFNLDDIASIMFTSGTTGPQKAVPQTFRNHYASAIGCKESLGFDRDTNWLSVLPIYHISGLSVLLRAVIEGFTVRIVDKFNAEQILTIIKNERITHISLVPQTLNWLMQQGLHEPYNLQKILLGGAKLSATLIETALQYNLPIYNSFGMTETCSQFLTATPEMLHARPDTVGMPSANVDVKIKNPNKEGHGELMIKGANVMNGYLYPTDLTGTFENGYFNTGDIAEIDHEGYVMIYDRRKDLIISGGENIYPYQIETVAKQFPGISDAVCVGHPDDTWGQVPKLYFVSESDISKAQLIAYLSQHLAKYKVPKHFEKVDTLPYTSTGKLQRNKLYRG

SEQ ID NO: 28313 - protein, 429 aa, Staphylococcus aureus subsp. aureus MSSA476
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIQQTLKAADYAFSQMK

SEQ ID NO: 28314 - protein, 264 aa, Staphylococcus aureus subsp. aureus MSSA476
MQLYYLGPKGTFSYLACRQYFSEKETTFQPKSNLFEVIKAVADDDTSIGVVPIENSIEGTINIVADALAQQDVFAHGEIRLDINFALYGNGTDSISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 28315 - protein, 319 aa, Staphylococcus aureus subsp. aureus MSSA476
MRRLFSIGEALIDFIPNITNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 28316 - protein, 475 aa, Staphylococcus aureus subsp. aureus MSSA476
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPKKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 28317 - protein, 302 aa, Staphylococcus aureus subsp. aureus MSSA476
MTKTKAIDIIGAPSTFGQRKLGVDLGPTAIRYAGLISRLKQLDLDVYDKGDIKVPVVNIEKFHSEQKGLRNYDEIIDVNQKLNKEVSASIENNRFPLVLGGDHSIAVGSVSAISKHYNNLGVIWYDAHGDLNIPEESPSGNIHGMPLRILTGEGPKELLELNSNVIKPENIVLIGMRDLDKGERQFIKDHNIKTFTMSDIDKLGIKEVIENTIEYLKSRNVDGVHLSLDVDALDPLETPGTGTRVLGGLSYRESHFALELLHQSHLISSMDLVEVNPLIDSNNHTAEQAVSLVGTFFGETLL

SEQ ID NO: 28318 - protein, 335 aa, Staphylococcus aureus subsp. aureus MSSA476
MKMIGFEKPFKLEEGNLFKVYEQRKPTPENDDILVKVNSISVNPVDTKQRQMEVTQAPRVLGFDAIGTVEAIGPDVTLFSPGDVVFYAGSPNRQGSNATYQLVSEAIVAKAPHNISANEAVSLPLTGITAYETFFDTFKISHNPAENEGKSVLIINGAGGVGSIATQIAKRYGLTVITTASRQETTEWCEKMGADIVLNHKEDLVRQFKEKEIPLVDYIFCTYNTDLYYNTMIELIKPLGHITTIVAFNEDQDLNALKLKSITFTHEFMFARPIHRTPDMIKQHEYLEDITKNIESGHYQPTTTQVFEGLSPENLYQAHQLLEKQSMIGKLVINI

SEQ ID NO: 28319 - protein, 470 aa, Staphylococcus aureus subsp. aureus MSSA476
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 28320 - protein, 459 aa, Staphylococcus aureus subsp. aureus MSSA476
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVIAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 28321 - protein, 305 aa, Staphylococcus aureus subsp. aureus MSSA476
MFQKLSIFATKSFLVWMLVAAVIGFISPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFLSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 28322 - protein, 243 aa, Staphylococcus aureus subsp. aureus MSSA476
MIQLNNIHKSFNDVEVIKGIDLSVEQGEVVTLIGRSGSGKTTLLRMINALEIPTEGTVYVNGKTYTSKDKKSQIEVRKQSGMVFQSYNLFPHKTALENVMEGLITVKKLKKDEARGKSLELLEKVGLTHVKDQRPHALSGGQQQRVAIARALAMNPKVMLFDEPTSALDPELVNDVLKVIKDLANEGMTMVIVTHEMRFAKEVSNNIVFIHEGMIGEQEAPEEMFNRPKTEELRRFLNVINEE

SEQ ID NO: 28323 - protein, 452 aa, Staphylococcus aureus subsp. aureus MSSA476
MNYTQQLKQKDSEYVWHPFTQMGVYSKEETIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRKCKENGLMIRNLENVITFVPVLSMSNKEVKTMVRIFKKAVHNILDRKC

SEQ ID NO: 28324 - protein, 384 aa, Staphylococcus aureus subsp. aureus MSSA476
MISNKLANIPDSYFGKTMGRKIEHGPLPLINMAVGIPDGPTPQGIIDHFQQALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 28325 - protein, 447 aa, Staphylococcus aureus subsp. aureus MSSA476
MYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEITPGDFEKRVTFDLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDGSAALKICNYCFEHGVVIIAVAGNVLRFQPPLVITYEQLDTALNTIEDALTALEAGNLDQYDISGQGW

SEQ ID NO: 28326 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIEGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 28327 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLFHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 28328 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLYHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 28329 - protein, 422 aa, Candida tropicalis
MVWVIGLMKQVFISIVFGLTVEGLAISKLNDRGAAPGLMGNFFDKRSTPGVLSLELYVNRNHDDSNFTIGPHFVVNEYSKRDDYISVELYNEQVTYSANFTVGSNSQKQNVIVDTGSSDLWVVDSSANCQEKSGYSSDYCFSGGTYDPSSSSTIQELGKSFNIRYGDGSSSSGTWVKDTVGINGAIILNQQFGDVNSTSVSQGILGIGLDTNESTDTIYENFPINLKEQGFINTNAYSLYLNAPSATSGTIIFGGIDHAKYTGSLTTLPLTSNREFTIQTNSATVGTSTIDINTGLLLDSGTTLTYLPQSVVDSIANAIGGDITYNRPIGAYIWSCNRNGKVTYNFPQGLNIDIPYSDLAVPLYYSNGAVAGFCALGILYGENFNILGDNFLRHAYVVYNLDALTISLAPVVYTSDSNVTIV

SEQ ID NO: 28330 - protein, 221 aa, Gossypium herbaceum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVALFGLGAVGLAAAEGARVCGASRIIAVDVNPRRFEEAKRFGITEFVNPKDYDKPVQEVIVEMTGGGVDRSV

SEQ ID NO: 28331 - protein, 221 aa, Gossypium raimondii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 28332 - protein, 424 aa, Arabidopsis thaliana
MDFNAGVPMSSLSPLMNQDAMWQMNLSSDETMETGSYPERPGEPDCSYYIRTGLCRFGSTCRVNHPRDRELVIATARMRGEYPERIGHPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDIHSSEGNKGRRRRAFKQEKNKSFLIFQKRNL

SEQ ID NO: 28333 - protein, 327 aa, Triticum aestivum
DLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLVAEAWDAGGLYQVGQFPHWNVWSEWNGKYRDIVRQFIKGTDGFAGGFAECLCGSPHLYQAGGRKPWHSINFVCAHD

SEQ ID NO: 28334 - protein, 332 aa, Solanum tuberosum
DLPLKFPQRDLVIYEMHVRGFTNHESSETKYPGTYLGVVEKLDHLKELGVNCIELMPCHEFNELEYYSYNSVLGDSKFNFWGYSTVNFFSPMGRYSSAGLSNCGLGAINEFKYLVKEAHKRGIEVIMDVVFNHTAEGNENGPILSFRGIDNSVFYTLAPKGEFYNYSGSGNTFNCNNPMVRQFIVDCLRYWVTEMHVDRFRFDLASILTRSSSSWNAVNVYGNSIDGDVITTGTPLTSPPLIDMISNDPILRGVKLIAEAWDCGGLYQVGMLPHWGIWSEWNGKYRDMVRQFIKGTDGFSGAFAECLCGSPNLYQKGGRKPWNSINFVCAHD

SEQ ID NO: 28335 - protein, 484 aa, Acinetobacter sp. ADP1
MTLLDASIWNKKLFNGGWFESGQPYGVVEVATGEQLGQTGSASPTDVAQAAKEAQTAQRQWWALDYLERQAVFEKAVQIATEHQDELVNWLIRESGSLALKAQFEVKVSIQMLKNCIAFPQLDQGNILPSRNGKLSLAKRLPLGVVGVISPFNFPLYLALRAVGPALAFGNAVVLKPDERTAVCSGYAIARIFELAGLPKGLLHVLPGGADTGEALTLDPHIASIQFTGSTQVGRIIGANAGKTLKKVSLELGGKNSLIILDDADLDLAAENIAWGAFLHSGQICMTSGKILIHEKIYDALKARVIEKVKRFVVGNPLEQNVTIGPLINEKQSKRVEALVQAAVEHGATLEIGGKANGPFFEPSVLSQVQADNPIFSEEIFGPVAVLIPFASDEQAIELANMGDYGLSAGIISSNVGRAMQLGAQLNVGLLHINDQTVNDETINPFGGFGASGNATRIGGPANPDEFTQWQWMTIQAEAPHYPF

SEQ ID NO: 28336 - protein, 230 aa, Solanum tuberosum
SRVDKFSKSDIIVSPSILSANFSKLGEQVKAIEQAGCDWIHVDVMDGRFVPNITIGPLVVDSLRPITDLPLDVHLMIVEPDQRVPDFIKAGADIVSVHCEQSSTIHLHRTINQIKSLGAKAGVVLNPGTPLTAIEYVLDAVDLVLIMSVNPGFGGQSFIESQVKKISDLRKICAERGLNPWIEVDGGVGPKNAYKVIEAGANALVAGSAVFGAPDYAEAIKGIKTSKRPE

SEQ ID NO: 28337 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQKGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 28338 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEIAFAEVLTQIYNIVSKKAMETSDDGAASAVPSKGEKIDVGKDVSAMKKGGCCSS

SEQ ID NO: 28339 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEISFAEVLTQIYNVISKKAMETSDDGAASAVPSKGEKIDVGKDVSAMKKGGCCSS

SEQ ID NO: 28340 - protein, 478 aa, Gossypium hirsutum
MDSTSKSNAATSSKKDANNGQTLLLGRYEVGKLLGHGTFAKVYHARNVKSGDNVAIKVIDKEKILKSGLIAHIKREISILRRVRHPNIVQLFEVMATKSKIYFVMEYVRGGELFNKVAKGRLKEDVARKYFQQLISAVHFCHARGVYHRDLKPENLLLDENGDLKVSDFGLSAVSDQIRQDGLFHTFCGTPAFVAPEVLARKGYDAAKVDIWSCGVILFVLMAGYLPFQDQNIMAMYKKIYKGEFRCPRWFSPELIRLLTKLLDTNPETRITIPEIMEKRWFKKGFKHIKFYIEDDKLCSVEDDDNDVGSCSDQSSMSESETELETRKRVGTLPRPASLNAFDLISFSPGFNLSGLFEEGEEGSRFVSGAPVSTIISKLEEIAKVVSFTVRKKDCRVSLEGSREGAKGPLSIAAEIFELTPSLVVVEVKKKGGERGEYEDFCNRELKPGLKELMVEESQSSAAASLATSSSYLPSDTE

SEQ ID NO: 28341 - protein, 502 aa, Mentha x piperita
MYSIAFMLVLRKMDEIISHTLAFQALVSLILLISITKWLSNSPKNKNSSPPSPRKLPILGNLLQLGSLPHHNLRSMARKHGPIMLLHLGSVRPVSSRRRPRGNHENSRSRLRRPRGSRSAALQLQGRVGGYGEYWRQLKTICVVQLLSNKRVQSFRSVREEETELLMKKIGDSSGNVNLSHMFTQLTNDVVCRSAIGRKYGAGDENGEKFLEILREFLELLGAISIGDFVPSLWWINRINGFDRRVDRIAKEMDEFLEKVIHERLENPAAKAEENFVDILLEIYRNNSAGVSIDRDSIKAIILDVFAAGTDTTAVVLEWAMTELLRHPEIMKKLQSEVRQVVKDKHNITDDDIEKMHYLKAVMKETMRFHTPIPLLVPRVARNDVEVMGYDVPVGTMVMINAWAIGRDPTSWDEPEKFRPERFLNSSVDFKGLDFELIPFGAGRRGCPGTTFPMATLEFTLANLMQKFDWELPHECRELDMSERPGVAIRRVIPLLAIGTKM

SEQ ID NO: 28342 - protein, 403 aa, Kluyveromyces marxianus
MSYMNFDPKPLGDTNIFKPIKIGNNELKHRVVMPALTRMRAIAPGNIPNTEWAEEYYRQRSQYPGTLIITEGTFPSAQSGGYPNVPGIWSKEQLAEWKKIFNAIHENKSFVWVQLWVLGRQAWPEVLKKEGLRYDSATDDLYMGEEEKERALKANNPQHGITKEEIKQYIKEYVDAAKKAIDAGADGVQIHSANGYLLNQFLDPISNNRTDEYGGSIENRARFTLEVVDAVVDAVGAERTSIRFSPYGTFGTMSGGENPGIVAQYAYVIGELEKRARAGKRLAFIDLVEPRVTDPFLPEFEKWFKEGTNEFIYSIWKGPVLRVGNYALDPDQATLDSKKPNTLIGYGRSFIANPDLVYRLEKGLPLNKYDRNTFYTFTKEGYTDYPSYEESVAKGYKKEEKKY

SEQ ID NO: 28343 - protein, 380 aa, uncultured bacterium
YRFSISWPRIFPTGAGQPNQRGLDFYRRLIDGLHQRNILPVATLYHWDLPQALEDRGGWMQRDTALRFAEYADYLFRTIGGDVALWATHNEPFIQAFYGYGNGENAPGKRVPWKVLAVVHHLLLSHGLAVSAFRAVRPRPARSDMPSPQIGIVLMIWPQYPASDRPADHKAAQRIDGIMNRLFLEPLFCRRYPDDIIKHFARRFVFAPIRPGDLEIIGQPIDFLGINTYTRLFNTVNWREPFVMAKQVPGPLPKTAMGWEIYPDCIIEALQKARQYTSLPLYITENGAAFDDPAPSATDQVVEDPQRVAYLQAHIEACRRALALGIDLRGYFVWSLLDNFEWAKGYSKRFGIIYTDYATQRRVWKRSAYVYRDIIARNGL

SEQ ID NO: 28344 - protein, 211 aa, Salicornia herbacea
MPINRIAVGTTEDARHPNTLKAGLAEFISTLIFVYAGQGSGMAFAKLTAGAANTPAGLVAAAISHGFALFVAVAVGANISGGHVNPAVTFGAFIGGNITLLNGIVYWIAQLLGSTVACLLLKFSTGGLQTSAFALCEGETVWGAFVMEIVMTFGLVYTRIRNRIGPKEGQHRDHCAPTHGFNRRCPPSLSGGAFCGPPINPLFFFGPPLVI

SEQ ID NO: 28345 - protein, 168 aa, Lycopersicon esculentum
MLVYQDLLTGDELLSDSFPYKEVENGVLWEVQGKWVVQGAVDVNIGANPSAEGGCEDEGVDDQAVRVVDIVDTFRLQEQPAFDKKQFVTFMKRYIKNLTPKLEGETQEAFKKNIEAATKFLLQKIKDLQFFVGESMHDDGALVFAYYKEGSADPPFLYIAPGLKEIKC

SEQ ID NO: 28346 - protein, 477 aa, Pseudomonas fluorescens
SQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLSDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 28347 - protein, 458 aa, Pseudomonas putida
QQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 28348 - protein, 392 aa, Mycoplasma arthritidis
MKDDACLLKKGSIVTIKTDENSYKNLVGDDKVITVSYRMDKDMHVGAKVLLDDGKLVTIVKEIKPEIILVEVQNDHVLKTNKRVNIPGIDFSMPFMSPKDREDIIWGAKYGVDFIAASFVNSAKNVHEIREILKQANAEHIQICSKIESQTGIDNIDEIIEASDSIMIARGDLGLEIPYYEVPYWEKKIIAKCRKANKEVIVATQMLDSMEKTPLPTRAEISDVYWATELGASATMTSGETASGQYPVEAIKTMATINHRAEQEYFNEIATSCNCQCQPKCELGHVAKELKEKTKTGDFPYTIAISEDGKLLKKIAKYKPNTTVIALVSDPKIETAFGITFGIFCEKNGAKAIEKVIKDPKYLNEILASHFDIKKGQKFLVIKDGLISENSL

SEQ ID NO: 28349 - protein, 347 aa, Camellia sinensis
MKDSVASATASAPGTVCVTGAAGFIGSWLVMRLLERGYIVRATVRDPANLKKVKHLLDLPKADTNLTLWKADLNEEGSFDEAIEGCSGVFHVATPMDFESKDPENEVIKPTINGVLSIIRSCTKAKTVKRLVFTSSAGTVNVQEHQQPVFDENNWSDLHFINKKKMTGWMYFVSKTLAEKAAWEAAKENNIDFISIIPTLVGGPFIMPTFPPSLITALSPITRNEGHYSIIKQGQFVHLDDLCESHIFLYERPQAEGRYICSSHDATIHDLAKLMREKWPEYNVPTEFKGIDKDLPVVSFSSKKLIGMGFEFKYSLEDMFRGAIDTCREKGLLPHSFAENPVNGNKV

SEQ ID NO: 28350 - protein, 487 aa, Bacillus thuringiensis serovar konkukian str. 97-27
MWESKFVKEGLTFDDVLLVPAKSDVLPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLSEAEKILQKYKIEKLPLVDNNGVLQGLITIKDIEKVIEFPNSAKDKQGRLLVGAAVGVTADAMTRIDALVKASVDAIVLDTAHGHSQGVIDKVKEVRAKYPSLNIIAGNVATAEATKALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFVRMSGAGLLESHPHHVQITKEAPNYSL

SEQ ID NO: 28351 - protein, 469 aa, Bacillus thuringiensis serovar konkukian str. 97-27
MEKLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 28352 - protein, 454 aa, Bacillus thuringiensis serovar konkukian str. 97-27
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFMIEEFKNFFISEVAPEMIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTAHV

SEQ ID NO: 28353 - protein, 478 aa, Bacillus thuringiensis serovar konkukian str. 97-27
MRKTMSQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 28354 - protein, 473 aa, Bacillus thuringiensis serovar konkukian str. 97-27
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFIDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTNTTEVESL

SEQ ID NO: 28355 - protein, 449 aa, Bacillus thuringiensis serovar konkukian str. 97-27
MFFTQFFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMKDTPQSCGLPSIEEHTGEYPPDEKIKDRERELSAKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSVKQKQA

SEQ ID NO: 28356 - protein, 289 aa, Bacillus thuringiensis serovar konkukian str. 97-27
MLRDLFVKKKKYAAIPSEQVRKDVPDGVMTKCPKCKKIMYTKEVLKNLKVCVNCGYHHPMNAWERLDSILDEGSFREYDKEMVSLNPLEFPDYEEKLESDRKKTELNEAVVTGEGTIDDMLVVVAVMDSRFRMGSMGSVVGEKIARAVEKAYDLQVPFIIFTASGGARMQEGILSLMQMAKTSVALKKHSNAGGLFISVMTHPTTGGVSASFASLGDYNLAEPGALIGFAGRRVIEQTVREKLPEDFQTAEFLLEHGQLDAVVHRDDMRESLRKILEVHQGGEMAVWQS

SEQ ID NO: 28357 - protein, 479 aa, Bacillus thuringiensis serovar konkukian str. 97-27
MTTSNTYKFYLNGEWRESSSGETIEIPSPYLHEVIGQVQAITRGEVDEAIASAKEAQKSWAEASLQDRAKYLYKWADELVNMQDEIAEIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLVKEQVAKLSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 28358 - protein, 479 aa, Bacillus thuringiensis serovar konkukian str. 97-27
MSKVIFPKGFLWGGAIAANQVEGAYVEDGKGLTTVDLLPTGENRWDIMKGNIHSFTPVEGEFYPSHEAIDFYHRYKEDIALFAEMGFKALRVSIAWTRIFPNGDDEKPNEAGLQFYDNLFDELLKHDIEPVVTMAHFDVPIHLVEKYGSWRSRKLVDFFETYAKTIFNRYKDKVKYWMTFNEINMLLHLPFMGAGLAFKEGDNKKQIQYQAAHHQLVASALAVKACHEIIPDAKIGCMLAAGATYPYTCNPDDIQRAMEQDRESFFFIDVQARGAYPGYAKRFFTDNNVTIEMEKEDEAILKEHTVDYIGFSYYASRATSTDPEVLKSITSGNVFGSVENPYLEKSEWGWTIDPKGFRITANQLYDRYQKPLFVVENGLGAIDQLNDEDEVNDAYRIDYLEKHMIEMSEAIQDGVDIIGYTSWGPIDLVSASTGEMKKRYGYIYVDKDNEGKGSLKRSKKDSFNWYKEVIATNGGSLES

SEQ ID NO: 28359 - protein, 510 aa, Bacillus thuringiensis serovar konkukian str. 97-27
MNLVQSLAETAKKKGDKPAYIFMDQSVSYDQLNKMVTRFSSNLAEMGIGKGDNVALVVGNSPHFLVGLYGTMKAGATVIPVNPIYTADEMHYILQNGDVKTIIVLDVLLPVIQSLTTRLPSLENIIICETSSDFNHTETEKMKTFTRMVGAGDLTYEGPELDEEDVAVILYTSGTTGKPKGAMLTHKNLYSNASDVASYLQYTADDRVVAALPMFHVFCLTVAVNAPIVNGATILMLPKFSPKEVFRICRTYEPTIFAGVPTMYNYLYLFEEASAEDVKTLRLCISGGASMPVALLQNFEKRFDVIVSEGYGLSEASPVTCFNPLDRPRKPGSIGTNIWHVENKIVNELGEEVPVGAVGELIVRGPNVMKGYYNAPEDTAATLKDGWLYTGDLAKMDEEGYFYIVDRKKDIVLVGGYNVYPREVEEVLYMHESVAEVVVIGVPDENLGEAVRAYVVLKQTNVTEEELMHYCALHLAKYKVPKSIEFLTELPKNTTGKLLRRALREKAMQV

SEQ ID NO: 28360 - protein, 431 aa, Bacillus thuringiensis serovar konkukian str. 97-27
MGKIHTRKLFICFCLAVVLFVPIHTFADEKREWRDEVIYSIMIDRFNNGEPKNDKQLEVGNLEGYQGGDIRGIIKRLDYIKEMGFTTVMLSPLFESVKYDGVDVRNFQKVNEHFGTENDVKELVQEAHAKGMKVIFQFPLGENEQQVIDSMKWWVKEVDLDASYVMHSEKKSPAFWDDVQKDMQVIKKDFRVMTKEDSEYNEKIVESFSKADVSVKSLYDVSKKDEEFIIFLDNQDTKRFARIAKENMNYPPSRLKLALTYLLTSPGIPNFYYGTEIALDGGDTPDNRRLMDFKSDEKFMQHITKLGELRQTRPSLRRGTFELLYDKNGMSVLKRKYKGEVTLVAINNTKETQKVALPASTIGEKQELRGLLEDEIIREENGKFYLVLKREESNVYKVNRETGVNWLFISLIVGVNVLFITFLIAVKKRRK

SEQ ID NO: 28361 - protein, 258 aa, Bacillus thuringiensis serovar konkukian str. 97-27
MGVERIKAAFENGKKAFIPYVMGGDGGLEILKERIRFLDEAGASIVEIGIPFSDPVADGPTIQRAGKRALDSGVTVKGIFQALIEVREEVQIPFVLMTYLNPVLAFGKERFIENCMEAGVDGIIVPDLPYEEQDIIAPLLREANIALIPLVTVTSPIERIKKITSESEGFVYAVTVAGVTGVRQNFKDEIHSYLEKVKSHTHLPVVAGFGISTKEHVEEMVTICDGVVVGSKVIELLENEKREEICEFIQATKQKEEA

SEQ ID NO: 28362 - protein, 455 aa, Bacillus thuringiensis serovar konkukian str. 97-27
MSVSSIVNKQKAYFYNGHTRSVEVRKNNLKKLYEGIQRFEEEIFQALKLDLNKSVHESFTTEVGYVLKEISFQLKHISSWSKPKRVRTALTHFGSKGKVVPEPYGVTLIIAPWNYPFQLAIAPLVGALAAGNTIVLKPSELTPNVSKVITRMLAELFQEELVAVVEGGVEESTALLKEPFDYIFFTGSVGVGKVVMEAAAKQLTPLTLELGGKSPCIVHKDAKVDVTARRIVWGKFLNAGQTCVAPDYLYVHASVKEQLIEALQHEIAEQYGNEPLQNDNYVRIVSERHFERLCRFLQDGQVAIGGNYKRDTLHIEPTVVTDITWQNAVMEDEIFGPILPIIEYENIEEVIDTIQQHPKPLALYVFSEDKEVQKKVTSNISYGGGCVNDVVYHLATPYLPFGGVGSSGLGSYHGEESFRTFSHYKSILAQSTAFDMKIRYSSTKSALKFIRKLLK

SEQ ID NO: 28363 - protein, 305 aa, Bacillus thuringiensis serovar konkukian str. 97-27
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGTGKKVLCVAPDTGERYLSMGLFE

SEQ ID NO: 28364 - protein, 474 aa, Bacillus thuringiensis serovar konkukian str. 97-27
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERMDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 28365 - protein, 322 aa, Bacillus thuringiensis serovar konkukian str. 97-27
MKVLEAISNIAVKYFAFWVICIATIAYFIPAPFLGLNSYITILLGVVMFGMGLTLKAVDFKIIATKPLPVIIGVCAQFIIMPLVAYVLAYVMNLPAELAAGLVLLGAVPGGTASNVMVYLAKGNLALSIAMTSLSTLLAPIATPLILLLLAGQWMPVNPMSMFLSIVQVIIIPIILGLVVKKFFPKTVTKGMTVIPFISVLAIIIIVSAVVSANVSSITSSGLLIFIAVMLHNAFGFLLGYITAFILKLDEGTRRAISIEVGMQNSGLGVALATAHFGPAAALPSVLAAVWHNIAGPILATIWSKNAKNTFSDENVSVNIEK

SEQ ID NO: 28366 - protein, 332 aa, Bacillus thuringiensis serovar konkukian str. 97-27
MNPLIFKGNRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 28367 - protein, 487 aa, Bacillus thuringiensis serovar konkukian str. 97-27
MTVQTAQIVKNYIGGEWVESISTKMEAVYNPATGEVIAQVPLSTKVDVEQAVLAANEAFKSWSKTAVPKRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVERLVAEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 28368 - protein, 494 aa, Bacillus thuringiensis serovar konkukian str. 97-27
MLTKNIELKPKVKAFLNEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGSAIVNHHDIDKVAFTGSTVTGKYIMRQSAETIKHVTLELGGKSPNIILEDADLKEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 28369 - protein, 447 aa, Bacillus thuringiensis serovar konkukian str. 97-27
MTCHDVENETKEKKDLKWWQLSLIGIGCTIGTGFFLGSSIGIKIGGSSIILILILTGFTTYIVFEALAKMAVEDPQKGSFRIYSKKAFGNWAGFSHGWTYWCSELLIMGSQLSALGIFSRYWFPKIPLWIFAAIYGVAAILIIFIGVKIFERLEKWMAIIKIAAIIGFIVIAILVILGFIKGGLYKAQIPRDFKDWFPNGLKGTWSSLIYAFYAFGGIEIMGLMTIRLKDPKDAQKSGRVMLMILTIIYVVSLGLAIMMVPLNQFNTKESPFVIALQDYNLPYVPFILNVVLILAGFSTLVGSLFAVTSVLMNLAEEGDAPAMFAKKNKKNISFPALILIIIGLGASILSALLLPKNIYEYVTTAAGLMLLYTWSLILLSFWRLMNPKGWMQIKSIIGLIMIALAVSGTLLQKTTRFGFLVSLLFLGIVIIVTIIVHFVSKKRNTAI

SEQ ID NO: 28370 - protein, 109 aa, Bacillus thuringiensis serovar konkukian str. 97-27
MNSQRQGYAGWWQGGHGGWPGGHGGWQGGHGGWQGGHGGWQGGHGGWQGGHGGWQGGHGGWQGGHGGWPGGHGGWQGGHGGWQGGHGGWPGGHGGWQGGHGGWQGGHGY

SEQ ID NO: 28371 - protein, 159 aa, Bacillus thuringiensis serovar konkukian str. 97-27
MWKTTDLCDEFEKDLQICRQSFRSFGKKEQFHGKIATVKVKDDNVLVKEGLQTLPEGTVLVVDGGASTNCALLGDNLAAIAEERKLAGIIVNGYVRDSSELKNINIGILALGTMPNRSVKEGKGERNISLQFGQVEWKPDEYVYVDEDGVIISEKSLHR

SEQ ID NO: 28372 - protein, 472 aa, Bacillus thuringiensis serovar konkukian str. 97-27
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGTEMKDHPFKMPFAPVTNYLTIAFLIMVLIGMWFNDDTRISLVVGIVFLAIVTISFYAFGIGKRPPLDVPNDQEISSK

SEQ ID NO: 28373 - protein, 323 aa, Bacillus thuringiensis serovar konkukian str. 97-27
MEHGHYLKKNAKFIDREVTKWSEMIKDWEEGVEIFGAALIGAPLSKPSISHSGASFAPKTIRAMLDAYSTYAITEEHDMKESVLYDCGDITMHVTNIKESHNRIAKTVGHVTKVNPNMIPIVLGGDHSISFPSITGFANSKGKVGIIQFDAHHDLRNLEDGGPSNGTPFRSLLENDVITGKQLVQIGIRNFSNARAYHEYAKEQDVTVYTMKDVREREIKDIIIESIEVLRKQGVTSIYISLDMDVLDQAFAPGCPAIGPGGMDSTTLLDAIELLGNEPLVQGMDIVEIDPTLDFRDMTSRVAAQVIMSFLLARETIRKQVSI

SEQ ID NO: 28374 - protein, 429 aa, Bacillus thuringiensis serovar konkukian str. 97-27
MKGILERTFKLGLHETSPKQEVLAGVTSFFTIVYIMIVNASILSDAGIPLEAGILATVFSSFVGCLLMAFWANAPAILVPGMGVNAFFTYTAVHTLGLTWQEALAAVFISGIIFAIAAFTPIARVLSVSIPKSLKEAITVGIGLFLAFIGLQKSGLVVSNPNTAVAMGKLSNPVVLATVLTLIVALVLFIRNVRGNFLWTIAIGTGIAWLFGLVDTSQVGNSSFSFANYGDVFGAMSFGKLSSLPFWIATFSLSMVLIFENMGLLHGLLEDDRKFPRAYQANAISAMTCGLFGTSPTVSTVESAAGITAGGKTGLTSIVTGLLFFASLFALPFVKLIPDSAIAPILIIIGGLMITSIQQIPLNDFSEGFPAFLIIVMIPLTYSIADGIAFGFIAYPILKVALGKRKEVAPSMYIITCLFLAMFVLHAIG

SEQ ID NO: 28375 - protein, 429 aa, Bacillus thuringiensis serovar konkukian str. 97-27
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTAHSDADIEATIAAAEIAMSKLKA

SEQ ID NO: 28376 - protein, 175 aa, Bacillus thuringiensis serovar konkukian str. 97-27
MNIEIKDTLISEEQLQEKVKELALQIERDFEGEEIVVIAVLKGSFVFAADLIRHIKNDVTIDFISASSYGNQTETTGKVKLLKDIDVNITGKNVIVVEDIIDSGLTLHFLKDHFFMHKPKALKFCTLLDKPERRKVDLTAEYVGFQIPDEFIVGYGIDCAEKYRNLPFIASVVTE

SEQ ID NO: 28377 - protein, 283 aa, Bacillus thuringiensis serovar konkukian str. 97-27
MIRVGYLGPEATFTNMAVSRFFPEAEHVPYRTIPDCMDAAANGNVDYAVVPLENAIEGSVNITVDYLVHEQPLSIVGEITVPIQQHLLVHPQYAEVWEEVYAVHSHPHAIAQCHKFLNEELKGVTARDMTSTSAAAQYVKEHPEEKIAAIANEAAAEKYGLTIVRRSIHTHKNNHTRFLVLHKKKKAILPNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 28378 - protein, 170 aa, Bacillus thuringiensis serovar konkukian str. 97-27
MAQIRIHEINTRIENEVEVSKFLQEEGVLYEKWNISKLPTHLKENYSLTDENKAEILAVFSKEIADVSARRGYKAHDVISLSNSTPNLDELLINFQKEHHHTDDEVRFIVSGHGIFAIEGKDGTFFDVELDPGDLISVPENARHYFTLQDDRQVVAIRIFVTTEGWVPIY

SEQ ID NO: 28379 - protein, 394 aa, Bacillus thuringiensis serovar konkukian str. 97-27
MNKKSIRDVDLKGKRVFCRVDFNVPMKEGKITDETRIRAALPTIQYLVEQGAKVILASHLGRPKGQAVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFSQGTKAVGQALADAEGTYSVIGGGDSAAAVEKFGMADKMSHISTGGGASLEFMEGKELPGVVCLNDK

SEQ ID NO: 28380 - protein, 332 aa, Bacillus thuringiensis serovar konkukian str. 97-27
MKAMIIDKYGKVPMRMAEVPIPEINEHEVLAEIHAASINPIDFKIRDGKVKMLLKYEMPLILGNDFSGVITKVGSKVTRFKVGDEIYARPRKNKIGTFAEYIAIHEDDIALKPKNLSFEEAASIPLVGLTSYQALHDIMHLQKGQKILIHAGSGGVGTFAIQLAKIMGATVTTTASEAGSDLVKSLGADQIINYKTEKFEEILKDYDAVFDTIGGTTLEKSFDIIKSGGNIVSVSGIPNARFGKEFGSGFFKTFLFSLASKKLTALEKKHNAQYSFLFMKPSGDQLRIIANYIEAGKIKPVIDRVFPFEDAQKAMEYSEAGRAKGKIIVKIK

SEQ ID NO: 28381 - protein, 339 aa, Bacillus thuringiensis serovar konkukian str. 97-27
MISFNNVSKVYESGGQSVHAVEDVTLSVEKGEIFGIIGFSGAGKSTLLRLVNMLERPTAGTISIDDKDITSLSTKELRKLRQRIGMIFQSFNLFNSRTVFGNIAYPLKLAKVPKNEIKERVNELLKFVGLEDKANNYPEQLSGGQKQRVGIARALATSPDILICDEATSALDPETTTEILNLLKKVNREYNLTILLITHEMHVVKEICHRVAVMEKGKVIEEGKLFDVFTQPKTKTTQNFVRSVINDHLPESVLAKIQNGGQIYRLTFTGEETGQPVLSYIAKNYNVDVNVLYGNIIELQNVLFGNLLVELQGEQREIQKALQHLRLQVQLKEVEAHAS

SEQ ID NO: 28382 - protein, 331 aa, Bacillus thuringiensis serovar konkukian str. 97-27
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKRDFNGNYFLYHLLGAENVIVVPNGADLMEEMHKVAKEVSEKGNTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 28383 - protein, 400 aa, Bacillus thuringiensis serovar konkukian str. 97-27
MMTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKENDFLPNLELIPEEIADKAKMMILNFPGNPVPAMAHEDFFKEVIAFAKKHNIIVVHDFAYAEFYFDGNKPISFLSVPGAKEVGVEINSLSKSYSLAGSRIGYMIGNEEIVGALTQFKSNTDYGVFLPIQKAASAALRYGAAFCEKNRAIYQERRDTLVDGFRTFGWNVDKPAGSMFVWAEIPKGWTSIDFAYALMDRANVVVTPGHAFGPHGEGFVRIALVQDKEVLQQVVENIRNSGIFALEKVDELVKN

SEQ ID NO: 28384 - protein, 511 aa, Bacillus thuringiensis serovar konkukian str. 97-27
MKKRALVSVSDKTGVVEFVKGLLEQGIEVISTGGTKKLLEKNGLQVIGISEVTGFPEIMDGRVKTLHPNIHGGLLAVRDNETHVAQMNELGMEPIDFVIVNLYPFKETIAKPDVTFADAIENIDIGGPTMIRSAAKNHKFVSVIVDPVDYDVVLAELKENGEVKEETKRKLAAKVFRHTAAYDALISNYLTEQMGEESPETLTVTFEKKQDLRYGENPHQKATFYKAPFAVTSSVAYAEQLHGKELSYNNINDADAALSIVKEFTEPAVVAVKHMNPCGVGVGTDIHEAYTRAYEADPVSIFGGIIAANREIDKATAEKLHEIFLEIIIAPSFSKEALEVLQSKKNLRLLTVNIEKATSASKKLTSVQGGLLVQEEDTLSLDESTISIPTKREPSEQEWKDLKLAWKVVKHVKSNAIVLAKDDMTIGVGAGQMNRVGSAKIAITQAGEKAQGSALASDAFFPMPDTVEEAAKAGITAIIQPGGSIRDEDSIKVADTYGIAMVFTGVRHFKH

SEQ ID NO: 28385 - protein, 396 aa, Bacillus thuringiensis serovar konkukian str. 97-27
MIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTARRWAYDVKKVEANRAEIIVCEDNFHGRTMGAVSMSSNEEYKRGFGPMLPGIIVIPYGDLEALKAAITPNTAAFILEPIQGEAGINIPPAGFLKEALEVCKKENVLFVADEIQTGLGRTGKVFACDWDNVTPDMYILGKALGGGVFPISCVAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVLS

SEQ ID NO: 28386 - protein, 459 aa, Bacillus thuringiensis serovar konkukian str. 97-27
MRILVVIGGGPAGYVAAITAAQNGKEVILIDEANLGGTCLNVGCMPTKSLLESAEVHDIVRKANHYGITLNNGSISIDWKQLQARKSQIVTQLVQGIQYLMKKNKIKVIQGKAKFETDHRVRVTNGNKEDVVDGDQFIIAAGSEPAELPFAPFDGKWILNSSHAMSLENIPKSLLIVGGGVIGCEFASIYSRLGTKVTIVEMAPQLLPGEDKDIAQILKEKLESDGVEIFTGAALKGLNNYKKQASFEYKGSIQEANPEYVLVSVGRKPRAQGLDLEKAGVQFSNKGISVNEHMQTNRSHIYAAGDVIGGIQLAHVAFHEGTTAALHASGEDVKVNYHAVPRCIYTAPEIASVGLSEKLAREQYGDILIGEFPFSANGKALIIGEQTGKVKVIVEPKYQEIVGISIIGPRATELIGQGTVMIHTEVTADIMRDYIAAHPTLSEAIHEALLQAIGHAVHA

SEQ ID NO: 28387 - protein, 297 aa, Bacillus thuringiensis serovar konkukian str. 97-27
MKKEISVIGVPMDLGQMRRGVDMGPSAIRYAGVIERIEEIGYDVKDMGDICIEREKEVDVNTSLRNLTQVATVCNELASKVDHIIEEGRFPLVLGGDHSIAIGTLAGVAKHYKNLGVIWYDAHGDLNTEETSPSGNIHGMSLAASLGYGHPTLVDLYGAYPKVKKENVVIIGARALDEGEKDFIRNEGIKVFTMHEIDRMGMTAVMEETIEYLSHTDGVHLSLDLDGLDPHDAPGVGTPVIGGLSYRESHLAMEMLAEADIVTSAEFVEVNTILDERNRTATTAVALMGSLFGEKLK

SEQ ID NO: 28388 - protein, 245 aa, Bacillus thuringiensis serovar konkukian str. 97-27
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKTLKKGEFPLTECLVDTEKRVLAYWHSEIAPKLKDGNKVIISSHGNTIRSLVKYLDNLSSDGVVSLNIPTSIPLVYELDENLRPIRHYYLSMDGEVPEGEIPKHITF

SEQ ID NO: 28389 - protein, 458 aa, Bacillus thuringiensis serovar konkukian str. 97-27
MAKKKTKFTCQECGYQSPKYMGKCPGCGQWNTLVEEMEPVVSSRRLNYANAIQTEVTKPRRLTEVETKSEARIETKFQEFNRVLGGGIVDGSLVLIGGDPGIGKSTLLLQISSQLADSSYDVLYISGEESAKQIKLRADRLHVNGSNLFVVSETDLQRIATHIEEVNPAFVVIDSIQTIHLPEVTSAPGSVAQVRECTAELMKLAKTKGIPIFIVGHVTKEGAIAGPRMLEHMVDAVLYFEGDRHHTYRILRAVKNRFGSTNEMGIFEMKELGLAEVLNPSEIFLEERPVGVAGSTVVASMEGTRPVLVEIQALISPTSFGNPRRMATGIDHNRVSLIMAVLEKRTGLLLQNQDAYLKVAGGLKLDEPAIDLAVALSIASSFRDKSTAPTDAVIGEVGLTGEIRRVSRIEQRVQEAAKLGFQRAIIPRKNLGGWTIPDGIEVVGVSNLGEALRLTLGG

SEQ ID NO: 28390 - protein, 453 aa, Bacillus thuringiensis serovar konkukian str. 97-27
MKETNSFSQKLKQFALLFFPIFVTQMSLFAMSFFDTTMSGHASPIDLAGVAIGTSIWIPVSTGLTGILMATTPIVAQLVGSKKKEDVPHVVIQAVYLAICASFVVILIGLFTVTPILNGMRLEEPVERIAAQFLSIIAIGIIPLFTYTVLRGFIDALGKTRTTMIITLLSLPINVVLNYVLIFGNFGFPKLGGVGAAIASAATYWCILIITVMIIRTKEPFASFNIFKQLYRPSLSSWKEFLKLGVPIGFAIFFETSIFAAVTLMMSNFSTTTIAAHQAAMNFASLLYMTPLSLAMAMTIAVGFEVGAKRYNNAKQYGFIGIGLALAFALLYSILLYFFDDEIASIYTTDIQVHHLAKEFLIFAILFQISDAIATPVQGALRGYKDVNVALIMTLIAYWVIGLPLGYILATYTDWAAKGYWIGLIIGLAFGATFLLIRLFQVQRKYTTQNSRS

SEQ ID NO: 28391 - protein, 444 aa, Bacillus thuringiensis serovar konkukian str. 97-27
MNYVIIGGDAAGMSAAMQIVRNDENANVVTLEKGEIYSYAQCGLPYVISGAIASTEKLIARNVKTFRDKYGIDAKVRHEVTKVDTEKKIVYAEHTKTKDVFEFSYDRLLIATGVRPVMPEWEGRDLQGVHLLKTIPDAERILKTLETNKVEDVTIIGGGAIGLEMAETFVELGKKVRMIERNDHIGTIYDGDMAEYIHKEADKHHIEILTNENVKAFKGNERVEAVETDKGTYKADLVLVSVGVKPNTDFLEGTNIRTNHKGAIEVNAYMQTNVQDVYAAGDCATHYHVIKEIHDHIPIGTTANKQGRLAGLNMLDKRRAFKGTLGTGIIKFMNLTLARTGLNEKEAKGLHIPYKTVKVDSTNMAGYYPNAKPLYLKLLYRSDTKQLLGGQVIGEEGVDKRIDVIAMALFNKMSIHDLEDVDLSYAPPYNSVWDPIQQAARRAE

SEQ ID NO: 28392 - protein, 345 aa, Bacillus thuringiensis serovar konkukian str. 97-27
MKAVVVNKNSKANIEVVEKELRPLHSGEALVDVEYCGVCHTDLHVANHDFGNTDGRILGHEGVGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGSADKIIQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKQHNCDCK

SEQ ID NO: 28393 - protein, 405 aa, Bacillus thuringiensis serovar konkukian str. 97-27
MSDWFQLDKEYMMSTYCRTKIAIERGEGCKLYDVDGKEYLDLFSGVGVNVLGYNHPKIVQTTMDQVTKSLHLPFHFLNPVAIEYAKKLVDCSLKNGKVFFTNSGTEATETTLKLIDKYRAITNEEREGIVVLKNSFHGRTLGALHFTRQESVYQNFPTTSIPVYEVERENIEQLEETIIDENPIAILLEPVLGSGGIYPLSREYLHGVQNLCDKYNVIFIVDEVQSGMGRTGKLFAYQNFNITPHIIQIGKGAGGGIPLGGIIVGEKLCDVFAPGDHGTTFAHSSMGTALGLTVLNTLLDDGLMQEAYEMSLYLNDKLQDIQKENSYYIEEVRHAGMMFGISLNDTNENVKKLQVELMEKGILVDVTQGNIIRLLPPYIITKEEIDTFITQFIFCIDKVAAVVSA

SEQ ID NO: 28394 - protein, 326 aa, Bacillus thuringiensis serovar konkukian str. 97-27
MIKDSSVQVEGQEKVYLDQWVAHYRTYAAKGRSASYIPALGEINVSQLGICIVKPDGTMIKAGDWEVPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSKKDVPFLDGCGIGIYGPAIDEYGNSLPGIMLLEHIAKEWDLSIF

SEQ ID NO: 28395 - protein, 1065 aa, Bacillus thuringiensis serovar konkukian str. 97-27
MDKKVSAIPQPKTYGPLGNLPLIDKDKPTLSFIKLAEEYGPIFQIQTLSDTIIVVSGHELVAEVCDETRFDKSIEGALAKVRAFAGDGLFTSETDEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDDVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKKHEIKKQVQKTPSIIGADNLSLLVLYGSDTGVAEGIARELADTASLEGVQTEVVALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKQSMWSDAMKAFGLELNKNMEKERSTLSLQFVSRLGGSPLARTYEAVYASILENRELQSSSSERSTRHIEISLPEGATYKEGDHLGVLPINNEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMKVGEAHLYFGCRHPEKDYLYRTELENDERDGLISLHTAFSRLEGHPKTYVQHVIKEDRIHLISLLDNGAHLYICGDGSKMAPDVEDTLCQAYQEIHEVSEQEARNWLDRLQEEGRYGKDVWAGI

SEQ ID NO: 28396 - protein, 309 aa, Bacillus thuringiensis serovar konkukian str. 97-27
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMDRILHFVREITDNPTINYSSKVANSELETAYLNRSLCYYMKQNGIIDCDIEELMDLYTRQCAVEVNCIDLARIGLIFAMDGYDPYKEKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 28397 - protein, 434 aa, Bacillus thuringiensis serovar konkukian str. 97-27
MVVEFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIENYDAAQDTDGEMFGKFFKLMLQEGVNLAPSKYEAWFLTTEHTKEDIEYTIEAVGRAFAALADNK

SEQ ID NO: 28398 - protein, 473 aa, Bacillus thuringiensis serovar konkukian str. 97-27
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 28399 - protein, 244 aa, Bacillus thuringiensis serovar konkukian str. 97-27
MISIQHLQKSFGDNTVLKHIDLTVEKGEVVVIIGPSGSGKTTFLRCLNVLETPNAGNIRIGDKELNFSQKVTKKDIVNLRTQTGMVFQHHNLFPHLTALQNVMEGLVTVKKMGKEEAKKKANYFLEKVGLADKVDLYPFQLSGGQQQRVGIARALAMEPEVLLFDEPTSALDPELVQEVLKVMKELAKEGMTMVIVTHEMRFAHQIANRVIFMDGGVVVEQGTPEDVFTNPKEERTKKFLQMLQ

SEQ ID NO: 28400 - protein, 463 aa, Bacillus thuringiensis serovar konkukian str. 97-27
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQKRQKLSYKMPLYPLSSYFSLAFLVLVLGIMAYSEDTRIALIVGPIWLIGLAIVYYMKGFHKIDETPNSKIS

SEQ ID NO: 28401 - protein, 430 aa, Bacillus thuringiensis serovar konkukian str. 97-27
MFQLQKYNTSVKQEFLAGITTFFTFAYILVINPKILSDAGVPFDQAFTATIIATVVGTIGMAIFANYPIVIAPAMGMNAYFAYSVVQKAEGITYVIAFSAVFVTGIIFLLLSFTSFRQKLILAIPDSLKHAIAGGIGLFIAFIGLRLSGIIVDHPSNLVTIGDFHSPAVILTLIGLILAAVLMALRVSGALFISMIVTGVIAFFTGQLKFTDKIVAMPHLPEGIIVSNPINAFSDVIEYGLYGVVFSFLLVLLFDTTGALLGLIKQAGLITDNTEKRFGKAFIADAIGGTTGSIFGTSPTAATIESSAGIAAGGKTGLTGIVVVGLTIITAFFSPVIASLSSVAAITAPSLIIVGSLMAQSIRDINWNEFEDALPAFLIFVGIPLTSSIANGIAIGFLVYPVLKIVKGKGMEVHPLLYLFTILFGCHLFL

SEQ ID NO: 28402 - protein, 437 aa, Bacillus thuringiensis serovar konkukian str. 97-27
MLSIKGQKWRNWTGNVEGTPHYTMYPESIQDVVEVIELARKKGKKIRVVGSGHSFTPLVQTEEILVSLDEMKGIVNIDTEKMIAEVWAGTKLHELGKLLEEKGYAQENLGDIDSQSIAGAISTGTHGTGITFGSLSTQVIEITAVLSTGETIVCSETENVEYWRAFQLSLGMLGIIVRIKLNIIRAYSLVYESEKQSLATVMNKLEEYKKNRHFEFFVFPYSDEVQVKVTNETTGKKSDLKWHKLKVELLENKMFSLLSKGCKWFPSISKGVSRLSAKAVPNTKIIGPSYEVFATSRAVPFYEMEYSVPSKYMQAVVEEISNLIEKKKYKVHFPIECRYVKRDDIWLSPAYGRDSAYIAVHMYKGMKYAAYFGEVEKIFLKYEGRPHWGKMHTLTYGKLQNIYPELHSFLKVRKLLDEAEMFSNPYTEKLFTIMKKS

SEQ ID NO: 28403 - protein, 432 aa, Bacillus thuringiensis serovar konkukian str. 97-27
MNVTTDVQSTTGETKEKRYKTLFGSALGYAAEGLDMLLLSFVLVYILKEFHLSPVEGGNLTLATTIGMLIGSYLFGFIADLFGRIRTMAFTILLFSLATALIYFATDYWQLLILRFLVGMGVGGEFGIGMAIVTETWSKEMRAKATSVVALGWQFGILVASLLPAFIVPHFGWRAVFLFGLIPALLAVYVRKSLSEPKIWEQKQRYKKELLQKESEGNLTTTEAEQLKQMKKFPLRKLFANKKVTITTIGLIIMSFIQNFGYYGIFTWMPTILANKYNYTLAKASGWMFISTIGMLIGIATFGILADKIGRRKTFTIYYVGGTIYCLIYFFLFTDSTLLLWGSALLGFFANGMMGGFGAVLAENYPAEARSTAENFIFGTGRGLAGFGPVIIGLLAAGGNLMGALSLIFIIYPIGLVTMLLCVPETKDKVLE

SEQ ID NO: 28404 - protein, 327 aa, Bacillus thuringiensis serovar konkukian str. 97-27
MENVFDYEDIQLIPAKCIVNSRSECDTTVTLGKHKFKLPVVPANMQTIIDERIATYLAENNYFYIMHRFQPEKRISFIRDMQSRGLIASISVGVKEDEYEFVQQLAAEHLTPEYITIDIAHGHSNAVINMIQHIKKHLPESFVIAGNVGTPEAVRELENAGADATKVGIGPGKVCITKIKTGFGTGGWQLAALRWCAKAASKPIIADGGIRTHGDVAKSIRFGATMVMIGSLFAGHEESPGETIEKDGKLYKEYFGSASEFQKGEKKNVEGKKMFVEHKGSLEDTLIEMEQDLQSSISYAGGTKLDSIRTVDYVVVKNSIFNGDKVY

SEQ ID NO: 28405 - protein, 342 aa, Bacillus thuringiensis serovar konkukian str. 97-27
MTKIFILASTLSLSFFSGLNIGNAATENFSPITNAIVQNNDYFAEGNSKDNNKPPGNGGSQDDSGSDGNGSDGSGSGDNGSGGNGSGGNGSGDNGSGDDGSGGNGSGDNGSGGNGSGGNGSGGNGSGGSGSGDNGSGGNGSGGNGSGGNGSGGNGSGGNGSGGSGSGDNGSGGNGSGGNGSGGNGSGGNGSGGNGSGSSGSGDNGSGGNGSGGSGSGDNGSGGSGSGDNGSGGSGSGDNGSGGSGSGDNGSGGSGSGDNGSGGSGSGDNGSGGSGSQGGNRVKGDSSSQGGNGSQGGNVKDNAKKQGDKLPNTATHYPASILMGLSTFLIGMLLFIRRKNAK

SEQ ID NO: 28406 - protein, 389 aa, Bacillus thuringiensis serovar konkukian str. 97-27
MKSPNFQLSLQTSNLIIGFMVWVILSSLMPYIKVDIPLTAGQISMVTAVPVILGSVLRIPIGYWTNRFGARKLFFISFILLLFPVFYISVANSMVDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 28407 - protein, 462 aa, Bacillus thuringiensis serovar konkukian str. 97-27
MTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 28408 - protein, 386 aa, Bacillus thuringiensis serovar konkukian str. 97-27
MTSHLFQTYGRRNVEFVKGNGTKVIDNNGKQYLDFTSGIGVCNLGHCHPTVMKAVQEQLNDIWHISNLFTNSLQEEVASLLTENIALDYVFFCNSGAEANEAALKLARKHTGKSLVVTCEQSFHGRTFGTMSATGQNKVKEGFGPLLPSFLHTPFNDIKALKEVMNEEVAAVMVEVVQGEGGVIPADLSFLKEIETLCKKFGSLFIIDEVQTGIGRTGTLFAYEQMGIDPHIVTTAKALGNGIPVGAMIGRKELGTSFTAGSHGSTFGGNYVAMAAAEAVLQVSKRPSFLKEVQEKGEYVLQKLQEELQHVECIQNIRGKGLMVGIECTHEVTSFIEQLEKEGLLVLQAGPTVIRLLPPLIVTNEELEQAVYIIKKVVCTKNVSII

SEQ ID NO: 28409 - protein, 240 aa, Bacillus thuringiensis serovar konkukian str. 97-27
MIKIENLHKSFGKNEVLKGITTTIEKGEVVAIIGPSGSGKSTFLRCMNVLEAPTNGYIWIGTEEVTNPKTNIMHVRENVGMVFQHFHLFPHMTVLENVTYAPINVKGVTKQEAEKKAEKLLEKVGLLDKKDTYPNRLSGGQKQRVAIARALAMEPEVMLFDEPTSALDPEMVKEVLEVMKSLVTTGMTMAIVTHEMGFAKEVADRVLFLDGGKLVEDSAPAEFFAAPKSERAQQFLQKIL

SEQ ID NO: 28410 - protein, 330 aa, Bacillus thuringiensis serovar konkukian str. 97-27
MDIQISGLEKNFGKTQALKPLQIVMKQGEFTTLLGPSGCGKTTLLRMIAGLEEPDKGEIYFGDMCMYSSTKKIKTSPHERNIGMVFQDFALWPHMTVFENVVFGLRATKQTNQLREKVEEAIKRVRLQGMEKRYPHELSGGQQQRVAFARAIVTKPHFILFDEPLSALDAILREEMRLELMDIVHSIGLTALYVTHDQTEAMSMSDQIIVMKQGEVLQKGTPEDIYVKPSHEFVAKFVGKANWLVEGKQMVRPEHVSWTKNEVCEIYTGEIQHVTYVGERYEVKVNMGTLGIWTAYHNSKLSIGKPVSLYVPKKCIHHIGGESYEEIQFA

SEQ ID NO: 28411 - protein, 451 aa, Bacillus thuringiensis serovar konkukian str. 97-27
MEVTEKLREKPIKSLFITYLIPAVLGMVLMSVNIVIDAVMISRGVGANGLAGVNVAIPAFSIFFSISLWIGMGGATLYSIALGENKIERARSIFTQSMTVAVIIVGILAAICLWRIEDLAYLFGANEVILPYALDYLHVLLTFGMIYVLENILSTFIRNDGNPNLAMAGLVVTAILNIVFDYIFIFIFGWGVTGAASATILSAAIGFLVLLTHFFRKSSILKWTKFHFEWDTIKQIMIIGFPSFITESTVAIVTIGFNIAFVQYAGEVGVASYAMVNSIHAMTLLLFFGVGAALQPIASFHYGANLSERLREGLQFAVKIAVILGGVAIIVGLFFGKYIIGLFDVQSPQLLELTLTGISLFFIQYVFLGYNIVYGEYFQSVRQTKKSVLIIMSRGLLFIIPLLWIMPKLFGINGIWLVMPVAEVITAIILFTMNRMKHPVPLNMAGEKEVI

SEQ ID NO: 28412 - protein, 330 aa, Bacillus thuringiensis serovar konkukian str. 97-27
MRDTAKGDGTVKPKVYIAEPVPTFVENYLSEHCDYEKWEQNEKVPRDVLLEKIQDKDGLLNFGSAINEELLEAAPNLKVVSNISVGYDNFDLQAMAKHNVIGTNTPYVLDDTVADLVFALMLSAGRRVCELDSYVKNGEWNAEIGKEHFGLDVHHSTIGIIGMGRIGEAVAKRAKFGFDMNVLYYNRRRKEEAEQKFDATYCDLQILLKQSDFIVLLTPLTDETYHLIGEKEFSFMKETAIFINASRGKTVDEEALIDALTEKKIFAAGIDTFTQEPIQKDNPLLSLQNVVTLPHIGSATLKTRQQMAMTAAENLVAALQGKTPPNIVRG

SEQ ID NO: 28413 - protein, 266 aa, Bacillus thuringiensis serovar konkukian str. 97-27
MKEMKVIIAGPRGRMGHEAVLLMERTEHFNLVAAVDYKHGGEKISDLPGMPALDAPIYADLHTCLEEVEADVLLDLTTPEVGKQHVTLAVERGLRSVIGTTGFTEEELKQLTETAKEKAVGTIIAPNFAIGAVLMMKFSQMAAKYFQDVEVIELHHDQKLDAPSGTAVKTVELIRQNRESKQQGHPNEVEQLEGARGANVDGIHIHSVRLPGLIAHQEVMFGGDGQMLTVRHDSFNRASFMSGVKLSIETVMNLDHLVYGLENIID

SEQ ID NO: 28414 - protein, 405 aa, Bacillus thuringiensis serovar konkukian str. 97-27
MPKHRKQSKIKIYRITSYKKDKRSELDSDKFELEQQEVENKQGKHSKQDKQDKQDNLDKQDNLDKQDNLDKQDNLDKPDNLDKPDNLDKQDNLDKQVQSENVVIVPTDSHNLDIWDEISLKEIQAGEHTNLFAEQSNYQNINLLQVSDIRLYLDKQLQFSSIDEQIYHEALVHPIMSKVIDPKRVLILGGGDGLALREVLKYETVLHVDLVDLDGSMIDMARNVPELVSLNKNAFFDNRVNTHVCDAKEFLSSPSSLYDVIIIDFPDPATELLSTLYTSELFARIATFLTEDGAFVCQSNSPADAPLVYWSIGNTIEHAGLTVKSYHTIVPSFGTDWGFHIAANSADVLDQIEQLYVVPTPRTLPSLLFPLFQFKEEHLEQRNFALLNSESNLILHQCYKKEMEF

SEQ ID NO: 28415 - protein, 311 aa, Bacillus thuringiensis serovar konkukian str. 97-27
MKYTKLQKAGLHISKLGLGTNAVGGHNLYADVNEEEGKQLIEEAMGQGITFFDTADSYGFGRSEELVGEVLKGKRHEIVLATKGGIQPLLNGEVYINNERSYLRNAVENSLRRLQTDYIDLYYLHFTNPETSSIDSIGELTRLKEEGKIRSIGISNVNVEQLKEANQHGHIDVVQSPYNMLDRTAGEELLPYCIESGISFIPYGPLAFGILGGKYTEDFKLNEGDWRQSVNLFEENTYKSNFKKVEKLKGVAKEEAVEVSHLALAWLLNKKGIDTVIPGGKRAEQIRESVRAVEVSLNENVMKEIESILED

SEQ ID NO: 28416 - protein, 300 aa, Bacillus thuringiensis serovar konkukian str. 97-27
MERVQMAETLEFSRIIQGFWRLAEWNMTKQELLSFIEDCMDMGITTFDHADIYGGYTCEGLFGEALQLKPSLRENMQIITKCGIAPPSPKFPERYVAHYNTSAKHIIQSAEASLKNLHTDYIDVLLIHRPDPFMDPNEVAEAFSRLKQEGKVRHFGVSNFLPSQFNMLSSYLDFPLITNQIEVSALQLEHFEKGTIDLCQEKRINPMIWSPLAGGEIFTGQSERAVRVRETVQKVATELGVTSIDTVMYAWLLAHPANMMPIVGSGKLDRVKTAALATKVNLDRQQWFTIFESSNGHPVP

SEQ ID NO: 28417 - protein, 444 aa, Bacillus thuringiensis serovar konkukian str. 97-27
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKNEAHAAYTIFEGMAIPSSLIVGLLSDKLFKGKRMPLCIFSMVGVVIGTFVYWQATSILVISIAVSIIGCLIYVPQFLIGLSAMELVPKFAVGTTVGMCGLFGYVGGSLVANAAIGVIVDRSGWDGCFILLLTGAILSTIFLFIVQRGHESKASKVA

SEQ ID NO: 28418 - protein, 345 aa, Bacillus thuringiensis serovar konkukian str. 97-27
MNSELFSPYTIKDVTLKNRIVMSPMCMYSSENEDGQVTNFHLIHYGTRAAGQVGLVMIEATAVLPEGRISNKDLGIWDDSLIEGLHKTTTFIHDNGAKAAIQLAHAGRKAELETDALAPSAIPFNETMKIPVEMSIQQIKNTILAFQQAAVRSKQAGFDVIEIHGAHGYLINEFLSPLSNKRTDEYGGSPEKRYRFLREIIDSINEVWNGPLFVRISANDYHPDGLTVQDYIQYTKWMKEQGVDLIDCSSGAVVPARIDVYPGYQVQYAKHIKEHANIATGAVGLITTGAQAEQILTNNEADLIFIGRELLRNPYFPRIAANELGFELEEPYQYERAPGKISTNK

SEQ ID NO: 28419 - protein, 221 aa, Bacillus thuringiensis serovar konkukian str. 97-27
MLKKAIAEFIGTFVLVLFGTGVAVIGGGIEGIGTLGIAMAFGLSIVAMAYSIGTISGCHINPAVSVAMFINKRMNAMELCYYVLAQILGGLLGTATLVTILQSAKTPLDNLGQNGFGTLGLSGAFLVEFILTFVFVLVIVAVTGKKGSSSLAGLVIGFTLVLVHLLGIPLTGTSVNPARSIAPALFAGGEALSQLWVFIVAPILGGIVAAIVGKFILNTEK

SEQ ID NO: 28420 - protein, 160 aa, Bacillus thuringiensis serovar konkukian str. 97-27
MTVYDFSAKTIIGEEKSLKDYEGKVLLIVNVASKCGFTPQYKGLQEVYDKYKEQGLEILGFPCNQFGGQEPGTEVDITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 28421 - protein, 356 aa, Bacillus thuringiensis serovar konkukian str. 97-27
MVIKVTIDRVCTIGPASNNKETLAQLINNGMKIVRLNLSHGTHESHKDIIRLVKSLDDSIKILGDVQGPKIRLGEIKGEQITLQAGDSFLLHTQPVTGSSTEASVDYEGIANDVKVGSRILMNDGEVELIVEKVSTDKIETKVKTGGNISSHKGVNLPGAIVSLPAITEKDKKDIQFLLEEGVDFIACSFVRKPSHIKEIRDFIQQYRETSPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPVESVSTLRLVSEFAEHVKQDGPFVMKDVLELLHKSLGE

SEQ ID NO: 28422 - protein, 449 aa, Bacillus thuringiensis serovar konkukian str. 97-27
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYTQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKEEIGEHPLVGDIRGKGLLVGIELVNDKETKEPIDNDKIASVVNACKEKGLIIGRNGMTTAGYNNVLTLAPPLVISSEEIAFVIGTLKTAMERI

SEQ ID NO: 28423 - protein, 323 aa, Bacillus thuringiensis serovar konkukian str. 97-27
MAKILVAGKIPEIGLELLKDHDVEMYDKEELISLDELTERVKDKDALLSLLSTKVTKEVIDAAPSLKIVANYGAGYDNIDYTYAGEKGIAVTNTPKVSTEATAELTFALLLAAARRIPEGDTLCRTTGFNGWAPLFFLGREVHGKTIGIIGLGEIGKAVAKRAKAFGMNILYTGPNRKPEVESELEATYVTLEELLQTADFITINCAYNPKLHHMIDEEQFKMMKKTAYIVNASRGPIMHEAALAHALKTNEIEGAALDVFEFEPKITEELKGLKNVVLAPHVGNATFETRDAMAEMAVRNILAVLNGEEPVTPVNQKVFVTK

SEQ ID NO: 28424 - protein, 375 aa, Bacillus thuringiensis serovar konkukian str. 97-27
MTSSNKKSASIYEGTNVNAWGSFENVAETKLFNSIQIGSWPLRNRIAMAPMTRCFADNETGAVGADVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQEVIGQYAQAAKNAIEAGFDGVEIHGAHGYLIDQFTYEFANKRTDKYGGDLKQRLTFMKEVTEAVIEAIGADKTLLRFSAFKGDNPTYMWENPELAIETFVNMFKEVGLTMIHPSTMNYTQVIADGKNFHQLVRKYWDGAIVGVGNLNPKEAEEALQEGTIDVAAFGRPLIANPDFVHRIKSAESLVEYDAKEHLATLI

SEQ ID NO: 28425 - protein, 276 aa, Staphylococcus aureus subsp. aureus MRSA252
MGGYITMETLNSINIPKRKEDSHKGDYGKILLIGGSANLGGAIMLAARACVFSGSGLITVATHPTNHSALHSRCPEAMVIDINDTKMLTKMIEMTDSILIGPGLGVDFKGNNAITFLLQNIQPHQNLIVDGDAITIFSKLKPQLPTCRVIFTPHLKEWERLSGIPIEEQTYERNREAVDRLGATVVLKKHGTEIFFKDEDFKLTIGSPAMATGGMGDTLAGMITSFVGQFDNLKEAVMSATYTHSFIGENLAKDMYVVPPSRLINEIPYAMKQLES

SEQ ID NO: 28426 - protein, 326 aa, Staphylococcus aureus subsp. aureus MRSA252
MIEKSQACHDSLLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 28427 - protein, 495 aa, Staphylococcus aureus subsp. aureus MRSA252
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPNGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 28428 - protein, 394 aa, Staphylococcus aureus subsp. aureus MRSA252
MNSIIELTDYYSSNNYAPLKLVITEGKGGKVWDTDGKQYIDCISGFSVANQGHCHPTIVKAMTEQASKLSIISRVLYSDNLGKWEEKICHLAKKDKVLPLNSGTEAVEAAIKIARKWGSDVKGITDGQVEIIAMNNNFHGRTLGSLSLSNHDAYKSGFHPLLQGTKTVDFGDIEQLTQAISPNTAAIILEPIQGEGGVNIPPKGYIQAVRQLCDKHQILLIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVEQLIKRGILCKDTHRTIIRLSPPLVIDKEEINQIVAAFQDVFKN

SEQ ID NO: 28429 - protein, 459 aa, Staphylococcus aureus subsp. aureus MRSA252
MNFFDIHKIPNKGIPLSVQRKLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSLKI

SEQ ID NO: 28430 - protein, 403 aa, Staphylococcus aureus subsp. aureus MRSA252
MTFEKETVLKTLFPEDVLSIAKGLTDGEVEFLQQVDSLLESKYRENINQHWIDATVPEDYFKDLGELNYFNNPLLYKDRPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 28431 - protein, 501 aa, Staphylococcus aureus subsp. aureus MRSA252
MNFDWIKTRSDFDDDKPAVIDHAKQTSWTYQQLNARADNMAHYLTSQGVKKGDVIGIFAPNDIAILDLLFACFKTGAVFLPLNWRLNPKEIAAIVEDAQLKLLFYAEKHLSSLTDIDQNLLHMDIDVAQYDEIVNPDYHQPFQATPVEPQDLAALIYTSGTTGSPKGVMFSYESFVHNGANLELTYKFNSNYITIVSTPMFHVLGFNDTVLPVLMSGGTLILQRYFNGEELNDMIAQYHPTFIIMIPTMYYSTLRASNFNPENFKAMDYIIQGGSQPLPSIQAAFKQYGINIINGYGLTEAPLVLVNTPENSKRKPMSIGKAVMFVDARILDDNGEEVPTGEIGELAIKAKNVTPGYWNKPAETAKAFHGRYLLTGDLAKMDDDGDIFIIDRKKELIITGGENVLPSEVENALAEHPLVDRCVVVGYDHPKYGESIAAAIILREDEPHYAEILDQHMRSRLAGYKVPRMYVPVTHMPLNSTQKPDKLAIRQMMNDKVSQTL

SEQ ID NO: 28432 - protein, 478 aa, Staphylococcus aureus subsp. aureus MRSA252
MTKLPQNFMWGGALAANQFEGGYDKGGKGLSVIDVMTSGAHGKARQITESIDPNHYYPNHEGIDFYHRYKEDIALFKEMGLKCLRTSIAWTRIFPNGDEDVPNEEGLAFYDRIFDELIAQGIEPVVTLSHFEIPLHLAKHYGGFRNREVVNYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDFGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGRGTMERLKKDSFYWYQQVIASNGDKL

SEQ ID NO: 28433 - protein, 404 aa, Staphylococcus aureus subsp. aureus MRSA252
MYRYKPLLQSIHLPNGIKISNRFVLSPMTVNASTKEGYITKADLAYAARRSNSAGMQVTGAAYIEPYGQLFEYGFNIDHDACIPGLTNMASTMKQHGSLAIIQLAHAGRFSNQAILNFGKVYGPSPMTLHSPIEHDVIAMSHEKINSIIQQYRDATLRAIKAGFDGVEISIAQRLLIQTFFSTFSNKRTDHYGADSLKNRARLCLEVMRAVQEVIDKEAPDNFILGFRATPEETRGSDLGYTIDEFNQLIDWVMDVSNIQYLAIASWGRHIYQNTSRTPGEHFGRPVNQIVYEHLAGRIPLIASGGINSPESALDALQHADMVGMSSPFVTEPDFVHKLSEQRPHDIDLEFSMADLENLAIPRAAFKDIVKMMDYGEGLKKHTRDALRQLEQNYHDTSSKDNFS

SEQ ID NO: 28434 - protein, 342 aa, Staphylococcus aureus subsp. aureus MRSA252
MMNNKVLVTGGTGFVGMRIISRLLEQGYEVQTTIRDLSKADKVIKTMQDNGISTERLMFVEADLSQDEHWDEAMKDCKYVLSVASPVFFGKTDDAEVMAKPAIEGIQRILRAAQHAGVKRVVMTANFGAVGFSNKDKNSITNESHWTNEDEPGLSVYEKSKLLAEKAAWDFVENENTTVEFATINPVAIFGPSLDAHVSGSFHLLENLLNGSMKRVPQIPLNVVDVRDVAELHILAMTNEQASGKRFIATADGQIDLLEIAKLIKEKRPEIAQKVATKKLPDFILSLGAKFNHQAKEGKLLLDMNRNVSNERAKTLLGWEPIATQEEAILAAIDSMAKFHLI

SEQ ID NO: 28435 - protein, 452 aa, Staphylococcus aureus subsp. aureus MRSA252
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLVLTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYILIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNAWLDNVSLIAIGFLIYGPVMLIGLQALDYVPKKAAGTAAGLTGLFGYLFGAVMANIVLGAVVDKFGWDVGFILLTAISVFAMLSFILTWNKVGQETVHH

SEQ ID NO: 28436 - protein, 488 aa, Staphylococcus aureus subsp. aureus MRSA252
MWESKFAKESLTFDDVLLIPAQSDILPKDVDLSVQLSDKVKLNIPVISAGMDTVTESKMAIAMARQGGLGVIHKNMGVEEQADEVQKVKRSENGVISNPFFLTPEESVYEAEALMGKYRISGVPIVDNKEDRNLVGILTNRDLRFIEDFSIKIVDVMTQENLITAPVNTTLEEAEKILQKHKIEKLPLVKDGRLEGLITIKDIEKVIEFPNAAKDEHGRLLVAAAIGISKDTDIRAQKLVEAGVDVLVIDTAHGHSKGVIDQVKHIKKTYPEITLVAGNVATAEATKDLFEAGADIVKVGIGPGSICTTRVVAGVGVPQITAIYDCATEARKHGKAIIADGGIKFSGDIIKALAAGGHAVMLGSLLAGTEESPGATEIFQGRQYKVYRGMGSLGAMEKGSNDRYFQEDKAPKKFVPEGIEGRTAYKGALQDTIYQLMGGVRAGMGYTGSHDLRELREEAQFTRMGPAGLAESHPHNIQITKESPNYSF

SEQ ID NO: 28437 - protein, 301 aa, Staphylococcus aureus subsp. aureus MRSA252
MITYDLIGNTPLVLLEHYSDDKVKIYAKLEQWNPGGSVKDRLGKYLVEMAIQEGRVRAGQTIVEATAGNTGIGLAIAANRHHLKCKIFAPYGFSEEKINIMIALGADVSRTSQSEGMHGAQLAARSYAEKYGAVYMNQFESEHNPDTYFHTLGPELTSALQHIDYFVAGIGSGGTYTGTARYLKQHHVQCYAVEPEGSVLNGGPAHAHDTEGIGSEKWPIFLERSLVDGIFTIKDQDAFRNVKSLAKHEGLLVGSSSGAALQGALNLKAQLSEGTIVVVFPDGSDRYMSKEIFNYEENDYE

SEQ ID NO: 28438 - protein, 341 aa, Staphylococcus aureus subsp. aureus MRSA252
MIEFRQVSKSFHKKKQTIDALKDVSFTVNRNDIFGVIGYSGAGKSTLVRLVNHLEAASNGQVIVDGHDITNYSDKMMRDIKKDIGMIFQHFNLLNSATVFKNVAMPLILSKKSKTEIKQRVTEMLEFVGLSDKKDQFPDELSGGQKQRVAIARALVTNPKILLCDEATSALDPATTASILTLLKNVNQTFGITIMMITHEMRVIKDICNRVAVMEKGQVVETGTVKEVFSHPKTTIAQNFVSTVIQTEPSPSLIRRLNDKQVGDFKDYKIFVEETQMTQPIINDLIQICGREVKILFSSMSEIQGNTVCYMWLRFNMDQQFDGTAINQYFKEKNIQFEEVH

SEQ ID NO: 28439 - protein, 487 aa, Staphylococcus aureus subsp. aureus MRSA252
MGEFKGFMKYDKQYLGELSLVDRLKHHKAYQQRFTKEDASIQGARCMDCGTPFCQTGQQYGRETIGCPIGNYIPEWNDFVYHQDFKTAYERLSETNNFPDFTGRVCPAPCESACVMKINRESIAIKGIERTIIDEAFENGWVAPKVPSRRRDEKVAIVGSGPAGLTAAEELNLLGYQVTIYERARESGGLLMYGIPNMKLDKDVVRRRIKLMEEAGITFVNGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 28440 - protein, 179 aa, Staphylococcus aureus subsp. aureus MRSA252
MHNDLKEVLLTEEDIQNICKELGAQLTKDYQGKPLVCVGILKGSAMFMSDLIKRIDTHLSIDFMDVSSYHGGTESTGEVQIIKDLGSSIENKDVLIIEDILETGTTLKSITELLQSRKVNSLEIVTLLDKPNRRKADIEAKYVGKKIPDEFVVGYGLDYRELYRNLPYIGTLKPEVYSN

SEQ ID NO: 28441 - protein, 310 aa, Staphylococcus aureus subsp. aureus MRSA252
MAQKPVDNITQIIGGTPVVKLRNVVDDNAADVYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEVHELTTGPELLQQFEGKTIDAFLAGVGTGGTLSGVGKVLKKEYPNIEIVAIEPEASPVLSGGEPGPHKLQGLGAGFIPGTLNTEIYDSIIKVGNDTAMEMSRRVAKEEGILAGISSGAAIYAAIQKAKELGKGKTVVTVLPSNGERYLSTPLYSFDD

SEQ ID NO: 28442 - protein, 454 aa, Staphylococcus aureus subsp. aureus MRSA252
MAKKKVIFECMACGYQSPKWMGKCPNCGAWNQMEEIVEKAANPKHGVKTKELVGKVQKLNSIKHETTPRVLTDSAEFNRVLGGGIVSGSLVLIGGDPGIGKSTLLLQICASLSQKKKVLYITGEESLSQTKLRAERLDEDSSELQVLAETDLEVIYQTVKEEQPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVNNPSEMFLEERSTNVPGSTIVATMEGTRPLLIEVQALVTPTTFNNPRRMATGIDHNRLSLLMAVLEKKENYLLQQQDAYIKVAGGVKLTEPAVDLSVIVATASSFKDKAVDGLDCYIGEVGLTGEVRRVSRIEQRVQEAAKLGFKRVIIPKNNIGGWTYPEGIQVIGVTTVHEALSFALHS

SEQ ID NO: 28443 - protein, 134 aa, Staphylococcus aureus subsp. aureus MRSA252
MDNQQDNHIKLLNPLTLAYMGDAVLDQYVRTYIVLKLKSKPNKLHQMSKKYVSAKSQAQTLEYLMEQEWFTDEEMDILKRGRNAKSHTKAKNTDVQTYRKSSAIEAVIGFLYLEKREERLEALLNEIITIVNER

SEQ ID NO: 28444 - protein, 458 aa, Staphylococcus aureus subsp. aureus MRSA252
MDVILEQLETHTQNKPNDIALHIDDETITYSQLNARITSAVESLQKYSLNPVVAINMKSPVQSIICYLALHRLHKVPMMMEGKWQSTIHRQLIEKYGIKDVIGDTCLMQNIDSPMFIDSTQLQHYPNLLHIGFTSGTTGLPKAYYRDEDSWLASFEVNEMLMLKNENAIAAPGPLSHSLTLYALLFALSSGRTFIGQTTFHPERLLNQCRKISSYKVAMFLVPTMIKSLLLVYNNEHTIQSFFSSGDKLYSSIFKKIKNQANDINLIEFFGTSETSFISYNLNQQAPVESVGVLFPNVELKTTNHDHNGIGTICVKSNMMFSGYVSEQCINNDEWFVTNDNGYVKEQYLYLTGRQHDMLIIGGQNIYPAHVERLLTQSSSIDEAIIIGIPNERFGQIGVLLYSGDVTLTHKNVKQFLNKKVKRYEIPSMIHHVEKMYYTASGKIAREKMMSMYLRGEL

SEQ ID NO: 28445 - protein, 440 aa, Staphylococcus aureus subsp. aureus MRSA252
MKTYDLIVIGFGKAGKTLAKYAASTGQHVAVIEQSSKMYGGTCINVGCIPSKTLVHDGLEGKSFEASYNRKNDVVNALNNKNYHLLADDSNIDVLDFKAQFKSNTEVNLLDQHGDIVDSITAPHIIINTGATSIIPNIKGLDQAKHVFDSTGLLNISYQPKHLVIVGGGYIALEFASMFANLGSKVTVLERGESFMPREDQDVVAHAITDLENKGIALHTNVETTELSSDNYHTTVHTNVGNFEADAVLLAIGRKPNTDLALENTDIELGDRGEIKVNAHLQTTVPHIYAAGDVKGGLQFTYISLDDYRIIKSSLYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTILRDNIYTHPTMAESFNDLFNF

SEQ ID NO: 28446 - protein, 312 aa, Staphylococcus aureus subsp. aureus MRSA252
MKQFVNLGKSDVEVFPIALGTNAVGGHNLYPNLDEEQGKDVVRQAINHGINLLDTAYIYGPERSEELVGEVVKEYPREQIKIATKGSHEFDENQEVHQNNQPEYLKQQVENSLKRLQTDYIDLYYIHFPDDNTPKDQAVAALQELKEQGKIKAVGVSNFTLDQLKEANKDGYVDVVQLEYNLLHRENEAVLQYCVDHQITFIPYFPLASGILAGKYDENTKFSDHRTTRRDFKPGVFEENVRRVKALESIAAAHQTSIANIVLAFYLTRPAIDVIIPGAKRAEQVIENIKAADIVLSDDEIQYIDELFPIED

SEQ ID NO: 28447 - protein, 336 aa, Staphylococcus aureus subsp. aureus MRSA252
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMENGTITGRMVIKF

SEQ ID NO: 28448 - protein, 302 aa, Staphylococcus aureus subsp. aureus MRSA252
MEQIMINHYVHFSRLVQGFWRANEWKMTAKELNYFINELVERGITTMDHADIYGDYQCESLFGNALDLSPELRNKIQIVTKCGIILPSKQFDFTNGHRYDLSSKHIVKSVEQSLINLNVGYLDSLLIHRPSPLMDPEQVADALTKLVKQGKLKSFGVSNFNHSQYQLLNQYIMKERLHISINQLELSPYHVDSLQDGTMDSMYQNHVQIMAWSPFAGGKIFDKEDIKAQRIMKVIQSIADKYGVSDTAVMIAWLVKIPHRIMPILGTSQLKRIDQAIEGLQLNLDDQSWFDIYTAIIGQDIP

SEQ ID NO: 28449 - protein, 396 aa, Staphylococcus aureus subsp. aureus MRSA252
MAKKIVSDLDLKGKTVLVRADFNVPLKDGEITNDNRIVQALPTIQYIIEQGGKIVLFSHLGKVKEESDKAKLTLRPVAEDLSKKLDKEVVFVPETRGEKLEAAIKDLKEGDVLLVENTRYEDLDGKKESKNDPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 28450 - protein, 253 aa, Staphylococcus aureus subsp. aureus MRSA252
MRTPIIAGNWKMNKTVQEAKDFVNALPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 28451 - protein, 505 aa, Staphylococcus aureus subsp. aureus MRSA252
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVEDQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 28452 - protein, 434 aa, Staphylococcus aureus subsp. aureus MRSA252 [sequence omitted]

SEQ ID NO: 28453 - protein, 319 aa, Staphylococcus aureus subsp. aureus MRSA252
MVKIVVSRKIPDKFYQQLSKLGDVVMWQKSLVPMPKDQFVTALRDADACFITLSEQIDAEILAQSPNLKVIANMAVGYDNIDVESATANNVVVTNTPNVLTETTAELGFTLMLATARRIVEAEKYVEADAWQSWGPYLLSGKDVFNSTVGIYGMGDIGKAFARRLQGFNTKILYHNRSRHKDAEADFNATYVSFETLLAESDFIICTAPLTKETHHKFNAEAFEQMKNDAIFINIGRGQIVDETALIDALDNKEILACGLDVLANEPIDHTHPLMGRDNVLITPHIGSASVTTRDNMIQLCINNIEAVMTNQVPHNPVN

SEQ ID NO: 28454 - protein, 375 aa, Staphylococcus aureus subsp. aureus MRSA252
MKSKYEPLFDKVVLPNGVELRNRFVLAPLTHISSNDDGTISDIELPYIEKRSQDVGITSNAASNVSDVGKAFPGQPSIAHDSDIEGLKRLATAMKKNGAKALVQIHHGGAQALPELTPDGDVVAPSPISLKSFGQKQEHSAREMTNEEIEQAIKDFGEATRRAIEAGFDGVEIHGANHYLIHQFVSPYYNRRNDVWANQYKFPIAVIEEVLKSKEVYGNKDFIVGYRLSPEEAESPGITMEITEELVNKISHMPIDYIHVSMMDTHATAREGKYAGQERLPLIHKWINGRMPLIGIGSIFTADDALDAVENVGVDLVAIGRELLLDYQFVEKIKDGREDEIINYFDPEREDNHHLTPNLWHQFNEGFYPLPRKDK

SEQ ID NO: 28455 - protein, 396 aa, Staphylococcus aureus subsp. aureus MRSA252
MTKSEKIIELTNHYGAHNYLPLPIVISEAEGVWVKDPEGNKYMDMLSAYSAVNQGHRHPKIIQALKDQADKVTLVSRAFHSDNLGEWYEKICKLAGKDKALPMNTGAEAVETALKAARRWAYDVKGIEPNKAEIIAFNGNFHGRTMAPVSLSSEAEYQRGYGPLLDGFRKVDFGDVDALKAAINKNTAAVLVEPIQGEAGINIPPEGYLKAIRELCDEHNVLFIADEIQAGLGRSGKLFARDWDNVKPDVYILGKALGGGVFPISVVLADKEVLDVFTPGSHGSTFGGNPLACAASIAALDVIVDEDLPGRSLELGDYFKEQLKQIDHPSIKEVRGRGLFIGVELNESARPYCEALKEEGLLCKETHDTVIRFAPPLIITKEELDLALEKIRHVFQ

SEQ ID NO: 28456 - protein, 443 aa, Staphylococcus aureus subsp. aureus MRSA252
MTHIQLDFSKTLEFFGEHELKQQQEIVKSIHKTIHEGTGAGSDFLGWVDLPVDYDKEEFSRIVEASKRIKENSDVLVVIGIGGSYLGARAAIEMLTSSFRNSNEYPEIVFVGNHLSSTYTKELVDYLADKDFSVNVISKSGTTTEPAVAFRLFKQLVEERYGKEEAQKRIFATTDKEKGALKQLATNEGYETFIVPDDVGGRYSVLTAVGLLPIATAGINIEAMMIGAAKAREELSSDKLEENIAYQYATIRNILYAKGYTTEMLINYEPSMQYFNEWWKQLFGESEGKDFKGIYPSSANYTTDLHSLGQYVQEGRRFLFETVVKVNHPKYDITIEKDSDDLDGLNYLAGKTIDEVNTKAFEGTLLAHTDGGVPNMVVNIPQLDEETFGYVVYFFELACAMSGYQLGVNPFNQPGVEAYKQNMFALLGKPGFEDLKKELEERL

SEQ ID NO: 28457 - protein, 492 aa, Staphylococcus aureus subsp. aureus MRSA252
MKKAILSVSNKTGIVEFAKALTQLNYELYSTGGTKRILDEANVPVRSVSDLTHFPEIMDGRVKTLHPAVHGGILADRNKPQHLNELSEQHIDLIDMVVVNLYPFQQTVANPDVTMDEAIENIDIGGPTMLRAAAKNYKHVTTIVHPADYQEVLTRLRNDSLDESYRQSLMIKVFEHTAEYDEAIVRFFKGDKETLRYGENPQQSAYFVRTSNAKHTIAGAKQLHGKQLSYNNIKDADATLALVKKFDTPAAVAVKHMNPCGVGIGDTLEQAFHHAYEADSQSIFGGIVALNRAVTPELAEQLHSIFLEVIIAPKFTDEALNILKQKKNVRLLEIDMTIDSNEEEFVSVSGGYLVQDKDNYVVPKEEMKVVTEVAPTDEQWEAMLLGWKVVPSVKSNAIILSNNKQTVGIGAGQMNRVGAAKIALERAIEINDHVALVSDGFFPMGDTVELAAQHGIKAIIQPGGSIKDQDSIDMANKHGIAMVVTGTRHFKH

SEQ ID NO: 28458 - protein, 364 aa, Staphylococcus aureus subsp. aureus MRSA252
MEPLLSLKSVSKSYDDLNILDDIDIDIESGYFYTLLGPSGCGKTTILKLIAGFEYPDSGEVIYQNKPIGNLPPNKRKVNTVFQDYALFPHLNVYDNIAFGLKLKKLSKTEIDQKVTEALKLVKLSGYEKRNINEMSGGQKQRVAIARAIVNEPEILLLDESLSALDLKLRTEMQYELRELQSRLGITFIFVTHDQEEALALSDFLFVLKDGKIQQFGTPTDIYDEPVNRFVADFIGESNIVEGRMVRDYVVNIYGQDFECVDMGIPENKKVEVVIRPEDISLIKAEEGLFKATVDSMLFRGVHYEICCIDNKGYEWVIQTTKKAEVGSEVGLYFDPEAIHIMVPGETEEEFDKRIESYEEVDNA

SEQ ID NO: 28459 - protein, 214 aa, Staphylococcus aureus subsp. aureus MRSA252
MTKLYPSLLSVDFLDLQHELKRLEEAGVDGVHFDVMDGQFVPNISIGLPILDAVRKGTTLPIDVHLMIENPEKYIASFAEHGADMISIHVESTPHIHRAIQMIKHLDKKAGVVINPGTPISQIEPILDIVDYVLVMTVNPGFGGQSFIDQCVEKIAGLNAIKMERQLNFDIEVDGGVNTDTAKVCVENGATMLVTGSFFFKQEDYKKVTQALKG

SEQ ID NO: 28460 - protein, 272 aa, Staphylococcus aureus subsp. aureus MRSA252
MNVYLAEFLGTAILILFGGGVCANVNLKRSAANGADWIVITAGWGLAVTMGVYAVGQFSGAHLNPAVSLALALDGSFDWSLVPGYIVAQMLGAIVGATIVWLMYLPHWKATEEAGAKLGVFSTAPAIKNYFANFLSEIIGTMALTLGILFIGVNKIADGLNPLIVGALIVAIGLSLGGATGYAINPARDLGPRIAHAILPIAGKGGSNWSYAIVPILGPIAGGLLGAVVYAVFYKHTFNIGCAIAIVVVIITLILGYILNKSSKKGDIESIY

SEQ ID NO: 28461 - protein, 158 aa, Staphylococcus aureus subsp. aureus MRSA252
METIYDFVVETNKGVTYKLDAYKGDVMLIVNTASECGFTSQFEGLQSLYEKYKDQGFVILGFPCNQFGGQEPGSGEEAAQNCKLNYGVTFPMHQKIDVKGEHQLPLFRYLTAAQHGFFNEKIKWNFTKFLVDREGNVVKRFAPQKKPVQIEREIEKLL

SEQ ID NO: 28462 - protein, 446 aa, Staphylococcus aureus subsp. aureus MRSA252
MPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILESGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 28463 - protein, 484 aa, Staphylococcus aureus subsp. aureus MRSA252
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 28464 - protein, 325 aa, Staphylococcus aureus subsp. aureus MRSA252
MKIFDYEDIQLIPNKCIVESRSECDTTIQFGPKKFKLPVVPANMQTVMNEKLAKWFAENDYFYIMHRFDEEARIPFIKHMQNSGLFASISVGVKKAEFDFIEKLAQEKLIPEYITIDIAHGHSDSVINMIKHIKTHIPDSFVIAGNVGTPEGVRELENAGADATKVGIGPGRVCITKIKTGFGTGGWQLAALNICSKAARKPLIADGGIRTHGDIAKSIRFGASMVMIGSLFAAHEESPGETVELDGKQYKEYFGSASEFQKGEHKNVEGKKMFVEHKGSLTDTLKEMQQDLQSSISYAGGKDLKSLRTVDYVIVRNSIFNGDRD

SEQ ID NO: 28465 - protein, 242 aa, Staphylococcus aureus subsp. aureus MRSA252
MTKLFIPYIMGNKDLIENATLLSENGADIIEIGVPFSDPVADGPVIMEAGQQAIKQGITIDYIFEQLEKHGNQIKCQYVLMTYYNIICHYGEQAFFEKCRDTGVYGLIIPDLPFELSQRLKQQFSHYGVKIISLVAMTTDDKRIKDIVSYAEGFIYTVTMNATTGQNGAFHPELKRKIESIKAIANVPVVAGFGIRSPQHVADIKEVADGIVIGSEIVKRFKSNTREEIIKYLQSIQQTLNN

SEQ ID NO: 28466 - protein, 440 aa, Staphylococcus aureus subsp. aureus MRSA252
MSNGKELQKNIGFFSAFAIVMGTVIGSGVFFKISNVTEVTGTAGMALFVWFLGGIITICAGLTAAELAAAIPETGGLTKYIEYTYGDFWGFLSGWAQSFIYFPANVAALSIVFATQLINLFHLSIGSLIPIAIASALSIVLINFLGSKAGGILQSVTLVIKLIPIIVIVIFGIFQSGDITFSLIPTTGNSGNGFFTAIGSGLLATMFAYDGWIHVGNVAGELKNPKRDLPLAISVGIGCIMAVYLLINATFLLTLPIELLAGNLNAASDTSKILFGENGGKIITIGILISVYGTINGYTMTGMRVPYAMAERKLLPFSHLFAKLTKSGAPWFGAIIQLIIAIIMMSMGAFDTITNMLIFVIWLFYCMSFVAVIILRKREPNMERPYKVPLYPIIPLIAILAGSFVLINTLFTQFILAIIGILITALGIPVYYYKKKQKAA

SEQ ID NO: 28467 - protein, 302 aa, Staphylococcus aureus subsp. aureus MRSA252
MQKNILKSGIALSELGLGCMSLGTDLKKAEQIIDCAVENGITYFDTADMYDKGINESVVGKALFKYQQRDDIVIGTKVGNRLTKDGSTTWDPSKSYIKEAVKGSLKRLGIDHIDLYQLHGGTIDDPLDETISAFDELKQEGIIRAYGISSIRPNVIDYYLKHSQIETIMSQFNLIDNRPESLLDAIHNDDVKVLARGPVSKGLLTSNSVNVLDNKFKDGIFDYSHDELGETIASIKEIESNLSALTFSYLTSHDVLGSIIVGASSVDQLKENIENYHTKVSLDQIKTARARVKDLEYTNHLV

SEQ ID NO: 28468 - protein, 468 aa, Staphylococcus aureus subsp. aureus MRSA252
MTQQIGVIGLAVMGKNLAWNIESRGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 28469 - protein, 473 aa, Staphylococcus aureus subsp. aureus MRSA252
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSVGIIGGGVIGMEFASLMIDLGVDVTVIEAGERILPTKSKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGPHVTELINEASLLQFMNGSALELGLTTHAHPSISEVLMELGLKAESRAIHV

SEQ ID NO: 28470 - protein, 379 aa, Staphylococcus aureus subsp. aureus MRSA252
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINDQPSNFKDRAKRFFKGE

SEQ ID NO: 28471 - protein, 428 aa, Staphylococcus aureus subsp. aureus MRSA252
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRDITTEYGALLIFDEVMTGFRVGYHCAQGHFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 28472 - protein, 497 aa, Staphylococcus aureus subsp. aureus MRSA252
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGGNDVATSPFTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKWFPFGPIFAAILCIVVIIGQDVDFIKTGDFNFSRFLITYMGIPVFLAFFIYHKLRYKTKKIPLEQVDLRQDVSMDEIKG

SEQ ID NO: 28473 - protein, 453 aa, Staphylococcus aureus subsp. aureus MRSA252
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAYKTQFGHASFTNLYEHGVFPKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKTPDLHKKATYKLFGGKYMGYLIFVFFIFVFGLLFINVETRRAIYFIPIWFILLGFMYLRYKRIAAKSNN

SEQ ID NO: 28474 - protein, 285 aa, Staphylococcus aureus subsp. aureus MRSA252
MFKDFFNRTKKKKYLTVQDSKNNDVPAGIMTKCPKCKKIMYTKELAENLNVCFNCDHHIALTAYKRIEAISDEGSFTEFDKGMTSANPLDFPSYLEKIEKDQQKTGLKEAVVTGTAQLDGMKFGVAVMDSRFRMGSMGSVIGEKICRIIDYCTENRLPFILFSASGGARMQEGIISLMQMGKTSVSLKRHSDAGLLYISYLTHPTTGGVSASFASVGDINLSEPKALIGFAGRRVIEQTINEKLPDDFQTAEFLLEHGQLDKVVHRNDMRQTLSEILKIHQEVTK

SEQ ID NO: 28475 - protein, 492 aa, Staphylococcus aureus subsp. aureus MRSA252
MDFWLYKQAQQNGHHIAITDGQESYTYQNLYCEASLLAKRLKAYQQSRVGLYIDNSIQSIILIHACWLANIEIAMINTRLTPNEMTNQMRSIDVQLIFCTLPLELRGFQIVSLDDIEFAGTDITTNGLLDNTMGIQYDTSNETVVPKDSPSNILNTSFNLDDIASIMFTSGTTGPQKAVPQTFRNHYASAIGCKESLGFDRDTNWLSVLPIYHISGLSVLLRAVIEGFTVRIVDKFNAEQILTMIKNERITHISLVPQTLNWLMQQGLHEPYDLQKILLGGAKLSASMIETALQYNLPIYNSFGMTETCSQFLTATPEMLHARPDTVGMPSANVDVKIKNPNKKGHGELMIKGANVMNGYLYPTDLTGTFENGYFNTGDIAEIDHEGYVMIYDRRKDLIISGGENIYPYQIETVAKQFPGIIDAVCVGHPDDTWGQVPKLYFVSESNISKAQLIAYLSQHLAKYKVPKHFEKVDTLPYTSTGKLQRNKLYRG

SEQ ID NO: 28476 - protein, 242 aa, Staphylococcus aureus subsp. aureus MRSA252
MPVIKINNLNKVFGDNEVLKDINLEINQGEVVAIIGPSGSGKSTLLRCMNLLEVPTKGQVIFEGNDLTEKGTQVDKLRQKMGMVFQNFNLFPHKKVVDNIILAPKLLKKDNNDELHKEALSLLDKVGLKEKADVYPNQLSGGQKQRVAIARALAMHPDVILFDEPTSALDPEVVGDVLKVMKDLAKEGMTMVVVTHEMGFAKDVSDKVIFMADGVVVESGTPVEIFEQPQHERTQNFLARVL

SEQ ID NO: 28477 - protein, 429 aa, Staphylococcus aureus subsp. aureus MRSA252
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHSNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 28478 - protein, 489 aa, Staphylococcus aureus subsp. aureus MRSA252
MYQLEDDSLMLHNDLYQINMAESYWNDNIHEKMAVFDLYFRKMPFNSGYAVFNGLKRVIDFIEHFGFSKSDLEYLKSIGYKDDFLSYLKDLKFTGSIRSMQEGELCFGNEPLLRVEAPLIQAQLIETILLNIVNFHTLITTKASRIRQIASNDKLMEFGTRRAQEIDAALWGARAAYIGGFDSTSNVRAGKLFGIPVSGTHAHAFVQTYGDEYVAFKKYAERHKNCVFLVDTFHTLKSGVPNAIKVAKELGDKINFVGIRLDSGDIAYLSKEARRMLDEAGFTETKIIASNDLDEETITSLKAQGAKVDSWGVGTKLITGYDQPALGAVYKLVAIENEDGSYSDRIKLSNNAEKVTTPGKKNVYRIINKKTGKAEGDYITLENENPYDEQPLKLFHPVYTYKMKFIKSFEAIDLHHNIYENGKLVYQIPTEDESRDYLAQGLQSIWDENKRFLNPQEYPVDLSKACWDNKHKRIFEVAEHVKEMEEDNE

SEQ ID NO: 28479 - protein, 264 aa, Staphylococcus aureus subsp. aureus MRSA252
MQLYYLGPKGTFSYLACRQYFSENEATFQPKSNLFEVIKSVADDDTSIGVVPIENSIEGTINIVADALAQQDVFAHGEIRLDINFALYGNGSNTISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 28480 - protein, 459 aa, Staphylococcus aureus subsp. aureus MRSA252
MNIIEQKFYDSKAFFNTQQTKDISFRKEQLKKLSKAIKSYESDILEALYTDLGKNKVEAYATEIGITLKSIKNARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTNDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 28481 - protein, 319 aa, Staphylococcus aureus subsp. aureus MRSA252
MRRLFSIGEALIDFIPNITNANLKDVQTFTKQIGGAPCNVACTVQKLGQQAHMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKSVDTTGAGDAFIGAVISRILATDVLNLTQLFENEGEEILAFSNRVAAIVTTKYGAINSLPTLQEVEQAF

SEQ ID NO: 28482 - protein, 475 aa, Staphylococcus aureus subsp. aureus MRSA252
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 28483 - protein, 302 aa, Staphylococcus aureus subsp. aureus MRSA252
MTKKKGIDIIGVPSTFGQRKLGVDLGPTAIRYAGLIPRLKQLDLDVNDKGDIKVSAVDIEKFQSEQNGLRNYDEIIDVTQKLNKEVSASIENNRFPLVLGGDHSIAIGSVSAISKHYNNLGVIWYDAHGDLNIPEESPSGNIHGMPLRILTGEGPKELLELNSNVIKPENIVLIGMRDLDKGERQFIKDHNIKTFTMSDIDKLGIKEVIENTIEYLKSRNVDGVHLSLDVDALDPLETPGTGTRVLGGLTYRESHFALELLHQSQSVTSMDLVEVNPLIDHNNHTAEQSVSLVGTFFGETLL

SEQ ID NO: 28484 - protein, 335 aa, Staphylococcus aureus subsp. aureus MRSA252
MKMIGFEKPFKLEEGNLFKVYEQRKPTPENDDILVKVNSISVNPVDTKQRQMEVTQAPRVLGFDAIGTVEAIGPNVTLFSPGDVVFYAGSPNRQGSNATYQLVSEAIVAKAPHNISANEAVSLPLTGITAYETFFDTFKISHNPSENIGKSVLIINGAGGVGSIATQIAKRYGLTVITTASRQETTEWCEKMGADIVLNHKEDLVRQFKEKEIPLVDYIFCTYNTDLYYNTMIELIKPLGHITTIVAFNEDQDLNALKLKSITFTHEFMFARPIHRTPDMIKQHEYLEDITKNIESGHYQPTTTQVFEGLSPENLYQAHLLLEKQSMIGKLVINI

SEQ ID NO: 28485 - protein, 470 aa, Staphylococcus aureus subsp. aureus MRSA252
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGEYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 28486 - protein, 215 aa, Staphylococcus aureus subsp. aureus MRSA252
MNIILMGLPGAGKGTQASEIVKKFPIPHISTGDMFRKAIKEETELGKEAKSYMDRGELVPDEVTVGIVKERISEDDAKKGFLLDGFPRTIEQAEALNNIMSELDRNIDAVINIEVPEEELMNRLTGRRICESCGTTYHLVFNPPKVEGICDIDGGKLYQREDDNPETVANRLSVNIKQSKPILDFYDQKGVLKNIDGSKDISDVTKDVIDILDHL

SEQ ID NO: 28487 - protein, 444 aa, Staphylococcus aureus subsp. aureus MRSA252
MKNYFQFDKYGTNFKREILGGITTFLSMAYILAVNPQVLSLAGVKGVSEDMKMDQGAIFVATALAAFVGSLFMGLIAKYPIALAPGMGLNAFFAFTVVLTMGIPWQVGLTGVLFSGIFFAILTVTGFREVIINAIPYQMKMAVSAGIGLFITFVGLQSSGIIVKNESTLVTLGHLTDPPVLLAIFGIVITVILYAIKLPGSIFIGMIITAIVGMFTGLIQMPSGIVGKIPSIEPTFGAAFEAFKDPSQLLTIQFLIVILTFLFIDFFDTAGTLVAVATQAGIMKDNKLPRAGRALFSDSLATIVGSVFGTTTTTSYIESTSGVAVGARTGFASIVTGCCFLLALFFSPLIAVVTSAVTTPALVVVGVLMAANFAEINWKSFEVAVPAFITIIMMPLSYSIATGIACGFIFYPITMLISKKHKEVHPIMYVLMVLFILYFIFVHG

SEQ ID NO: 28488 - protein, 317 aa, Staphylococcus aureus subsp. aureus MRSA252
MEKVYVAGAIPEVGLKLLQEHFEVEMYEGKGLVDKDTLIKGVKDATALISLLSTNVDKDVIDAGKDLKIIANYGAGFNNIDIEYAREKSIDVTNTPKASTNATADLTIGLVLAVARRIVEGDQLSRTTGFDGWAPLFFRGREVSGKTIGIIGLGEIGSAVARRARAFDMDVLYTGPNRKEEKEREIGAKYVDLDTLLKNADFITINAAYNPKMHHLIDTEQFKMMKSTAYLINASRGPIVHEQALVQALKNNEIEGAALDVYEFEPDITDDLKSLNNVVLTPHIGNATFEARDMMSKIVANAAISAVQGEKPQFVVN

SEQ ID NO: 28489 - protein, 459 aa, Staphylococcus aureus subsp. aureus MRSA252
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEEVEGHPFKMPGGAVSNYLTILFLILVLVGMVFNVETRISVLIGVIFLTIVTIYYFIRYNKNNVKAK

SEQ ID NO: 28490 - protein, 389 aa, Staphylococcus aureus subsp. aureus MRSA252
MYKTKGGFQLTLQTLSLVVGFMAWSIIAPLMPFIKQDVNVTEGQISIILAIPVILGSVLRVPFGYLTNIVGAKWVFFTSFIVLLFPIFFLGQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVIMIIGAVILGISDHIALFTVGCLTISICAGIGNGLIFKLVPSYFSNEAGSANGIVSMMGGLGGFFPPLVITYVANLTGSSHLAFIFLAVFGCIALFTMRHLYQKEYGSLKHS

SEQ ID NO: 28491 - protein, 243 aa, Staphylococcus aureus subsp. aureus MRSA252
MIQLNNIHKSFNDVEVIKGIDLSVGKGEVVTLIGRSGSGKTTLLRMINALEIPTEGTVFVNGKTYTSKDKKSQIEVRKQSGMVFQSYNLFPHKTALENVMEGLITVKKLKKAEAREKSLELLEKVGLTHVKDQRPHALSGGQQQRVAIARALAMNPKVMLFDEPTSALDPELVNDVLKVIKDLANEGMTMVIVTHEMRFAREVSNNIVFIHEGVIGEQGAPEEIFNNPKTEELKRFLNVINEE

SEQ ID NO: 28492 - protein, 228 aa, Staphylococcus aureus subsp. aureus MRSA252
MPKLILCRHGQSEWNAKNLFTGWEDVNLSEQGINEATRAGEKVRENNIDIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 28493 - protein, 452 aa, Staphylococcus aureus subsp. aureus MRSA252
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNAFLSDSHGVNTFFHGHTYTGNQIVCTVALENIRLYEKCKLLSQIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 28494 - protein, 469 aa, Staphylococcus aureus subsp. aureus MRSA252
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 28495 - protein, 384 aa, Staphylococcus aureus subsp. aureus MRSA252
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSKIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKARRDRFEAMLTKADLPFFHAKGGIYVWLETPPGYDSEQFEQFLVKEKSILVAPGKPFGENGNRYVRISLALDDQQLDEAAIRLTELAYLYE

SEQ ID NO: 28496 - protein, 447 aa, Staphylococcus aureus subsp. aureus MRSA252
MYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALENICRENGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKNLKTRDASAALKICNYCFEHGVVIIAVAGNVLRFQPPLVITYEQLDTALNTIEDALTALEAGNLDQYDISGQGW

SEQ ID NO: 28497 - protein, 496 aa, Staphylococcus aureus subsp. aureus MRSA252
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEIDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 28498 - protein, 165 aa, Staphylococcus aureus subsp. aureus MRSA252
MNNRNVYDIEVSDYKGLTYKLEAFRGKVILVVNTATECIYSEQLKKLETLFQKYKDRGFVVLSFPNNNFDNRQPGSNEEILKISREKFGVTFPVLAKISVNGNDEHPLFTHLKNEQPGIFGSPIKWNFTKFIIDRQGNVVNRFLPMEDPLDISANIEILLQESSS

SEQ ID NO: 28499 - protein, 210 aa, Staphylococcus aureus subsp. aureus MRSA252
MTNYKIDFSKGLVPAILQDNQTKQVLMLGYMNQEAFDKTIEDGVVCFYSRSKQRLWTKGETSGHTQRVKDIHVDCDNDTILIDVIPNGPTCHTGSQSCFNTEVPFSVQTLAQTVQDSAQSNNEKSYTKYLLTEGIEKITKKYGEEAFEVVIEAIKGDKKAFVSEVADELYHLFVLMHALGVDFSEIEAELARRHHKRNNFKGERQNIEQW

SEQ ID NO: 28500 - protein, 476 aa, Azotobacter vinelandii
SQKFDVIVIGAGPGGYVAAIKSAQLGLKTALIEKYKGKEGKTALGGTCLNVGCIPSKALLDSSYKFHEAHESFKLHGISTGEVAIDVPTMIARKDQIVRNLTGGVASLIKANGVTLFEGHGKLLAGKKVEVTAADGSSQVLDTENVILASGSKPVEIPPAPVDQDVIVDSTGALDFQNVPGKLGVIGAGVIGLELGSVWARLGAEVTVLEAMDKFLPAVDEQVAKEAQKILTKQGLKILLGARVTGTEVKNKQVTVKFVDAEGEKSQAFDKLIVAVGRRPVTTDLLAADSGVTLDERGFIYVDDYCATSVPGVYAIGDVVRGAMLAHKASEEGVVVAERIAGHKAQMNYDLIPAVIYTHPEIAGVGKTEQALKAEGVAINVGVFPFAASGRAMAANDTAGFVKVIADAKTDRVLGVHVIGPSAAELVQQGAIAMEFGTSAEDLGMMVFAHPALSEALHEAALAVSGHAIHVANRKK

SEQ ID NO: 28501 - protein, 213 aa, Candida maltosa
DQSLNILLAGRDTTAGLLSFAVFELGRNPEVWSKLRQEIGDKFGLDSDSRIEDISFELLKLCEYLKAVINETLRLYPSVPRNGRFAAADTTLPHGGGKDGMSPILVRKGQTVMYSVYALQRDEKYYGKDANEFRPERWFEPEVRKLGWAFLPFNGGPRICLGQQFALTEASYVLVRLIQSFETLELSPEAAYPPAKLTHLTMCLFDGAPVRIE

SEQ ID NO: 28502 - protein, 377 aa, Platanus x acerifolia
RGVQSSGSVFNVNDYGAKGAGDISQAVMKAWKAACASQGPSTVLIPKGNYNMGEVAMQGPCKGSKIGFQIDGVVKAPADPSKFKSDGWVSFYRIDGLTVSGTGTLDGQGQTAWAKNNCDKNPNCKHAAMNLRFDFLKHAMVRDITSLNSKMFHINVLECEDITFQHVTVTAPGTSINTDGIHVGISKGVTITNTKIATGDDCISIGPGSQNVTITQVNCGPGHGISIGSLGRYNNEKEVRGITVKGCTFSGTMNGVRVKTWPNSPPGAATDLTFQDLTMNNVQNPVILDQEYCPYGQCSRQAPSRIKLSNINFNNIRGTSTGKVAVVIACSHGMPCSNMKIGEINLSYRGAGGPATSTCSNVKPTFSGKQVPAIKCA

SEQ ID NO: 28503 - protein, 160 aa, Citrullus lanatus
IIAKGHYTERAAASLLRTIVQIVHTCHSMGVIHRDLKPENFLLLSKDEDSPLKATDFGLSVFYKQGEVFKDIVGSAYYIAPEVLKRRYGPEVDIWSVGVMLYILLCGVPPFWAESEHGIFNAILRGHIDFTSDPWPTISPAAKDLVRKMLNSDPKQRLTA

SEQ ID NO: 28504 - protein, 309 aa, Zea mays
MEGGAGASEKGTVLVTGASGFVGSWLVMKLLHAGYTVRATVRDPANVGKTKPLMDLPGAKERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALAYAAEHGLDLVTIIPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTF

SEQ ID NO: 28505 - protein, 470 aa, Cicer arietinum
LDPIYSGSKGGVIMFSRALRLYKRQGIRVNVLCPEFVETDMGTMIGPKFLSMMGGFVPMEMVVKGAFELITDENKAGDCLWITNRRGLEYWPTPSEEAKYLLRSTRSRRRTEYKAPPIKLPESFEKIVVQTLTHNFRNATSVVRAPLRLPIKPNYVLVKIIYAGVNASDVNFSSGRYFGGNNSDTASRLPFDAGFEAVGVIAAVGDSVTDLKVGMPCAFMTFGGYAEFTMIPSKYALPMPRPEPEGVAMLTSGLTASIALEKAGQMESGKVVLVTAAAGGTGQFAVQLAKLAGNTVVATCGGGAKAKLLKELGVDRVIDYHSEDIKTVLRKEFPKGIDIIYESVGGDMLKLCLDALAVHGRLIVIGMISQYQGENGWTPSKYPGLCEKLLSKSQTVAGFFLVQYSHMYQEHLNKLFDLYSSGKLKVAVDPKRFIGLHSVADAVEYLHSGKSVGKVVVCVDPTFGHQVAKL

SEQ ID NO: 28506 - protein, 382 aa, Fusarium oxysporum
MDQLTNTRYKKPHAEIALIQAYNKYHKPLPPKLKKIAQHEADLIKNKLGMKGTASATPPQYYDSQYVVPVKIGTPAQQTYLNFDTGSSDLWVFSTDTYQPDQAGHILYKPDKSTTSKRLNGQTWSIRYGDGTGASGIVYTDKVQVGKTYVNKQAVESATEVSDGIASDKFSHGIMGLAMSSLNTVRPTPQNTYFQNVQNNLAVPVFTANLQKGKAGNYNFGYIDQGEYYGSIQFAKVKKGSPWWQINIEGYRIAAGAPWHKYNYSAIVDTGTTLLLLPGVLTNFYYRKVKGAYIDQDYGVWVFPCTSKLPSFYFGFGSYQGKVPGNYINYGRLTNTVCYGGIQSSDGIGFAILGDILLKAQFVVFDLKGQRVGFANKLTIKS

SEQ ID NO: 28507 - protein, 132 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKTSGRTGKPSQEL

SEQ ID NO: 28508 - protein, 363 aa, Aspergillus terreus
MGDQPFIPPPQQTALTVNDHDEVTVWNAAPCPMLPRDQVYVRVEAVAINPSDTKMRGQFATPWAFLGTDYAGTVVAVGSDVTHIQVGDRVYGAQNEMCPRTPDQGAFSQYTVTRGRVWAKIPKGLSFEQAAALPAGISTAGLAMKLLGLPLPSPSADQPPTHSKPVYVLVYGGSTATATVTMQMLRLSGYIPIATCSPHNFDLAKSRGAEEVFDYRAPNLAQTIRTYTKNNLRYALDCITNVESTTFCFAAIGRAGGHYVSLNPFPEHAATRKMVTTDWTLGPTIFGEGSTWPAPYGRPGSEEERQFGEDLWRIAGQLVEDGRLVHHPLRVVQGGFDHIKQGMELVRKGELSGEKLVVRLEGP

SEQ ID NO: 28509 - protein, 2532 aa, Aspergillus terreus
MTPLDAPGAPAPIAMVGMGCRFGGGATDPQKLWKLLEEGGSAWSKIPPSRFNVGGVYHPNGQRVGSMHVRGGHFLDEDPALFDASFFNMSTEVASCMDPQYRLILEVVYEALEAAGIPLEQVSGSKTGVFAGTMYHDYQGSFQRQPEALPRYFITGNAGTMLANRVSHFYDLRGPSVSIDTACSTTLTALHLAIQSLRAGESDMAIVAGANLLLNPDVFTTMSNLGFLSSDGISYSFDSRADGYGRGEGVAAIVLKTLPDAVRDGDPIRLIVRETAINQDGRTPAISTPSGEAQECLIQDCYQKAQLDPKQTSYVEAHGTGTRAGDPLELAVISAAFPGQQIQVGSVKANIGHTEAVSGLASLIKVALAVEKGVIPPNARFLQPSKKLLKDTHIQIPLCSQSWIPTDGVRRASINNFGFGGANAHAIVEQYGPFAETSICPPNGYSGNYDGNLGTDQAHIYVLSAKDENSCMRMVSRLCDYATHARPADDLQLLANIAYTLGSRRSNFRWKAVCTAHSLTGLAQNLAGEGMRPSKSADQVRLGWVFTGQGAQWFAMGRELIEMYPVFKEALLECDGYIKEMGSTWSIIEELSRPETESRVDQAEFSLPLSTALQIALVRLLWSWNIQPVAVTSHSSGEAAAAYAIGALTARSAIGISYIRGALTARDRLASVHKGGMLAVGLSRSEVGIYIRQVPLQSEECLVVGCVNSPSSVTVSGDLSAIAKLEELLHADRIFARRLKVTQAFHSSHMNSMTDAFRAGLTELFGADPSDAANASKDVIYASPRTGARLHDMNRLRDPIHWVECMLHPVEFESAFRRMCLDENDHMPKVDRVIEIGPHGALGGPIKQIMQLPELATCDIPYLSCLSRGKSSLSTLRLLASELIRAGFPVDLNAINFPRGCEAARVQVLSDLPPYPWNHETRYWKEPRISQSARQRKGPVHDLIGLQEPLNLPLARSWHNVLRVSDLPWLRDHVVGSHIVFPGAGFVCMAVMGISTLCSSDHESDDISYILRDVNFAQALILPADGEEGIDLRLTICAPDQSLGSQDWQRFLVHSITADKNDWTEHCTGLVRAEMDQPPSSLSNQQRIDPRPWSRKTAPQELWDSLHRVGIRHGPFFRNITCIESDGRGSWCTFAIADTASAMPHAYESQHIVHPTTLDSAVQAAYTTLPFAGSRIKSAMVPARVGCMKISSRLADLEARDMLRAQAKMHSQSPSALVTDVAVFDEADPVGGPVMELEGLVFQSLGASLGTSDRDSTDPGNTCSSWHWAPDISLVNPGWLEKTLGTGIQEHEISLILELRRCSVHFIQEAMESLSVGDVERLSGHLAKFYAWMQKQLACAQNGELGPESSSWTRDSEQARCSLRSRVVAGSTNGEMICRLGSVLPAILRREVDPLEVMMDGHLLSRYYVDALKWSRSNAQASELVRLCCHKNPRARILEIGGGTGGCTQLVVDSLGPNPPVGRYDFTDVSAGFFEAARKRFAGWQNVMDFRKLDIEDDPEAQGFVCGSYDVVLACQVLHATSNMQRTLTNVRKLLKPGGKLILVETTRDELDLFFTFGLLPGWWLSEEPERQSTPSLSPTMWRSMLHTTGFNGVEVEARDCDSHEFYMISTMMSTAVQATPMSCSVKLPEVLLVYVDSSTPMSWISDLQGEIRGRNCSVTSLQALRQVPPTEGQICVFLGEVEHSMLGSVTNDDFTLLTSMLQLAGGTLWVTQGATMKSDDPLKALHLGLLRTMRNESHGKRFVSLDLDPSRNPWTGDSRDAIVSVLDLISMSDEKEFDYAERDGVIHVPRAFSDSINGGEEDGYALEPFQDSQHLLRLDIQTPGLLDSLHFTKRNVDTYEPDKLPDDWVEIEPRAFGLNFRDIMVAMGQLESNVMGFECAGVVTSLSETARTIAPGLAVGDRVCALMNGHWASRVTTSRTNVVRIPETLSFPHAASIPLAFTTAYISLYTVARILPGETVLIHAGAGGVGQAAIILAQLTGAEVFTTAGSETKRNLLIDKFHLDPDHVFSSRDSSFVDGIKTRTRGKGVDVVLNSLAGPLLQKSFDCLARFGRFVEIGKKDLEQNSRLDMSTFVRNVSFSSVDILYWQQAKPAEIFQAMSEVILLWERTAIGLIHPISEYPMSALEKAFRTMQSGQHVGKIVVTVAPDDAVLVRQERMPLFLKPNVSYLVAGGLGGIGRRICEWLVDRGARYLIILSRTARVDPVVTSLQERGCTVSVQACDVADESQLEAALQQCRAEEMPPIRGVIQGAMVLKDALVSQMTADGFHAALRPKVQGSWNLHRIASDVDFFVMLSSLVGVMGGAGQANYAAAGAFQDALAEHRMAHNQPAVTIDLGMVQSIGYVAETDSAVAERLQRIGYQPLHEEEVLDVLEQAISPVCSPAAPTRPAVIVTGINTRPGPHWAHADWMQEARFAGIKYRDPLRDNHGALSLTPAEDDNLHARLNRAISQQESIAVIMEAMSCKLISMFGLTDSEMSATQTLAGIGVDSLVAIELRNWITAKFNVDISVFELMEGRTIAKVAEVVLQRYKA

SEQ ID NO: 28510 - protein, 469 aa, Erwinia carotovora subsp. atroseptica SCRI1043
MSAEHVLTMLNEHEVKFVDLRFTDTKGKEQHVTIPAHQVNADFFEEGKMFDGSSIGGWKGINESDMVLMPDASTAMIDPFFEDTTLIIRCDILEPGTMQGYDRDPRSIAKRAEDFLRSSGIADTVLFGPEPEFFLFDDIRFGSSTSGSHVAIDDVEAYWNSGKAYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKDGTNLFAGDKYGGLSEMALFYIGGVIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEALAALNEDREFLTRGGVFTDDAIEAYIELRKPEIDRVRMTPHPVEFELYYSV

SEQ ID NO: 28511 - protein, 450 aa, Erwinia carotovora subsp. atroseptica SCRI1043
MTKHYDYLAIGGGSGGIASINRAAMYGQKCALIEAKYLGGTCVNVGCVPKKVMWHAAQIAEAIHQYGPDYGFDTTVNQFNWGTLVKNRSAYIDRIHQSYDNVLGKNKVDVIHGFARFVDAHTVEVNGEKITADHILIATGGRPVHPNIPGAEYGIDSDGFFELDALPKRTAIVGAGYIAVEIAGVLNGLGSETHLFVRKHAPLRSFDPLIVDTLVEVMNTEGPTLHTESIPKAIVKNADGSLTLELENGQSQTVDCLIWAIGREPATDNLNLSVTGVGLNDKGYINVDKFQNTTVSGIYAVGDNTGAVELTPVAVAAGRRLSERLFNNKPDEHLDYSNIPTVVFSHPPIGTVGLTEPQAREQYGDDQVKVYKSAFTAMYTAVTQHRQPCRMKLVCVGKEEKIVGIHGIGFGMDEMLQGFAVAVKMGATKKDFDNTVAIHPTASEEFVTMR

SEQ ID NO: 28512 - protein, 511 aa, Erwinia carotovora subsp. atroseptica SCRI1043
MAHDNLEGRSAFGEVGSLDLKKRYDNFIGGTWVPPDAGQYFVNLTPVTGQPMCEVASSSTRDIDHALDAAHKAKAEWGGLSVQERALVLNRIADRMEQNLERLAQVETWDNGKPIRETSGADVPLAIDHFRYFAACIRAQEGAISEIDGDTVAYHFHEPLGVVAQIIPWNFPLLMACWKMAPALAAGNCIVLKPAKLTPMSVLILMELIQDLLPAGVINVVNGSGSEIGEYLATSKRVAKVAFTGSTEVGQQIMSYAAQNVTPVTLELGGKSPNIFFADVMDKEDSFFDKALEGFTLFAFNQGEVCTCPSRALVQESIYDRFMERAIKRVEAIRIGNPLDSKTMMGAQVSAGQLETILNYIDIGKKEGARVLTGGQRKAMPGGLAEGYYLEPTILFGKNSMRVFQEEIFGPVLAVTTFKTMEDALEIANDTEYGLGAGVWSRNGNVAYRMGRGIQAGRVWTNCYHAYPAHAAFGGYKQSGIGRENHKMMLDHYQQTKCLLVSYSDKPMGLF

SEQ ID NO: 28513 - protein, 479 aa, Erwinia carotovora subsp. atroseptica SCRI1043
MSTTQKRMYINGEFVENRSGKWIDVVNPATEQVISQVPEGSADDAKRAIDAAEAAQPSWEALPAVERGVWLHKIAAGIREREAELTDTIIAEGGKTHGLAQTEVLFTADYLDYMAEWARRYEGEIIQSDRPNENIFVFRKAIGVTTGILPWNFPFFLIARKAAPALITGNTIVIKPSEITPNNAVIFAEIIHKIGLPKGVINFVTGYGPTVGQELAGNPKVGMVSLTGSVAAGIATMTAAAQNVTKVSLELGGKAPAIVMDDADLDLAVKAIVSSRVINSGQVCNCAERVYVQKGIYDEFIIRIKAAMEQVTFGNTAEKKTLDMGPLISAAALQRVEDKVAKAVSQGAKVLLGGKSESGTGYFYPPTLLVNVTQEMPIMHEEVFGPVLPVATFDTLEDAIAMANDSEYGLTSSIYTQNINTAMKALKGLKFGETYINRENFEAMQGFHAGWRKSGVGGADGKHGLQEYLQTHVAYLQFH

SEQ ID NO: 28514 - protein, 253 aa, Erwinia carotovora subsp. atroseptica SCRI1043
MNQTALTQSTDHMITLENVNKWYGQFHVLKDINLQVRQGERIVLCGPSGSGKSTTIRCINHLEEHQQGRIVVDGIELNNDLRNIEKVRTEVGMVFQHFNLFPHLTVLQNCTLAPSWVRHTPKKEAEELAMHYLERVRIAAHAHKFPGQLSGGQQQRVAIARSLCMKPKIMLFDEPTSALDPEMVKEVLDTMLGLAQDGMTMLCVTHEMGFAKTVADRVIFMDQGEIVEQAPPDIFFSSPRSERTQSFLSQILH

SEQ ID NO: 28515 - protein, 484 aa, Erwinia carotovora subsp. atroseptica SCRI1043
MSGNHLQDHELFKTGYFVAGKWQQGAATFEVVNPATGESIARVAKAGKKETQAAIDAAHAAFPAWKRKTAKERSEILYRWYELILENKRYLAELMTAEQGKPVQEAEGEVVYAANFIQWFAEQGKRVNGEIIPPAKPGSKIYATREPVGVVVAITPWNFPLAMLTRKLGPALAAGCTGVIKPANNTPLSAFALLALAQQAGVPDGVLNGVAGDTQAISDTVMASDKVRKISFTGSTAVGKTLVRNAADTMKKVSMELGGNAPYIVFDDADIQAAVKGAIANRFRNAGQVCVSANRFYIQDGVYDEFVSLLAEEVKKLKVGNGMDDGVVLGPLIDEAAVEKVEKHVNDAVEKGGKALVGGKRHKLGHSFFEPTVIVDANEAMLLAQEETFGPVAPCFRFKTEEEVIQRANNTPFGLAAYFYSQNLQRVFRVAEALESGMIGINECAVSTELAPFGGVKESGLGREGSVLGLDEFLEVKTWHVGGL

SEQ ID NO: 28516 - protein, 270 aa, Erwinia carotovora subsp. atroseptica SCRI1043
MNHEATNLVEIRGLSFRRGEREIFTDITLNVPKGKVTAIMGPSGIGKTTLLRLIGGQLSPDSGEIWFDGENIPALSRSELYNARKKMSMLFQSGALFTDLNVFDNVAWPLREHTQLPESLLRSIVMMKLEAVGLRGAAELMPAELSGGMARRAALARAIALDPQLIMFDEPFVGQDPITLGTLVKLIDELNHALGVTCVVVSHDVPEVMSIADYAYIVADKRVIAEGTADQLRANDDPQVRQFLDGIADGPVPFRFPAGDYKTSLLGSGG

SEQ ID NO: 28517 - protein, 472 aa, Erwinia carotovora subsp. atroseptica SCRI1043
MSQNVYQFIDLQRVDPPKKPLKIRKIEFVEIYEPFSESQSKAQADRCLSCGNPYCEWKCPVHNYIPNWLKLANEGRIIEAAELSHQTNSLPEVCGRVCPQDRLCEGSCTLNDEFGAVTIGNIERYINDKAIEMGWKPSVANVIPTGKRVAIIGAGPAGLACADVLARSGVQAVVFDRHPEIGGLLTFGIPSFKLEKEVMVKRREIFTEMGIEFRLNTEVGKDVQMKALLDEYDAVFLGVGTYQSMRGGLDNEDAQGVYDALPFLIANTKQLMGFEAATDEPYISMQGRRVVVLGGGDTAMDCVRTSIRQAATHVTCAYRRDEENMPGSKREVKNAREEGVEFKFNLQPLSVEVNGAGKVCGVKMARTALGVPDANGRRRPEIVEGSEHVLEADAVIMAFGFRPHKMAWLAEHDVKLDDQGRIVAPESCDNAFQTSNPKIFAGGDAVRGSDLVVTAIAEGRKAADGIMNYLEV

SEQ ID NO: 28518 - protein, 311 aa, Erwinia carotovora subsp. atroseptica SCRI1043
MANKIWVMGDAVVDLIPEDTERYLKCPGGAPANVAVGIARLGGNSAFVGRVGDDVFGHFLKTVLEEENVDTHYMAYDRHHRTSTVVVSLDDAGERTFTFMVRPSADLFLQPEDLPVFNRREWLHLCSIALSQEPSRSTAFEAMRQIKAALGRVCFDPNIRDDLWQSEQELRDCLTQALMLADVVKLSCEELTFLCPTSDVEEGIQQFMLRYPTRLLLVTLGSEGVWLHDRHQLQHFAAPSVTPVDTTGAGDAFVAGLLHGLAEYDDLSQPLSWDPIIEQAQRCGALATTAKGAMTALPYAQQLYTLPLAKV

SEQ ID NO: 28519 - protein, 460 aa, Erwinia carotovora subsp. atroseptica SCRI1043
MAKAIKRAFVCNECGADYPRWQGQCSACHAWNTITEVRLASASVSRSDRLTGYAGESAGVSRVQKLSEISLEALPRFSTGFLEFDRVLGGGVVPGSAILIGGSPGAGKSTLLLQTLCKLSEHMKTLYVTGEESLQQVAMRAHRLNLPTQNLNMLSETSIEQICLIAEQEQPKLMVIDSIQVMHLADIQSSPGSVAQVRETAAYLTRFAKTRGVAIVMVGHVTKDGSLAGPKVLEHCIDCSVLLDGDADSRFRTLRSHKNRFGAVNELGVFAMTEQGLREISNPSAIFLSRGDEVTSGSSVMVVWEGTRPLLVEIQALVDQSMMANPRRVAVGLEQNRLAILLAVLHRHGGLQMSDQDVFVNVVGGVKVTETSADLALLLSLVSSFRDRPLPQDLVIFGEVGLAGEIRPVPSGQERITEAAKHGFKRAIIPHANMPKKAPASMQVFGVKKLADALAILDDL

SEQ ID NO: 28520 - protein, 467 aa, Erwinia carotovora subsp. atroseptica SCRI1043
MRRNTMKAFPDGFLWGGSVAANQVEGAWNEDGKGVSTSDLQLKGVHGPVTERDESISCIKDRAIDFYHQYPQDIQLFAEMGFKVLRTSIAWTRIYPEGNEAEPCEAGLAFYDHLFDEMAKHHIQPLITLSHYEMPYGLVKKLGGWGNRAVIDHFEKYARTVFSRYKDKVKHWLTFNEINMALHSPFTGIGLSGEPSKQDIYQAIHHQLVASARVVKACHDIIPDAKIGNMLLGAVRYPMTCHPKDVLEAQNKNREWLFFGDVQVRGTYPAWIQRYFRENDVELTITAQDKDDLSHTVDFVSFSYYMSGCATFEPEKYQSSRGNIIRLIPNPHLEASEWGWQIDPEGLRFLLNELYDRYQKPLFIVENGLGARDVVEEDGSIHDSYRIDYLRRHLIQVREAIDDGVELLGYTSWGPIDLVSAGTAQMSKRYGFIHVDRDDEGKGTLERRRKDSFYWYQDVISSNGKSL

SEQ ID NO: 28521 - protein, 445 aa, Erwinia carotovora subsp. atroseptica SCRI1043
MSNRKYFGTDGIRGKVGDTPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDDVEEAIEAEMEKPLTCVESSELGKASRIVDAAGRYIEFCKGTFPGELSLNGLKIVVDCANGATYHIAPSVLRELGAKVIAIGCEPDGMNINEECGATDVRQLQARVLAEKADVGLAFDGDGDRLIMVDHLGNKVDGDQILYIIAREGLRQGQLRGGAVGTLMSNMGLEVALKQLGIPFARAKVGDRYVLEMMQTKGWRIGAENSGHVILLDKTTTGDGVIAGLQVLTAIVKNHMSLHDLCSGMKLFPQILVNVRFTGENDPLEDKSVQQITQDVEKELAGRGRVLLRKSGTEPLIRVMVEGEHEETVIAQANRIADAVKAVS

SEQ ID NO: 28522 - protein, 330 aa, Erwinia carotovora subsp. atroseptica SCRI1043
MQKRKLGANGPQVSAIGLGCMGMSDFYSTAQDEKESIATLHRALELGVTLLDTADMYGPHTNEQLLGNAIKGKREQVFLATKFGIVRDPANPYARGVCGKPDYIRRAVEGSLKRLGTDVIDLYYQHRIDPTVPIEETVGALAELVKEGKIRYIGLSEASVTTLERAHRVHPITALQSEYSLWTRDMEAEILPTCERLGIGFVPYSPLGRGFLTGAIRSLDDLAADDFRRTNPRFAGENFGKNLQLVEKINQLAQEKQATPSQLALAWVLAQGEHIVPIPGTKRRLYLEENVAALDVTLTKEELAAINAIFPPDAAAGERYGKESMATLNQ

SEQ ID NO: 28523 - protein, 451 aa, Erwinia carotovora subsp. atroseptica SCRI1043
MSNTTRQAGSQGSLDAFFKITQRGSNVRQEVLAGLTTFLAMVYSVIVVPSMLGKAGFPPTAVFVATCLVAGLGSLLMGLWANLPMAIGCAISLTAFTAFSLVLGQQISIPVALGAIFLMGVLFTIISVTGIRSWILRNLPLGVAHGTGIGIGLFLLIIAANGVGLVVKNPIDGLPVALGNFTSFPVIMSLLGLAATIGLEKRRVPGGILLVIVVISILGLIFDPNVKYAGFFALPSLTAADGSSLIFSLDIMGALQPLVLPSVLALVMTAVFDATGTIRAVAGQANLLDKDGQIINGGKALTADSVSSIFCSLVGTSPAAVYIESAAGTAAGGKTGLTATVVGVLFLLLLFVSPLAYLVPGYATAPALMYVGLLMLGNVSKLNFDDFVDAMSGLVCAVFIVLTCNIVTGIMLGFGALVLGRICSGEWRKLNIGTVIIAVALVAFYAGGWAL

SEQ ID NO: 28524 - protein, 475 aa, Erwinia carotovora subsp. atroseptica SCRI1043
MHYQQQKHFPAGFLWGASTSAYQVEGGWQADGKSPSIIDKCQHPENTADFTVASDHYHRFKDDVQLFAELGLKAYRFSIAWTRILPNGTGDVNPLGIAFYNELIDELNAHGIEPVVTLYHFDLPYCLEAQGGWQNRATIDAFVHYARTLFTHFGDKVKYWLTINEQNTMILHPGAIGLPEGGVLPSKKALYQQNHHMMLAQAQVMALCHELAPNGLIGPAINTTSMYQATSKPEDAIAAHNWETLRCWSFLDVAVHGRYNALAWRYLEDRGLAPETLPGDDEILQSGKPDYVAINYYSTATIAASKGDASDVSARAGDQQIMLGEPGVYRAAENPHVDKTPYGWVIDPIGLRLTLRKTYERYHLPILITENGMGAPDKLEADGTINDQYRIDFIARHIEQIQLAISDGVDLIGYCPWSAIDVVSTHQGYGKRYGFIYVNRDEFDLKDLRRIKKKSFYWYQGVIESNGTRLFPREP

SEQ ID NO: 28525 - protein, 259 aa, Erwinia carotovora subsp. atroseptica SCRI1043
MSSRKLTLGVSLKMYFGYQQTLDWCQKIHEIAEQHPLASLPSARLFVLPAFPTLAPVVQRFAQSPVHVGAQDLHWTDNGAFTGEVSGTMLHEMGCRYVEIGHAERRRYFGETDEHFALKTAAAWRNGLTPVLCVGEEQRGSTQQAIDTCQAQLAAALNLAQKQQLTGDLVLAYEPQWAIGSTEPAPTAYISEVCQALKQHLPTQAGVREGRIIYGGSAGPGLLSQLGDAVDGLFLGRFAHDPAAFNAIMDEAFTLSSQA

SEQ ID NO: 28526 - protein, 293 aa, Erwinia carotovora subsp. atroseptica SCRI1043
MTTLEQCIGNTPLVKLQRMTQGLKSEIWLKLEGNNPAGSVKDRAAFSMILQAENRGDITPGDRLIEATSGNTGIALAMIAALKGYRLRLLMPDNMSYERQTAMRAYGAELVLVNRKLGMEGARDRAKQMVLAGEGKTLDQFNNPDNSLAHFLTTGPEIWQQTAGKLTHFISSMGTTGTISGVSRYLKQQNPAICTVGLQPAEGSHIPGIRRWTPDYMPGIFRADLVDRILDMTQVDAENTLRQLARQEGIFCGVSTGGAVAGALRIAAENPGSVIVAIACDRGDRYLSTGVFD

SEQ ID NO: 28527 - protein, 322 aa, Erwinia carotovora subsp. atroseptica SCRI1043
MSKIYEDNSFTIGHTPLVRLNRIGNGRILAKVESRNPSFSVKCRIGSNLIWDAEKRGVLKPGIELVEPTSGNTGIALAYVAAARGYKLTLTMPETMSIERRKLLKALGANLVLTEGAKGMKGAIAKAEEIVASDPSRYLLLQQFSNPANPEIHEKTTGPEIWEDTDGEVDVFISGVGTGGTLTGVSRYLKNTKGKAIISVAVEPTDSPVISQALAGEELKPGPHKIQGIGAGFIPGNLDLELIDRVEKVTNEEAISTARRLMEEEGILAGISSGAAVAAALNLLKEKEFDGKTIVVILPSSGERYLSTALFADLFTEQELQQ

SEQ ID NO: 28528 - protein, 379 aa, Erwinia carotovora subsp. atroseptica SCRI1043
MMKDIVIIGAGFAARQLIRQLRKLDAHCPIRLITADSGDEYNKPDLSHVMSLQQHADDLTKMQATAFAEENRIALQANTRVTAIDRNAQQVVCGTDRYDYHKLVFATGASAIVPPIPGREHMLTLNSQQEYRTHEARLWQAERVLVLGAGLIGTELAMDLSRAGKRVTLVDCASSILPALMPPEVSARLQFTLTQQGVSLLLNTTVQQLEKTETGVQARFTDGRTVEVDEIISAVGLQANTQLAKAADLAVQKGIQTNAQLQTPDPQIYALGDCAEIGGKLLPFLQPIQLSAITLAKNLLGASEALTLPPMLVKIKTPLFPLQMAGDTTGSDLHWQQEWNEQGMVAKALDSQQRLRAFVVGGERMKEAFPLLRQLSATI

SEQ ID NO: 28529 - protein, 177 aa, Erwinia carotovora subsp. atroseptica SCRI1043
MIDDDGYRPNVGIVICNRQGQVMWARRYGQHSWQFPQGGINPGESPEQAMYRELFEEVGLRKKDVRVLASTRNWLRYKLPKRLVRWDTKPVCIGQKQKWFLLQLMCNESDINMQSSGTPEFDGWRWVSYWYPVRQVVSFKRDVYRRVMKEFISPVILLQESVAARVATPPSPRRKRG

SEQ ID NO: 28530 - protein, 402 aa, Erwinia carotovora subsp. atroseptica SCRI1043
MEYQSGKRVLSLSLGLIGLFSASAWASDSRTVSEPKVPSSCTVLKADSSTATSAIQKALNNCGQGKAVRLSAGSSSVFLSGPLSLPSGASLLIDKGVTLRAINNAKSFENSPSSCGVVDKNGKGCDAFITAVSTTNSGIYGPGTIDGQGGVKLQDKKVSWWELAADAKVKKLKQNTPRLIQINKSKNFTLYNVSLINSPNFHVVFSDGDGFTAWKTTIKTPSTARNTDGIDPMSSKNITIAYSNISTGDDNVAIKAYKGRAETRNISILHNDFGTGHGMSIGSETMGVYNVTVDDLKMNGTTNGLRIKSDKSAAGVVNGVRYSNVVMKNVAKPIVIDTVYEKKEGSNVPDWSDITFKDVTSETKGVVVLNGENAKKPIEVTMKNVKLTSDSTWQIKNVNVKK

SEQ ID NO: 28531 - protein, 458 aa, Erwinia carotovora subsp. atroseptica SCRI1043
MEQPSSKLKRGLSTRHIRFIALGSAIGTGLFYGSASAIQMAGPSVLLAYLIGGIVAYIIMRALGEMSVHNPQSSSFSRYAQDYLGPLAGYVTGWTYCFEMLIVAIADVTAFGIYMGVWFPAVPHWVWVLSVVLIIGAINLMNVKAFGELEFWLSFFKVATIIIMIAAGIGIIVWGIGNGGEPTGIHNLWSNGGFFSNGVMGTILSLQLVMFAYGGVEIIGITAGEAKDPHKSIPRAINSVPWRILVFYVGTLFVIMSIYPWNQVGTNGSPFVLTFQHMGITAAAGILNFVVITASLSAINSDVFGVGRMLHGMAEQGHAPKVFSRVSKRGIPWVTVVVMMMALLVAVYLNYIMPGKVFLVIASLATFATVWVWIMILFSQIAFRRRLSVDEVKALAFPLRGGIATSVFGIVFLFFIIGLIGYFPDTRISLYVGIIWILVLLVGYVWKKKHQNAVAAQN

SEQ ID NO: 28532 - protein, 358 aa, Erwinia carotovora subsp. atroseptica SCRI1043
MTNAWVKNAISAIEADFQRSADTHLIRLTLPDYPGIYFYLKDESTHPSGSLKHRLARSLFLYGLCNGWIKEGTPIIEASSGSTAVSEAYFARLLGLPFIAVMPSCTAKRKIEQIAFYGGRCHFVEQAGQIYAASEQLAQEMNGHYMDQFTYAERATDWRGNNNIADSIYRQMAREPHPVPDYIVMSAGTGGTSATLGRYIRYQGLDTQLVVVDPENSVFYDCYQKQDRSIIGPCGSRIEGIGRPRAEPSFIPGVIDSMIKVPDAASIATLYWLESVLGRKAGASTGTNVWGMLQLAKEMVNHGQKGAIVTLLCDSGERYLDTYYNSSWVEKNIGDISPYLNALNNPEMSFLIPEPSLA

SEQ ID NO: 28533 - protein, 214 aa, Erwinia carotovora subsp. atroseptica SCRI1043
MRIILLGAPGAGKGTQAQFIMGKYGIPQISTGDMLRAAVKAGTELGKQAKEIMDAGKLVTDELVIALVKERIAQDDCRNGFLLDGFPRTIPQADAMKDAGIDVDYVIEFAVPDELIIDRIIGRRVHAASGRVYHVKFNPPKVEDKDDVTGEDLSVRKDDQEDTVRKRLVEYHQQTAPLVSYYQKEADAGNTRYFKVEGTRKVEEVRAELETILG

SEQ ID NO: 28534 - protein, 460 aa, Erwinia carotovora subsp. atroseptica SCRI1043
MRSGLALSLMASCITLGIQAGTAQAASSVKFPDKTCDVTQYGAEGHRLQIALNTEAFQKAIDDCAAAGGGTVHVPRGNYLVDPLFLKSNIRLDLAKDATIVASTEVAAYRATEKTKYAEAENGWLPFISIADAQNVAITGQGTIDGQGAVWWERWRENIRATGKKGGTDRPRLIYIKSSSNVLVDGVTLTHSPSFHVVMRYSHDVDVNGTRILSPWHAPNTDAIDPIDSQNIRITNNYIDCNDDHIAIKAEKPDSRFPNGVVDNIYIANNILKQGRGISIGSETSGGVNNVLVENNQFEGSMYGIRIKTLRGKGGEVKNITYRNTKMVDVEIPLVFAAYYKAAPIVQAEVDKMLAEGGFTMGEQIYPPDTDPEQPFDQYKTPHFSNVTIENLESTGKTKAAAYIIGVPEAPLSGFHFDNVRIDADKGIRVRNAELQTKGLTVNVKEGPVMQLDKGAKVDQ

SEQ ID NO: 28535 - protein, 476 aa, Erwinia carotovora subsp. atroseptica SCRI1043
MAILTDWPWRYWASQTPQPVPLNEPVALIDDETRWSWQMLAQRVDRLAEHFAQQGVTAESTVALRGKNSVPMLCSYLALLQCGARALPLNPQLPDTLTEVLLPALNVACGLCLNDKPWPDSVRTLSLPSASSLSGDIEETIDTNRLRWQDERLATLTLTSGSSGMPKAVAHTFSAHISSAEGVVQMMAFSASDSWLLSLPLFHVSGQGIIWRWLATGATIVVRAHQPLDTALRDCTHASLVPTQLWRLLSEKAFPEALKAVLLGGAMIPQTLTQQAEARGVSCWCGYGLTELASTVCAKRADGRSGVGMPLLGREIQLVDDEILLRGSTLAAGYWRDGKLIPLVDDDGWFHTRDRGLFTEGEWHIQGRLDNQFFSGGEGVQPENIEAVLLTHPAVQQACIVPVEDVEFGHRPVAVLEVVQTTTLDAVRDWLQPQLAGFQRPVAYYALPAELKNGGIKLSRQQVKNWVKATYPQPKR

SEQ ID NO: 28536 - protein, 215 aa, Erwinia carotovora subsp. atroseptica SCRI1043
MDAKELIARRVALELKNGDVVNLGIGLPTKVANYVPHGIEVTFQSENGFLGLGAITEPDGNLVNAGGQACGMVPGAAMFDSAFSFALIRGGHVDVCVLGGLQVDEHGNLANWMVPGKMVPGMGGAMDLVVGAKKVIIALEHCAKNGDAKLLHQCTYPLTAANKVSMVVTELAVFHFINQQMVLTEISPDITVDELRQKTEANFIVSADVKPFSIH

SEQ ID NO: 28537 - protein, 218 aa, Erwinia carotovora subsp. atroseptica SCRI1043
MKNKVIDASHFRSYLFDGMTIMFGGFMGVGTPKLLVDEIIKSGVSDLTLIGNDTGFVDTGVGPLIVSGQVKKLITSHIGTNPETGRRMISGELDVELVPQGTLAERIRSGGAGLGGFLTPTGVGTIVEENKQKITINDITYLLELPIKADLAILQASIADTSGNLIYHLTARNFNPLIALAAKKVVAQCEQVIPVGQLAPECIVTPAALVDHLYLGEK

SEQ ID NO: 28538 - protein, 241 aa, Erwinia carotovora subsp. atroseptica SCRI1043
MISLKNISKWYGQFQVLADCSTEVKKGEVVVVCGPSGSGKSTLIKTVNGLEPIQKGDITVNGIAVNDKKTNLAQLRSKVGMVFQHFELFPHLSIIENLTLAQVKVLKRKREEAKAKAQKLLERVGLSAHANKYPGQLSGGQQQRVAIARALCMDPIAMLFDEPTSALDPEMINEVLDVMVELAQEGMTMMVVTHEMGFARKVAHRVIFMDEGKIVEDTRKDDFFNNPQSERAKDFLAKILH

SEQ ID NO: 28539 - protein, 242 aa, Erwinia carotovora subsp. atroseptica SCRI1043
MDIASRYCAEVIMTTAELATPAAIAIDKLSHAFAGKTVLDSICLNVSRGTILALLGPSGCGKSTLLKLLAGLLQPDAGTIHFGDRQVAGHQLSLPPEQRNLGMVFQDYALWPHMTVAQNVGFPLLMRKVPRDICRQRVDVTLARVGLADFADRKPADLSGGQQQRVALARAIIAEPNILLFDEPLSNLDRDLRESLCQEMASLLRHLGTTAVYVTHDRGEANILAHRIVHMSQGYITDITTR

SEQ ID NO: 28540 - protein, 250 aa, Erwinia carotovora subsp. atroseptica SCRI1043
MAVTKLVLVRHGESQWNNENRFTGWYDVDLSEKGRSEAKAAGQLLKDEGFAFDFAYTSVLKRAIHTLWSVLDELDQAWLPVEKSWKLNERHYGALQGLNKAETAEKYGDEQVKQWRRGFAITPPELTRDDERFPGHDPRYASLSDKELPQTESLALTIERVVPYWTETILPRIKSGERVIVAAHGNSLRALVKYLDNMGEDEILELNIPTGVPLVYEFDENFKPIKRYYLGNADEIAAKAAAVANQGKAK

SEQ ID NO: 28541 - protein, 1015 aa, Erwinia carotovora subsp. atroseptica SCRI1043
MQLNRRGFFKVCAGGMAGTTLAVLGFTPTEAMASVRQYKLLRAKETRNNCTYCSVGCGVLMYSLGDGAKNAKPSIFHIEGDADHPVSRGSLCPKGAGLVDYIHSENRLLYPEYRAPGSDKWQRISWDDAIERIARLMKADRDANFQRTNAKGETVNRWLTTGMLCSSAASNETGVLDQKFARSLGMVAIDCQARLCHGPTVAALAPTFGRGAMTNNWVDIKNANVIIVMGGNPAEAHPVGFKWAVEAKTHNNAKLIVVDPRFNRSAAVADLYAPIRAGSDAAFLLGIVNYLITHEKIHREYVVSYTSASLIVREDFSFDEGLFSGYDEQTRQYDKSSWQYELDESGFAKRDNTLSHPRCVWNLLKKHVSRYTPEMVTSLCGTSAKDYETICRTLAETCVPNKTATFMYALGWTHHTNGAQIIRSAAMIQLLLGNIGMAGGGINALRGHSNIQGYTDLGLLTTNLPGYMPLPSEKQPDLKTYLTQITPTALLPDQVNYWKNTPKFFISMMKSFYGDHAQAANNWGYDWLPKWDRSYDIMVQTELMVEGKMNGYIVQGFNPVAAFSNKNKATEALSKLKYMVIIDPLITETSTFWQNYGEFNDVDTKSIQTEVFRLPSSCFAEENGSIANSGRWLQWHWAAAEPPGEAHHDGKILGKLLMRLRELYNEEGGAYSDPLMNINWNYKDPEDPTPEEIAREANGMALADIYDDSGKLILKKGQQLADFSQLRDDGTTSSFCWIYAGSWTEAGNQMDKRDNADAGLGCTPNWSWCWPQNRRILYNRASADLQGKPWDSKRKLLEWNGQRWQGIDVPDFGATVPPGKDTGPFIMLPEGLARLFSVDKLVDGPFPEHYEPIESPIGTNPLHPSVISSPVARLFARDAKTMGTAKDFPYVATTYSITELFRHWTKHARLNAIVQPEQFVEIGENLAKSKGIKAGDEVKVSSKRGYIKAKAVVTKRIKTLEIAGHSVETVGIPCHWGYEGTTRKGFLANTLTPSVGDANSQTPEYKAFLVNVEKV

SEQ ID NO: 28542 - protein, 469 aa, Erwinia carotovora subsp. atroseptica SCRI1043
MIVPVIMAGGSGTRLWPLSRALYPKQLLALHSDVTMLQATISRLAGFESEAPLVICNEAHRFIVAEQLRELRCEGKIILEPCGRNTAPAIAVAALQAMRLAPDVDPILLVLAADHVIENEDAFTQAVNQAQPLTALGKLITFGIVPTEAHTGYGYIRRGISVNDAAFTVDCFVEKPNASTAEAYVSSGDYYWNSGMFMFKASVYLNALKEHRPDIFAACEQACANSREDLDFTRLDEAAFTDCPDDSVDYAVMEKTSDAVVIPLAAGWSDVGSWSSLWGILEKDESGNVNIGEVIALDSHNNYISSDSALVATIGINDVVIVNTGDALLVAAKDRSQDVKKVVDRLKESNLHHYREHPESFRPWGKISNIDSGDHYQVKKIIVHPGHGLSLQQHFHRAEHWVVLVGTAKVNIDEKEFFLSENQSTFIPPGAVHTLENPGVIDLVMIEVRSGHYLADDDIVRLQDRYGRI

SEQ ID NO: 28543 - protein, 468 aa, Erwinia carotovora subsp. atroseptica SCRI1043
MSKQQIGVVGMAVMGRNLALNIESRGYSVSIFNRSSDKTDEVIAENPGKKLVPSYTVEEFVESLEKPRRILLMVKAGEATDKTIESLKPYLEKGDILIDGGNTFYKDTIRRNRELSAEGFNFIGTGVSGGEEGALKGPSIMPGGQKEAYDLVAPILEQIAARADGEACVTYIGSDGAGHYVKMVHNGIEYGDMQLIAEAYALLKQALNLDNDELATTFSEWNKGELSSYLIEITADIFKKKDEEGKYLVDVILDEAANKGTGKWTSQSSLDLGEPLSLITESVFARYLSSLKDQRVAASKVLTGPTAQPFGGDKAEFVEKVRRALYLGKIVSYAQGFSQLKAASDENSWDLNYGEIAKIFRAGCIIRAQFLQKITDAYEQKADIANLLLAPYFKKVADEYQQALRDVVSYAVQQGIPTPTFSAAIAYYDSYRSAVLPANLIQAQRDYFGAHTYKRTDKEGVFHTEWLE

SEQ ID NO: 28544 - protein, 474 aa, Erwinia carotovora subsp. atroseptica SCRI1043
MKYRHLKRFPEGFLWGAATSAYQVEGAWNEDGKGPSVIDARTSYPEGTTDFKVASDHYHRYKEDVALFADIGFKTYRFSIAWSRIIPDGSGEVNPAGIEFYHNLIDELLHYGIEPIVTMYHFDLPQALQEKGGWYNRETVDAFERFANVLFDEYGNKVKYWLTINEQNMMILHGSALGTLDPTLENPKQNLYQQNHNMLVAQAKAMNALHEKVPGAKIGPAPNIALIYPASAKPEDVMAAFNYNAIRNWLYLDMAVYGRYNTAAWRYMEEKGYTPEILPGDMDILASAKPDFIAFNYYTSQTVEASKGDGSDEIARGGDQHLKSGEEGVHRGASNPWLQKNAFGWEIDPIGFRNTLRELHDRYHLPLIITENGLGAFDTLDENGEVQDDYRIDYLQRHIEQIQLAITDGVDVFGYTPWSALDLISTHQGCAKRYGFIYVNREEFDLKDLRRIRKKSAYWYADVIKNNGLDSSEA

SEQ ID NO: 28545 - protein, 352 aa, Erwinia carotovora subsp. atroseptica SCRI1043
MITLNTEKSFVELKHITKRFGNNTVIDDLNLAIPQGKMVTLLGPSGCGKTTVLRAVAGLEKPTEGQIFIDGEDVTERSIQQRDICMVFQSYALFPHMSLGENIGYGLKMLGRPKAEINQRVKEALALVDLEGFEDRYVDQISGGQQQRVALARALILKPKVLLFDEPLSNLDANLRRSMREKIRELQQQFNITSLYVTHDQSEAFAVSDMVLVMNKGKIMQLGAPQELYRQPASRFMASFMGDANIFPATFTADSVNIYGYLIPRPQGFAAGLSESTVGIRPEAITLSHQGEESQRCTITQVAYMGPQYEVQVDWHGQSMLLQVNATQLQPNPGDSYYLQIHPYGMFVLSEQ

SEQ ID NO: 28546 - protein, 441 aa, Erwinia carotovora subsp. atroseptica SCRI1043
MQAPMFPKGQLSPTQISQRYRYWRPRLLISMVIGYATFYLTRKSINFVMPVMQLELGLSKGDIGLLGTLFYLCYGASKFISGIVCDRTQVRWFMGVGLMITGVLNILFMYCQSLTGLLIVWALNGFFQGWGWPPCARLLSSWYSRNERGLWWGCWNTSINIGGAAVPLLAGYLASEWGWQAALLVPGIIGIVIGLWLCWQLCDKPQQQGLPSVGQWRRDALELRQEQQSPPMPMRQILRDAILRNRTIWLLGFSYILVYLIRIALNDWGNIWLSESHGFNLLSANATLSLFELGGLLGALFAGWGSDLLFRGQRAPMILLFALGLFLTMTALWLAPIHHYSLLAACFFSIGFFVFGPQMLIGLAATEYSHKDAAGTVTGFLALFAYLGAALAGWPLAQVLQHYGWSGFFTLLALASACIGLLLMPLLMAGVSRRERLMTSK

SEQ ID NO: 28547 - protein, 337 aa, Erwinia carotovora subsp. atroseptica SCRI1043
MHLARFPRLSLGHFPTPLEVLPNLSAYLGGPTIYIKRDDATGLATGGNKTRKLEFLLADAQQQGADVIITQGATQSNHVRQTIAAAAKLGLKTKVLLEKRVEDYGEDYQRSGNVLLDNLLGGDIIDHLPAGTDMQQAMETLAESLRKEGFKPYVIPGGGSSPVGALGYVACAEELLFQSSQQRLRIDHIVHATGSTGTQAGLVTGLAATHSQIPLLGISVRAPKAKQEENVYALAQRTWQLLGIPGELPRSAVRVNSDYVGKGYGIPTEGTLEALRLLAQLEGILLDPVYSGKGMAGLIDLIRQGHFRADENIVFIHTGGSAGLFGYRQLFEQTAAQ

SEQ ID NO: 28548 - protein, 474 aa, Erwinia carotovora subsp. atroseptica SCRI1043
MHDKLLIEGKLIAGNGEALAVFNPATGEQIAAIPQADLHQIDAAVLAAESAFAHWGQTTPKTRATLLLKIADAIEENAEVFAKLESLNCGKPYHAVLNDEVPAVADVFRFFAGAARCLSGSAAGEYLEGHTSMIRRDPVGVVASIAPWNYPLMMASWKLAPALAAGNCVVLKPAEQTPLTTFYLAHLLADILPAGVVNIVFGRGADIGDALTGHEKVNMVSLTGSIATGAHILAHTAASVKRTHMELGGKAPVIVFDDADIDQVVDGIRSFGFYNAGQDCTAACRLYVQRAVYDEVVEALGKAVATLKIGDPRDETTELGPLITEPQLERVMGFVERAKALPHITVVTGGERVKGTGFYFQPTVLAGAKQDDEIVQKEVFGPVISITSFDDEAQVIGWANASNYGLASSVWTRDIGRAHRLAACLQYGCTWVNTHFMLVSEMPHGGQKLSGYGKDMSMYGLEDYTIVRHIMIRH

SEQ ID NO: 28549 - protein, 468 aa, Erwinia carotovora subsp. atroseptica SCRI1043
MSRSNAHLNPLECTQQALHWIHSDTLSPDDMAALNQEVLSCFREYVNPGFLEYRKSVTTGGDYGAVEWRASGPNTLIDTQGNEYLDCLGGYGIFNVGHRNPNVIAAVESQLARQPLHSQELLDPLRGLLAKTLAALTPGNLKYSFFSNSGTESVEAALKLAKAYQSPRGKYTFIAATGAFHGKSLGALSATAKPAFRRPFMPLLPGFHHVAFGDISAMRKQVQQCQKTGDDVAAIILEPIQGEGGVIVPPENYLPAVRALCDEVGALLILDEVQTGMGRTGKMFACEHYGVQPDILCLAKALGGGVMPIGATVATEAVFSVLFENPFLHTTTFGGNPLACAAALATVNELLTKNLPEQAAIQGEFLLQGLQQLAAEYPQLIIEARGMGLLQAIEFRKNEIGYAFAKELFQRNILVAGTLNNSKSVRIEPPLTITREQCARVLKEAKDVLKKLNGTMPDENKMKEYAVE

SEQ ID NO: 28550 - protein, 300 aa, Erwinia carotovora subsp. atroseptica SCRI1043
MSLSQEFQNFIAQLRANPVPFEQLTDIGELRGAFNALGSDLPPLLDVLFRQVDAAGVPAEWVDPAGSDPSRVIFYLHGGGYVAGDPIIYRNFVTALCRASDCRALIVDYRLAPESPFPAALEDAQRSYAWLLTQGISADQIVIIGDSAGGGLALSTLVSLRDSCQPLPGAAVLLSPWTDLTLESESHLTKVKDDPIITHKFLDQSRQRYIGTGASDTDALVSPLHADLTGLPPLLVLVGTAEVLLDDSTALAHKAREAGVDVDLIEGDGMIHTWPFFIDSFPEAEKAVQSIGTFIHSRIR

SEQ ID NO: 28551 - protein, 490 aa, Erwinia carotovora subsp. atroseptica SCRI1043
MSRYGLQQLYINGAYVDSTGNDTFDAVNPANGDIIACIQSATAADVDRAVSAATAGQKVWAAMTAMERSRILRRAVDILRERNDELALLETHDTGKPLSETRTVDIVTGADVLEYYAGLIPMLEGQQIPLRDTSFVYTRREPLGVVAGIGAWNYPIQIALWKSAPALAAGNAMIFKPSEVTSLTALKLAEIYTEAGLPAGVFNVLTGTGKSVGQALTTHPGIAKVSFTGGIASGKTVMANAAGSTLKDVTMELGGKSPLIIFDDADLDKAADIAMMANFFSSGQVCTNGTRVFVPKALQAQFEEKILACVQRIRAGDPTDESVNFGPLVSFPHRESVLRYIESGKREGARVLVGGEPMTDGDYAQGAYVAPTVFTDCRDDMKIVRKEIFGPVMSILTYQDEDEVIRRANDSEYGLAAGIVTRDLNRAHRVIHQLEAGICWINTWGESPAEMPVGGYKHSGVGRENGVTTLEHYTQIKSIQVELGEFRSVF

SEQ ID NO: 28552 - protein, 364 aa, Erwinia carotovora subsp. atroseptica SCRI1043
MSQLFSPVSLGKLELPNRIIIAPMCQYSAEDGKATAWHTMHLGNLSHSGAGLLIIEATAVSPEGRISPHDLGLWDDTTEQALASVIQSVKTYSAMPLGIQLGHAGRKASTGVPWSERAFLHPEQGGWQTIAPSAIPYNASDAAPLAMSEQHIRALVDSFVDSAKRADSLGFDLIEIHAAHGYLLHQFLSPLTNQRTDSYGGSLQNRMHLVVEIYRAVREVFPAHKAVGVRISATDGVEGGWDLEQSVQLSKALHELGCDFIHVSSGGLSPLQQIHPAPNYQVPYAQRIKQEVGITTIAVGLITEPEQAEAIVATGEADAIGLARAILFDPRWPWHAAARLGAQVSAPAQYWRSEPRYARGIFKQ

SEQ ID NO: 28553 - protein, 183 aa, Erwinia carotovora subsp. atroseptica SCRI1043
MSTEIYAIPLTTIDGKATTFEAFKGQVALVVNVASKCGLTKQYDALEKLYETYRDKGLVVLGFPSNEFAGQEPGSEEEIQEFCRGTFGVQFPMFSKIEVNGENRHPLYQLLIRQQPEANGTWKSDFFARLVNKGRKPKNPEDILWNFEKFLVDREGRVIERFAPDMSPDHDTIVKAIEAALAK

SEQ ID NO: 28554 - protein, 470 aa, Erwinia carotovora subsp. atroseptica SCRI1043
MKKTKIVCTIGPKTESEEMLGNLLSAGMNVMRLNFSHGDYVEHGQRIKNLRAVMEKTGQQAAILLDTKGPEIRTMKLENGADVTLTAGQTFTFTTDQSIVGNKDRVAVTYAGFTEDLSVGNTVLVDDGLIGMQVTAVSGNDVVCKVLNNGDLGENKGVNLPGVSIQLPALAEKDKRDLIFGCEQGVDFVAASFIRKRSDVEEIRAHLKAHGGEHIQIISKIENQEGLNNFDEILEASDGIMVARGDLGVEIPVEEVIFAQKMMIEKCNLARKVVITATQMLDSMIKNPRPTRAEAGDVANAIIDGTDAVMLSGESAKGKYPLESVTIMATICQRTDSVMKSRLDTIKTPGILRITEAVCRGAVETAEKLDAPLIVVATSGGKSAKSIRKYFPNARILALTTNEVTARQLLLSKGIDTLLVKEIASTDDFYRIGKEAALKTGHAQAGDVVVMVSGALVSSGTTNTASVHRL

SEQ ID NO: 28555 - protein, 464 aa, Erwinia carotovora subsp. atroseptica SCRI1043
MSHQFPKEFLWGGAIAANQVEGAYLTDGKGLSTSDLQPQGIFGEIVMRTPGDSGTKDTAIDFYHRYPEDIALFAEMGFKCLRTSIAWTRIFPQGDETQPNEAGLAFYDRLFDEMAKYGIQPLVTLSHYEMPYGLVKNYGGWRSRETITFFERYARTVFQRYKDKVKYWLTFNEINCALHAPFTGIGLPTESNKQDIYQAIHHQLVASAKAVKACHEIIPDAKIGNMMLGSMFYPLTCKPADVMETMQQNRDWLFFGDVQTRGYYPAYMKRFFAQHGITLSVTEDDRQSLKETIDFISFSYYMTGCVTTDEEVNLKARGNILNMVPNPHLESSEWGWQIDPEGLRYLLNYLYDRYQKPLFIVENGLGAKDKLESDGSINDDYRIKYLNDHLYQVGEALEDGVEVMGYTCWGPIDLVSASKAEMSKRYGFIYVDRDDEGNGTLARRRKKSFYWYKEVIASDGEALK

SEQ ID NO: 28556 - protein, 457 aa, Erwinia carotovora subsp. atroseptica SCRI1043
MQQYLTEARKLSALAVPVIIAQVSQTSMGVVDTIMAGAYSATDMAAVAVGTSIWLPAILFGHGLLLALTPVVAQLNGSGRRDRISHQVRQSFFLAAIISVLTMLVLYQGEYAINLMSNDSPELAAKAIGYLHALLWGVPGYLFYQVLRCQCEGLSKTYPGMMIGFIGLLINIPINYIFIHGKFGMPELGGVGCGVATASVYWIMMLLMMLYTQRASWLRDIRLHRPAFRPDFTVLKRLFGLGLPIALALLFEVTLFAVVALLVLPLGVVNVAGHQIALNFSSLMFVLPLSVGVATTIRVGHRLGEGSVDNARIAAHTGIMAGVALACCTAIFTTLLREPIALLYNQDPLVVAMASQLMLLAAVYQISDAVQVIGTGVLRGYKDTRSIFYITFVAYWVLGLPSGYLLALTDVIVPRMGPAGFWCGFIIGLTAAAVMMVTRIRFLQRQPAARILARAAR

SEQ ID NO: 28557 - protein, 421 aa, Erwinia carotovora subsp. atroseptica SCRI1043
MKNSELNQRRLAATPRGVGVMCDFYAERAENSTLWDVEGREFIDFAAGIAVLNTGHRHPKIVAAVREQLDRFTHTAYQIVPYGSYVTLAERINALAPIQGAAKTTFFTTGAEAVENAVKIARAYTKRPGVIAFNAAFHGRTLLTMTLTGKVAPYSTGFGPFPGSIFHALYPNEQTGITVEQALESVERLMHTDIAADQVAAIILEPVQGEGGFHVAPPAFISGLRKLCDEHGILLIADEVQTGFARTGKLFAMEYYTEKADLITMAKSLGGGFPISGVVGRAEVMDAPSPGGLGGTYAGNPLSVASALAVLDVIEEEKLCQRAQRLGAALVETLEKVKAQCPALVAIRAQGSMVAAEFNDPNTGKPSAEITRQFQKSALEAGLLLLTCGVHGNVIRFLYPLTVPDEQFSKAMNILTRVLTR

SEQ ID NO: 28558 - protein, 490 aa, Erwinia carotovora subsp. atroseptica SCRI1043
MQLKQSISLKQQVLFRQHCLIDGEWQDSQSGERLNVTNPATGEVLGTVPLVTVSQTEQAIAAAEQALVEWRKKTGKERAALLQAWARLIMDNQDDLAVLLTAEQGKPLAEARGEIAYATSFIDWFAEEAKRIEGSVLQSPQGQQRLMVIKQPIGVCAAITPWNFPAAMITRKVGPALAAGCTMIVKPAEQTPFTALALAELAQQAGIPRGVLQVIVGDAQSVGKVLCDSPVVRKLSFTGSTEVGRILMAQSAPTVKKLSLELGGNAPFIVFDDADVDQAVKGILASKFRNSGQTCVCANRIYVQNGIYPTLVERLIEEVRKLNVGDGTQPGVTQGPLIDDDAVSKVEQHIADALSHGATLLLGGQRHERGGTFFTPTIVGDVTREMRFAREETFGPVAPLFRFSDEAEVIAMANDTEFGLAAYVYTRDAIRQWTVPEALDYGMVGINTGLISNEVAPFGGVKQSGLGREGSRFGIEDYLEMKYLCVDLSR

SEQ ID NO: 28559 - protein, 428 aa, Erwinia carotovora subsp. atroseptica SCRI1043
MTSEMTATEALLARRQRVLGGGYRLFYEEPLHVARGEGVWLFDHQGKRYLDVYNNVASVGHCHPAVVEAVARQSAQLNTHTRYLHHAIVDFAEDLLSEFPAELNNVMLTCTGSEANDLALRIARHVTGGTGMLVTRWAYHGVTSALAELSPSLGDGVVRGSHVKLIDAPDTYRQPGAFLTSIREALAQMQREGIRPAALLVDTIFSSDGVFCAPEGEMAQAAALIRQAGGLFIADEVQPGFGRTGESLWGFARHNVVPDLVSLGKPMGNGHPIAGLVGRSALFDAFGRDVRYFNTFGGNPVSCQAAHAVLRVIREEQLQQNAQRVGDYLRQGLQQLAQHFPLIGDIRAYGLFIGAELVSDRESKTPASESALQVVNAMRQRGVLISATGPAANILKIRPPLVFLEEHADVFLTTLSDVLALIGTRAQR

SEQ ID NO: 28560 - protein, 413 aa, Erwinia carotovora subsp. atroseptica SCRI1043
MSELTPTIAIVGSGPAGCYSAQFLKKSIPSAEITVFEALPVPYGLLRYGVAADHQGTKNVSAQFERLFTHSGVRFMGNVEIGKDLGVDELMVAFDVVVFATGLSSDRRLGIPGDDLENVIGAGKLLRALNGYPNKSINGQDVTRPLGDRVAVIGNGNVAMDIVRLIAKSEDELLGSDVDDNLRLELCTTNVRRIDIIGRSPIESAKFDLAMLREICHLKGATVNWLNKPLDINCPAADLLLSTEAVSSLVSGSVEINFRFSAAPLLISSRNQATVLTLRLNEGGTVEDLEYDTVITAVGFCSEESDSLALTPGTYPVGWARRGPKGTVAENRRDAAEVASLIVEDLHNGRQNIGKPGLKAIEHLVTHKAVSFEQWKRLDRHEIHSAAPGRCRKKTTSITEMLSVMENQVPVAK

SEQ ID NO: 28561 - protein, 274 aa, Erwinia carotovora subsp. atroseptica SCRI1043
MSEAIDYFAHARTTTQPQAENARGLIEIRNVAKHFGQHKALDDINLTLAPGSVTVILGPSGSGKSTLLRTINHLERVDEGFIRIDGDYIGYRRKGNTLYELKEKDVLRQRINVGYVFQNFNLFPHLSVLENIIEAPLAHKLHSRQEAEDLAFTLLESVGLRHKAQSYPRHLSGGQQQRVAIARALALKPKVMLFDEPTSALDPELVGEVLDVIKSLARSGVTLVVVTHEIGFAREVADRVVFMVEGKIVESGESWQVLNHPRHPRTINFLNKVL

SEQ ID NO: 28562 - protein, 476 aa, Erwinia carotovora subsp. atroseptica SCRI1043
MSASTFPTGFLWGGAIAANQAEGAYLEGGKGLTTVDMIPHGVNRLPVKLGQEPRFALREDEFYPSHQAIDFYHRYKEDIALMAEMGFTVFRTSIAWSRLYPNGDELTPNADGIAFYRDMFAECKKYNMEPLVTLCHFDVPMHLVTEYGSWRNRKMVEYFTRYARTCFEAFDGLVKYWLTFNEINILLHSPFSGAGLVFAEGENQEQVKYQAAHHELVASALATKIAHEVNPGNQVGCMLAGGNFYPWSCKPEDVWAALNKDRENLFFIDVQARGTYPAYTGRLFKEKGITIASEPGDDEILKNTVDFVSFSYYASRCASADMNEHNSSAANIVKSLKNPHIKASEWGWGIDPLGLRITMNMMYDRYQKPLFLVENGLGAKDEINAQGDIDDDYRISYLREHISAMADAIGDGIPVIGYTSWGCIDLVAASTGEMSKRYGFIYVDRDDLGEGTLARKKKKSFYWYKKVIASNGADLS

SEQ ID NO: 28563 - protein, 372 aa, Erwinia carotovora subsp. atroseptica SCRI1043
MKHAALFEKFSLGQGITLRNRIVMAPMTTWSGNDDGTVSEDEEAYYHLRVKDIGLVITGCTHVQENGIGFTGEFAAYDDKFIPSLKRLAAAAKSGGAPAILQVFHAGVKTRPDLVSDIVAASAVPGDAGPSAPSVTPRGLQNEEVLIVVQAFGEATRRAIEAGFDGVELHGAHGFLLQNFFSPHFNQRTDCWGGSPDNRMRFPLAVASEVRKTISEHATEPFLLGYRITLDESHEDGLRIKDSLQLIDNLIVVGINYLHVSLGNALEARPVDGPNGPKIIEIVRDHLDGRIPFIAAGQIRTPEQADDALAAGLSLAAIGQGLVMNPDWVRIASGESSDPIALDVAACDVESLAIPRKLWGIIEDTTGWFNVR

SEQ ID NO: 28564 - protein, 460 aa, Erwinia carotovora subsp. atroseptica SCRI1043
MTDKVRIDSLGANSLNGNNETYLARQAEFESNVRSYPRKLPLAIAKAEGVWITDVENNQYLDCLAGAGTLALGHNHPDVLQSIQRVITSGLPLHTLDLTTPLKDQFSEYLLSLLPGQGKEYCLQFTGPSGADAVEAALKLAKKYTGRSGVISFSGGYHGMTHGALSVTGNLSPKEAVDGMMPEVQFMPYPHQYRCPLGIGGDAGVKALTYYFENLLNDVESGVRKPAAVILEAVQGEGGVNPAPAEWLQRIRKVTQEHGILLIIDEVQAGFARTGKFFAFEHAGIEPDIIVMSKAVGGGLPLAVLGIKKQFDAWAPGHHTGTFRGNQLAMATGLTTLMHLKDNQVADKVAEQGEWLKAKLAELQKRYPVIGHIRGLGLMIGIEMVKPGEAQDHMGCYPADGDLSALLQKKCFESGLILERGGRNGCVLRLLPSLLISNAELEIFLDKFENALLSAGVKPV

SEQ ID NO: 28565 - protein, 268 aa, Erwinia carotovora subsp. atroseptica SCRI1043
MERYQQLFTRLSEKKEGAFVPFVTLGDPSPEQSLKIIDTLIAAGADALELGVPFSDPLADGPTIQDANLRAFAAGVTSGQCFEMLAAIRQKYPEIPIGLLMYANLVFSNGIDEFYQRCAEVGVDSVLVADVPVVESAAFRAAALRHGIAPIFICPPNADDELLREIASYGRGYTYLVSRAGVTGAEKRAQLPLNHLVAKLNEYHAAPPLQGFGISDPAQVRETVASGAAGAISGSAIVRIIEKNLNQPDVMLSELHAFVSEMKAATRS

SEQ ID NO: 28566 - protein, 458 aa, Erwinia carotovora subsp. atroseptica SCRI1043
MANDQQELVLKRGLKNRHIQLIALGGAIGTGLFLGISQTIQMAGPSVLLGYAIAGMIAFLIMRQLGEMVVEEPVAGSFSHFAFKYWGDFAGFLAGWNYWAMFILVGMAELTAVGIYIQYWWPDTPTWLSAAIFFVLINLINLVNVKMFGETEFWFAIIKVLAIVGMIVFGSWLLLSGNGGETATVRNLWIHGGFMPNGASGLIMAMAVIMFSFGGLELVGITAAEAADPKRSIPQATNQVVYRILIFYIGALSILLSLYPWGNVVGGGSPFVLIFQALNSNIVANVLNVVVLTAALSVYNSGVYCNSRMLYGLAKQGNAPKSLAKVNARGVPVRSIALSALATSLGVAINYVMPGKAFELLMALVVSTLVINWIMICFAHLRFRQAMMEKGIVPAFKAFWYPWSNYLCLAFLAGILVIMLLSPGIRISVMLIPFWIAVIWLGFRFSRKTYSPAKIVPR

SEQ ID NO: 28567 - protein, 480 aa, Erwinia carotovora subsp. atroseptica SCRI1043
MSRRLRRTKIVTTLGPATDRDNNLEKIINAGANVVRMNFSHGTAEDHQLRANKVREIAAKLGRHVAILGDLQGPKIRVSTFKEGKIFLNIGDKFLLDANLAKGEGDKEKVGIDYKGLPSDVVPGDILLLDDGRVQLKVLQVEGLKVYTEVTVGGPLSNNKGINKLGGGLSAEALTEKDKADIITAAKIGVDYLAVSFPRTGEDLNYARRLARDAGCNAKIVSKVERAEAVCSDAAMDDIILASDVVMVARGDLGVEIGDPELVGIQKKLIRRARQLNRAVITATQMMESMITNPMPTRAEVMDVANAVLDGTDAVMLSAETAAGQYPAETVAAMAKVCLGAEKIPSINVSKHRLDVQFDNTEESIAMSSMYAANHLKGVTALIAMTESGRTALMMSRISSGLPIFAMSRHEHTLNLTALYRGVTPVHFDSYTDGVAAANDAVILLRDKGFLMSGDLVIVTQGDIMGTVGTTNTIRILRVE

SEQ ID NO: 28568 - protein, 210 aa, Erwinia carotovora subsp. atroseptica SCRI1043
MLSEECFLNDEQRNQLDWEKTDGMLPVVVQHAVSGEVLMLGYMNQDALQATEESGKVTFFSRTKQRLWTKGESSGHFLNVVSITPDCDNDTLLILVNPIGPTCHLGTSSCFSPAASDWTFLYQLEQLLAERKHADPDSSYTARLYASGTKRIAQKVGEEGLEAALAATVHDREELTNEAADLMYHLLVLLQDQDLDLATIINRLKERHNK

SEQ ID NO: 28569 - protein, 373 aa, Erwinia carotovora subsp. atroseptica SCRI1043
MQMIKTRAAIAWGPNQPLSVEEVDLMPPQKGEVLVRIVATGVCHTDAYTLSGKDPEGVFPAILGHEGGGIVEAIGEGVTSVAVGDHVIPLYTPECGECKFCRSGKTNLCQAIRSTQGKGLMPDGTTRFSKNGQPIFHYMGTSTFAEHTVVPEISLAKVNKEAPLEEVCLLGCGVTTGMGAVLNTAKVKAGDTVAIFGLGGIGLSAIIGAHMAGAGRIIGIDLNTSKFDLARKLGATDLLNPKDYDKPIQDVIVELTDGGVDFSFECIGNVNVMRSALECCHKGWGESIIIGVAGAGEEIATRPFQLVTGRVWRGSAFGGVKGRSELPGLVDRYLKGEFPLNDFITHTMGLDDINTAFDLMHEGKSIRTVIHFG

SEQ ID NO: 28570 - protein, 491 aa, Erwinia carotovora subsp. atroseptica SCRI1043
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 28571 - protein, 240 aa, Erwinia carotovora subsp. atroseptica SCRI1043
MIEFKNVSKHFGKTQVLHDIDLTIGQGEVVVIIGPSGSGKSTLLRCINKLEEITSGELIVDGLKVNDPRVDERLIRQEAGMVFQQFYLFPHLTALENVAFGPIRVRGASKAEAEKLALELLAKVGLSERAHHYPSELSGGQQQRVAIARALAVKPKLMLFDEPTSALDPELRHEVLTVMKDLAEEGMTMVIVTHEVGFARKVASRLIFIDKGRIAEDGDPETLTTNPPSDRLREFLQHVS

SEQ ID NO: 28572 - protein, 470 aa, Erwinia carotovora subsp. atroseptica SCRI1043
MEQHASGSEGQFKRTMKARHLVMLSLGGVIGTGLFFNTGYIISTTGAAGTLLAYLIGALVVYLVMLSLGELSVAMPETGAFHVYASRYLSPATGYTVAWLYWLTWTVALGSSLTAAGFCMQYWFPQVPVWTWCLLFCALIYLLNVVSSRFFAEGEFWFSIVKVVTILAFIVLGAGAMFGFIPMQDGSPAPFFQNITASGWLPHGGLPILMTMVAVNFAFSGTELIGIAAGETENPQKVVPMAIRTTVARLVIFFLGTVLVLAAIIPMEEAGIAKSPFVLVFEKIGIPYAADIFNFVILTAILSAANSGLYASGRMLWSLSNEGTLPRRFSRLTRRGIPLFAISVSMLGGLLALFSSVVAPDTVYVALSAISGFAVVAVWLSICASHYMFRRHHIRSGKSLSELQYRAPWFPITPILGFLLCLLACVGLVFDPSQRIALWCGIPFVALCYGAYYFTQSVKKRGLTGVEDIA

SEQ ID NO: 28573 - protein, 470 aa, Erwinia carotovora subsp. atroseptica SCRI1043
MVEKLKETADLAPEQGEGLQRNLTNRHIQLIAIGGAIGTGLFMGSGKTISMAGPSIIFVYMIIGFMLFFVMRAMGELLLSNLNYKSFSDFAADLLGPWAGFFTGWTYWFCWVVTGIADVVAISAYSQFWFPDLSQWVSSLLCVLLLLTLNLATVKLFGEMEFWFAMIKIVAIVALIVVGVALVMMQFSSPSGNVASFNNLWNDGGMFPKGISGFFAGFQIAVFAFVGIELVGTTAAETKNPKVVLPRAINAIPIRIIMFYVFALIMIMSVTPWGAITADRSPFVEMFVLVGLPAAASMINFVVLTSAASSANSGVFSTSRMLFGLAKQGDAPKSFGMLSKRAVPSTGLMFSCICLLSGVVLIYLIPNVMTVFTLVTTVSAILFMFIWSIILCSYLTYRKKRPQLHAESSYKMPLGVFMCRVCLAFFAFVIVLLTLQPDTRQALVVTPLWFIVLAIAYQFVRRKKQVVDVK

SEQ ID NO: 28574 - protein, 383 aa, Erwinia carotovora subsp. atroseptica SCRI1043
MPHSDLLFDHFRFENGMTLRNRVVMTPMTTWSANPDGTISDQEAAYVQARAKDVGMVITGCTHVTPEGIGFTDEFAAYDDRFIPSLRKLAQAAKSGGASAILQIFHAGSKAVPELVPNGRVVGPSTMEVPAGLFNNGGNTATALRHSEIESIIKAFGDATRRAIEAGFDGVELHGAHGFLLQDFFSPLANNRDDEWGGSLDKRLRFPLSVVQTVRQVISAHTDRPFLLGYRISPEEQADGGLRIADTKILLDRLIDTGVDYIHASLHDVLNGKPIVDDGGKTTARLLIEHVADRVPLIAAGGFKTPTQAQAALDAGLSLAAIGQALIMNPNWVALAKAGREEEIVNVLNPASVQDLNIPEKLWTVIQQAKGWFPLVETEQAVE

SEQ ID NO: 28575 - protein, 276 aa, Erwinia carotovora subsp. atroseptica SCRI1043
MREDIALSEERVLSENRDLSEDTVLRIRGLQKRFGAVEVLKGIDLDVRRGEKIAIIGGSGSGKSTLLRCLNFMEIPSAGTIELDGVVLGKTDAKGQHDYPEKQLCAVRERVGMVFQQFNLFPHLTVLENVREALVSVKKMPRHEADIIAKAQLEKVGLSNKQDARPSSLSGGQQQRVAIARALAMSPEVMLFDEPTSSLDPELVGEVLHTIRALADEGRTLLLVTHELGFAYHFADRVVFIENGVIHEMGSAEQVLKNPQQPRTQAFLARFAERAF

SEQ ID NO: 28576 - protein, 362 aa, Erwinia carotovora subsp. atroseptica SCRI1043
MSALFQPFKLKDITLRNRIAVPPMCTYSANDGLINEWHEVHYASLARGGAGLVIVEATAVAPEGRISPRCTGIWNDEQAQAFAKVAKSIKDAGSVPGIQIGHAGRKASANIPWEGDDHIPAGDSRGWQTIAPSAAPFGANLPKQPQEMTLEDIARVRDDFVAAARRALEAGFEWLELHFAHGYLAQSFFSAHSNKRNDQYGGSFENRSRFLLETLAAVRDVWPQHLPLTARFGVIEFDGRDEETLQESIELTRRFKAAGLDMLSVSIGFSTPEANIPWAPAFMGPIAQQVREQADLPVSSAWGFGTPELAEQAVASDQLDLVMVGKAHLANPHWSYQAARELGIDRASWTLPTPYAHWLERY

SEQ ID NO: 28577 - protein, 1395 aa, Erwinia carotovora subsp. atroseptica SCRI1043
MKPHLIVIGNGMASARFVDTLRQLAATCYRITVIGDEPRASYNRILLSPVLSGEKAFADTLLTPAAIDDDTALPVNTLLGERVTHIDRQAREVTTTQRQLHYDHLVLAMGSTPFMPPMPGIDLAGVCGFRTLDDVELMLATISQPVPAVVIGGGLLGIEAAAALRLRGADVTLLHRVPILMERQLDATASDLLCNSLRARGIACETDVQVAALHGDAHGVTAVELADGRTIPAGLVVVTAGVIPASQLARECGLPCNRGVLVDGQLQTADPHISAIGECCELNGETFGLVAPCFAHATLVAQRLAGHAPQDYQREQATTRLKVTGIGVVSGGEINVAPNDEVYTTFDPQTQHYRRLLLRDGRLSGVLLYGDTDDSPRLLAAMDNTTEGEMIPPATLLFGLSSPDSDSQPAAVRIPVMSKPILVVVGHGMVGHYFLEQLVERDLHQHYHIVVFGEERHEAYDRVHLSEYFSGRSAASLSLVKEGFFAESGIELRSASEIVAIDRERQCVCDAQGRETAYDKLVLATGSYAFVPPIPGNTRPGCLVYRTLDDLDAIAAQAKKATSGVVIGGGLLGLEAANALRQLGLDTHVVEFAPRLMAVQLDDGGASMLRRKIEALGVQIHVSKETREITDGEQALHRLCFADGSVLETDLVLFSAGIRPRDKLADSCDLEKGPRGGIVIDDCCQTSDDAIFAIGECALWKGQIFGLVAPGYQMARSVADTLAQRDTPFTGADMSTKLKLLGVDVASIGDAHGRTAGSQSYQWTDGPNEVYKKIVVSADGKHLLGAVLIGDSSDYSTLLQMMLNDMSLPTQPEGLILPARSGDAPKGLGVAALPASAQICSCHNVSKGDISAAVAGGCGELGALKTCTKAGTGCGGCVPLLKQVMEYELTQQGVEVKKDICEHFAYSRQELYHLIRVHEIRSFDGLLERYGHGLGCEVCKPLVGSMLASCWNDYLLQPQHLPLQDTNDRFFANIQKDGTYSVVPRVPAGEITPAGLIAIGQVAQRYNLYTKITGGQRVDLFGARLEQLPEIWRELIDAGFETGHAYGKSLRTVKSCVGSTWCRYGVQDSTGLAIQLEHRYKGLRSPHKVKMAVSGCTRECAEAQSKDIGVIATDKGWNLYVCGNGGMKPRHADLFASDLDTETLLRTIDRVLMFYIRTGDRLQRTSTWMDNLEGGIEYLRQVILEDSLNIGEELDKEMQRVVEAYQCEWQTTLESPERLALFRGFLNSDSPDEAVVMVPERGQIRPAQEHEKAISPEPVVLKPATHEAEWIQVATLGDIPRHAGMAARLGQQQIALFHLPGSEQQVYALENHEPGSGANVLSRGLIGDVAGEPVVISPLYKKRFKLRDGVSPDDRALYVRAWPVRVEDDEIWVCRQPLAVPESVGLADNDMAKAS

SEQ ID NO: 28578 - protein, 413 aa, Erwinia carotovora subsp. atroseptica SCRI1043
MADSTSPRRFTRIDRLPPYVFNITAELKMAARRRGEDIIDFSMGNPDGPTPPHIVEKLCTVAQREDTHGYSTSRGIPRLRRAISRWYADRYEVDIDPESEAIVTIGSKEGLAHLMLATLDHGDTVLVPNPSYPIHIYGAVIAGAQVRSVPLVEGVDFFNELERAIRESIPKPKMMILGFPSNPTAQCVELDFFERVVELAKQYGVLVIHDLAYADIVYDGWKAPSIMQVPGAKDIAVEFFTLSKSYNMAGWRIGFMVGNSELVNALARIKSYHDYGTFTPLQVAAIAALEGDQQCVRDIAEQYRQRRNVLVRGLHEAGWMVDEPKASMYVWAKIPDAYAHLGSLEFAKRLLSEAKVCVSPGIGFGDYGDTHVRFALIENQDRIRQAVRGIKTMFRADGILPTTKPLAGKGPAA

SEQ ID NO: 28579 - protein, 339 aa, Erwinia carotovora subsp. atroseptica SCRI1043
MTIIKSYAAPEAGAALELYEFDAGELQAEDVEVVVDYCGVCHSDLSMIDNEWGMSSYPLVAGHEVIGRVHALGDAAKNKGLKIGQRVGIGWTARSCGHCDACISGSQTNCQQGSVPTILNKGGFADKIRANWQWAIPLPDSIDIESAGPLLCGGITVFKPLLMHHVTATSRVGVIGIGGLGHIAIKLLHAMGCEVTAFSSNPSKEQEVLAMGADKVVNSRDPQALTALAGQFDLIINTVSVDLEWQPYFNALAYNGKFHTVGAVMKPFSVPAFTLIAGDRSVSGSSTGSPHELRSLMKLSARANVKPQTELFPMSKINDAIQHVRDGKARYRVVLKADF

SEQ ID NO: 28580 - protein, 488 aa, Erwinia carotovora subsp. atroseptica SCRI1043
MLRIAKEALTFDDVLLVPAHSTVLPNTADLSTQLTKNIRLNIPMLSAAMDTVTESGLAIALAQEGGLGFIHKNMSIERQAEEVSRVKKYESGVVVDPQTVAPETTLREMRELTERNGFAGYPVVAKDNELVGIITGRDVRFVTDLEKPVSAFMTPKERLVTVNEGEARDVVLQKMHEKRVEKALVVDDKFHLIGMITVKDFQKAERKPNACKDEHGRLRVGAAVGAGAGNEERVDALVAAGVDVLLIDSSHGHSEGVLQRIRETRAKYPNLEIIGGNVATGSGAKALVEAGVSAVKVGIGPGSICTTRIVTGVGVPQITAISDAVEALEGTGIPVIADGGIRFSGDIAKAIAAGAACVMVGSMLAGTEESPGEIELYQGRSFKSYRGMGSLGAMSKGSSDRYFQTDNAADKLVPEGIEGRVAYKGRLKEIVHQQMGGLRSCMGLTGCATIDALRTQAEFVRISGAGIQESHVHDVTITKESPNYRMGS

SEQ ID NO: 28581 - protein, 172 aa, Erwinia carotovora subsp. atroseptica SCRI1043
MDYFTLFGLPIRYDVDGGLLASRFQDLQRQFHPDRYATSPECERMLAVQLAATINNAYQALKHPLKRAEYMLSLHGFDVNNEQHTMRDTAFLMEQLELREELDTISQRSDADEVLTTFAERLQVMIGTRRSHMRHELDNETWTDAADTVRKLRFLDKLQQQVEELEEQLLDR

SEQ ID NO: 28582 - protein, 368 aa, Erwinia carotovora subsp. atroseptica SCRI1043
MSDDILFSPFTVKGLTLPNRIVMAPMTRSMAEEGIPGPANAEYYRRRAEGGVGLILTEGTVVDRPASRNMPGIPFFHGEAALAGWDAVAKAVHAAGGRIGPQIWHTGSTHGRGWEPDAPVESPSGLVGPDEPRGVVMTEEDIADTVAAFARAAADAKRLGFDTLELHGAHGYLIDQFFWPGTNKRSDAFGGATIRERSHFAAEVIRAVRAAVGEDFPLILRVSQWKQQDYSARLATSPQEMTDWLAPLVEAGVDILHCSQRRFWDPEFPEVDGAEGLNFAGWAKKLTGAATISVGSVGLTSDFFAAFGGEGSGTAALDNLYARMEREEFDLIAVGRVLLSDAQWVQKVRTGQTDKLRGFDAADLAVLA

SEQ ID NO: 28583 - protein, 330 aa, Erwinia carotovora subsp. atroseptica SCRI1043
MSIEIRNINKQFGQFRALNEINLSIHSGELVALLGPSGCGKTTLLRIIAGLEQPDSGSIIFHGQDVSVHDVRKRNVGFVFQHYALFRHMTVFDNVAFGLRMKPKNIRPSKSDIEKKVHELLNLVQLDWLGDRYPEQLSGGQRQRIALARALIVEPSILLLDEPFGALDAKVRKELRRWLSQLHEDIDLTSVFVTHDQEEAMEVADRIVLMNKGVIEQIGTPAEVYNHPASEFVYHFLGDSNRLKVAQTEETILFRPHEVSLSVQAQDGYQAVTVRDIRPLGALTRLSLKLGEQSELIEAEVAKDDVSLEGLQKGDVIQFKPKRYNHDWEI

SEQ ID NO: 28584 - protein, 426 aa, Erwinia carotovora subsp. atroseptica SCRI1043
MNKSESLYAAAQQLIPGGVNSPVRAFNGVGGTPLFIERADGAYLYDVDEQAYIDYVGSWGPMVLGHNHPSIRDAVIAAAERGLSFGAPTEMEVQMARLVTSLVPSMDMVRMVNSGTEATMSAIRLARGYTGRDKIIKFEGCYHGHADCLLVKAGSGALTLGQPNSPGVPADFARHTLTCVYNDLSSVRTTFEQYPDEIAAIIVEPVAGNMNCVPPLPDFLPGLRALCDEFGALFIIDEVMTGFRVALAGAQSHYGVVPDLTCLGKIIGGGMPVGAFGGKREVMQALAPTGPVYQAGTLSGNPIAMAAGFACLTEVAKPGVHEKLTALTNQLADGLLAAAKAENIPLVVNQAGGMFGLFFTDAESVTCYQDVMKCDVERFKRFFHMMLEEGIYLAPSAFEAGFMSLAHTPQDIERTIEAAQICFSRL

SEQ ID NO: 28585 - protein, 178 aa, Erwinia carotovora subsp. atroseptica SCRI1043
MMKHTVEVMISEQEVMARVTELGQQISEHYRDSGSDMVLVGLLRGSFIFMADLCRAIDVPHEVDFMTASSYGSGMNSTRDVKILKDLDEDIRGKDVLIVEDIIDSGNTLSRVREILQLREPKSLAICTLLDKPERREVAVKVEWVGFSIPDEFVVGYGIDYAQHYRHLPYVGKVVPQE

SEQ ID NO: 28586 - protein, 287 aa, Erwinia carotovora subsp. atroseptica SCRI1043
MSQKEIWYETLHANFGQYFSVDRVLYHEKTDHQDLIIFENDALGRVMALDGVVQTTERDEFIYHEMLTHVPLLSHGNAKRVLIIGGGDGGMLREVSRHHGVEQITMVEIDAGVVEFCRQYLPNHSAGSYDDPRFNLVIDDGVNFVRQCSEKFDVIISDCTDPIGPGESLFTSDFYQGCARSLNEGGIFVAQNGVCFLQQDEAIGSHKKLSHYFNDVSFYQAAIPTYYGGIMTFAWASNNPALRQMDIVTLRQHFAQSGITCRYYTPDVHIGSFALPQYLLSALQNAQ

SEQ ID NO: 28587 - protein, 386 aa, Erwinia carotovora subsp. atroseptica SCRI1043
MTDNPLLVLRERISALDLQLIELLAQRRELALGVARSKLHSHRPIRDKERERDLLDKLTAAGKKHHLDGHYITRLFQLIIEDSVLTQQALLQHHLNQTTSHSARVAFLGPKGSYSHLAARQYSARHFEQFIECGCQKFQDIFNMVETGQADYAVLPIENTSSGSINDVYDLLQHTSLSIVGELTNPINHCVLVATDTSLAQIETVYSHPQPFQQCSHFINRFPHWKIEYCESTAAAMEKVAALNSPKAAALGSEAGGQLYQLQMLEHNLANQSQNITRFIVLARKPIDVTEQVPAKTTLIMATGQQSGALVEALLVLRDNGIVMTKLESRPINGNPWEEMFYLDVQANLRGDAMQKALKGLAPITRSLKVLGCYPSENVVPVDVNE

SEQ ID NO: 28588 - protein, 240 aa, Erwinia carotovora subsp. atroseptica SCRI1043
MIHVNNLQKQFGDTHVLRGISCDIAPQEVLCLIGPSGSGKSTFLRCINALETLSAGEITVNGFAIHDQKTDINRMRESVGMVFQRFNLFPHMTVLENVIMAPMGVKKLSRTQAVERAKALLSKVGLLDKIDAWPNSLSGGQQQRVAIARALAMEPAIMLFDEPTSALDPELVGEVLAVMKTLANEGMTMVIVTHEMAFAREVADRVIFIDQGIIQEQGTPEAIFTHPSNPRTQAFLSKIL

SEQ ID NO: 28589 - protein, 472 aa, Erwinia carotovora subsp. atroseptica SCRI1043
MSTQQSKKDLQAILNTMKRAHMASGPADARLRKDRLQRSINLIRENHIALAQAMSEDFGHRSLYHSFTADVGTTLKMLQNAIDNVERWMQPEPVDEPAPGMQAWIQHQPLGVIGVISPWNFPVNLSFGPLADIFAAGNTAILKPSELTPHTSELLAELIAHYFDPLELAVVLGDAEIGQAFSELPFDHLVFTGSTAVGKHVMRAAAENLVPVTLELGGKSPVVIDSSADITEAAERTMTIKTFNAGQICLSPDYVLLPEGQEQAFRDAAKAFMQKSFPTLQANPDYTSIIADRHYDRLIRLLKEAEQQGATVVSLAPEGEASYDAKSRKIAPHLVFGVRDDMTIMQEEIFGPLLPVKTYQTAEEPINYINAHPRPLAAYLFSHDEAMQQRFAGRTTSGALVINDVMTHVSIDTLPFGGVGASGIGAYHGVHGFRRFSHAKPIVIQSEDGASNLTLRAPYHEKQNAIVAVLKG

SEQ ID NO: 28590 - protein, 431 aa, Erwinia carotovora subsp. atroseptica SCRI1043
MSKIVKVIGREIIDSRGNPTVEAEVHLEGGFVGLAAAPSGASTGSREALELRDGDKSRFLGKGVTKAVAAVNGPIAQAVLGKDAKDQANIDKIMIDLDGTENKSQFGANAILAVSLAAAKAAAASKGLPLYAHIAELNGTPGKYSMPLPMMNIINGGEHADNNVDIQEFMIQPVGAKTLKEAIRMGSEVFHTLAKVLKSKGMGTAVGDEGGYAPNLGSNAEALAVIAEAVKAAGYELGKDITLAMDCAASEFYKDGKYVLAGEGNKSFTSEEFTHFLEDLTKQYPIVSIEDGLDESDWAGFAYQTKVLGDKIQLVGDDLFVTNTKILKEGIDKGIANSILIKFNQIGSLTETLAAIKMAKDAGYTAVISHRSGETEDATIADLAVGTAAGQIKTGSMSRSDRVAKYNQLIRIEEALGDSAPFNGLKEVKGQ

SEQ ID NO: 28591 - protein, 294 aa, Erwinia carotovora subsp. atroseptica SCRI1043
MKIGFIGLGIMGKPMSKNLLKAGYSLVVMDRNLEAVAEVVAAGATSAETPKQVAEQSDVIITMLPNSPHVKEVVLGENGVIEGARAGSIVVDMSSIAPLASREIAAVLAEKEIAMLDAPVSGGEPKAVDGTLSVMVGGDKAQFERCFEILKSMAGSVVHTGDIGAGNVTKLANQVIVALNIAAMSEALVLATKAGVNPDLVYQAIRGGLAGSTVLDAKAPMVMDRNFKPGFRIDLHIKDLANALDTSHGVGAQLPLTAAVMEMMQALKADDLGSADHSALACYYEKLAKVEVTR

SEQ ID NO: 28592 - protein, 206 aa, Erwinia carotovora subsp. atroseptica SCRI1043
MTTPSFDSVEAQASYGIGLQVGQQLQESGLEGLIPEALLAGLRDALEGNAPAVPVDVVHRALREIHERADAVRRDRQQELAVEGQQFLAENAQKEGVDSTESGLQFRVLTQGEGAIPARQDRVRVHYTGRLTDGSVFDSSVERGQPAEFPVSGVIPGWIEALTLMPVGSKWELYIPHNLAYGERGAGASIPPFSALIFEVELLEIL

SEQ ID NO: 28593 - protein, 478 aa, Erwinia carotovora subsp. atroseptica SCRI1043
MSKVSLTIPPDFILGAAASAWQTEGWSGKKAGQDSYLDLWYKQDRQVWHNGYGPAKATDFFNRYREDVALMKLAGLTHYRTSINWSRFMLDYEKGIVDEEYAAYIDNLLDEMHRQGIEPMICLEHYELPACLLEKYQGWSSKQVVEWFVLYADTVFARYAGKVKRWFTFNEPIVVQTRVYLDALRYPYEQNTHTWMQWNHHKNLATAKVVQRFRQKGYDREGGSIGVILNPEVTYPRSRAAHDVKAAHLYDLFYNRVFLDPALKGEYPAELIALLAQHQVKWDYTEEELAIIRDNTVDEVGINLYYPHRVKAPSREWNKETPFHPAYYYEHFELPGRRMNTSRGWEINPKIIYDMAKRIEREYDNVPWFVAENGIGIENEARFKDDAGVIQDDYRIAFIAEHLYWTLKAKEEGANCRGYMLWAFTDNVSPMNAFKNRYGLIEIDLEQDRQRRPKKSAAWFRQLHDTRQLELTLDDEEK

SEQ ID NO: 28594 - protein, 462 aa, Erwinia carotovora subsp. atroseptica SCRI1043
MRSIKRLPMPPTRGVLGHVDYLKRSDIHLQMLRWKAQYGCFFRLRLGLSSAVVIADTEWIRTIMKSRPDEFRRISSIESVFQEAGLNGVFSSEGERWELQRKLTEPMFQPAHLKYFYSSLRKVTSRLSERFTMLAETGEAIALVDEFKRYTVDITSLLAFGEDVNTLEQGDNPLSQSLRHLFPIINERCESPIPVWRYIRRARDKQFDASLNLIREYVDGFISRQRQRIQLNPQLLEAPENMLQVMLAEQQKDGTLKDDDIVANAITLLIAGEDTTANTLTWMSFLLCSAPSVEECVFQECKEAAEGVGAILPWPLPRMAWLTAVMYESMRLKPVAPLLYLEPTRDTVIDDFLIKKGTPLLLMLNASGFNDELFQQPYDFMPERWLERGKAAFSDLQPFGGGPRMCPGRSLALMEIKLGFHALCSGFHVEALQVASAVTESFAFTVTPSGFRVKLHKRELQQ

SEQ ID NO: 28595 - protein, 475 aa, Erwinia carotovora subsp. atroseptica SCRI1043
MMSTEIKAQVVVLGAGPAGYSAAFRAADLGLETVLVERYSTLGGVCLNVGCIPSKALLHVAKVIEEAKALAEHGIVFGEPKTDIDKIRLWKEKVINQLTGGLAGMAKGRKVKVVNGLGKFTGANTLEVDGENGKTTINFDNAIIAAGSRPIQLPFIPHDDPRVWDSTDALELKSVPERLLVMGGGIIGLEMGTVYHALGSQIDVVEMFDQVIPAADKDVVKVFTKRISKQFNLMLETKVTAVEAKEDGIYVTMEGKKAPAEPQRYDAVLVAIGRVPNGKNLDAGKAGVEVDDRGFIHVDKQMRTNVPHIYAIGDIVGQPMLAHKGVHEGHVAAEVISGKKHYFDPKVIPSIAYTEPEVAWVGLTEKEAKEKGISYETAIFPWAASGRAIASDCAEGMTKLIFDKETHRVIGGAIVGTNGGELLGEIGLAIEMGCDAEDIALTIHAHPTLHESVGLAAEIFEGSITDLPNPKAKKK

SEQ ID NO: 28596 - protein, 452 aa, Erwinia carotovora subsp. atroseptica SCRI1043
MDNQQTDGTLKRGLKNRHIQLIALGGAVGTGLFLGIAQTIKMAGPSVLLGYAIGGLIAFLIMRQLGEMVVEEPVAGSFSHFAYKYWGDFAGFASGWNYWVLYVLVAMAELSAVGIYVQYWWPDIPTWVSAAVFFLLINAINLANVKVYGEMEFWFAIIKVAAIIGMIAFGGWLLISGTGGPEATVTNLWAQGGFFPNGGLGLVMAMAVIMFSFGGLELVGITAAEADDPEKSIPRATNQVIYRILIFYIGSLAILLSLYPWGKVVEGGSPFVMIFHELNSNVVATILNVVVLTAALSVYNSCVYCNSRMLFGLAKQGNGPKVLETIDSRGVPVVAIGISALATALCVLINYLIPGKAFELLMALVVSALVINWAMISLAHLKFRAQKDKEGTVTKFKALLYPLGNYICLLFLAGILVIMFLTPGIQISVMLIPVWLIILGVGYFIKKKNQAK

SEQ ID NO: 28597 - protein, 346 aa, Erwinia carotovora subsp. atroseptica SCRI1043
MRIEEDLKLGFKDVLIRPKRSTLKSRSDVELERQFTFLHAGGNWSGVPIIAANMDTVGTFSMAEVLASFDVLTAVHKHYSVEQWSQFVQRAPESVLRHVMVSSGTSDADFIKLKQILALSSELKFICIDVANGYSEHFVTFLQKVREACPDKVICAGNVVTGEMVEELILSGADIVKVGIGPGSVCTTRVKTGVGYPQLSAVIECADAAHGLGGQIVSDGGCAMPGDVAKAFGGGADFVMLGGMLAGHDECEGTIVEENGEKMMLFYGMSSASAMERHVGGVAEYRAAEGKTVKLPLRGPVDNTVRDILGGLRSACTYVGASRLKELTKRTTFIRVAEQENRIFNG

SEQ ID NO: 28598 - protein, 379 aa, Erwinia carotovora subsp. atroseptica SCRI1043
MAKQDYYESLGVAKSADDREIKKAYKRLAMKYHPDRNPGDSEAEAKFKEIKEAYEILIDSQKRAAYDQYGHAAFEQGGMGGGGGGGFGGGGADFGDIFGDVFGDIFGGGRRQRASRGSDLRYNMELSLEEAVRGVTKEIRIPALEECDVCHGNGAKPGSSPITCPTCHGNGQVQMRQGFFTVQQACPHCHGRGKIIKDPCIKCHGHGRVEKSKTLSVKIPAGVDTGDRIRLSGEGEAGDHGAPSGDLYVQVQVKAHPIFQREENNLYCEVPINFAMAALGGEIEVPTLDGRVKLKVPAETQTGKLFRMRGKGVKSVRGGAQGDLLCRVVVETPVNLNERQRQLLQELDESFGGPSGERNSPRSKNFFDGVKKFFDDLTR

SEQ ID NO: 28599 - protein, 387 aa, Erwinia carotovora subsp. atroseptica SCRI1043
MSVIKMTDLDLAGKRVLIRADLNVPVKEGKVTSDARIRASLPTIEIALKQGARVMVTSHLGRPTEGEYNEDFSLLPVVDYLKEKLSSPVRLAKDYLDGVDVAEGELVVLENVRFNKGEKKDDEVLSKKYAALCDVFVMDAFGTAHRAQASTHGVGKFATIACAGPLLSGELEALGKALSKPARPMVAIVGGSKVSTKLTVLDSLSKIADQLIVGGGIANTFVAAQGHNVGKSLYEADLISEAKKLLETCDIPVPSDVRVASEFSETAAATLKSVTEIKDEEQILDLGDVSAERLAEILKNAKTILWNGPVGVFEFPNFRKGTEIIARAIADSDAFSIAGGGDTLAAIDLFGIADKISYISTGGGAFLEFVEGKKLPAVVMLEERAKQ

SEQ ID NO: 28600 - protein, 349 aa, Erwinia carotovora subsp. atroseptica SCRI1043
MLVNAYGAHAGDKPLEPLKIVRRAPGAHDVQIEIAYCGICHSDLHQVRAEWAGTQFPCVPGHEIVGRVSAVGPHVSAFKAGDLVGIGCIVDSCRHCEECDEGLENYCDGMVGTYNGPTADEPGWTLGGYSQQIVVHERYVLRVRHSEAELAAVAPLLCAGITTYSPLRHWNAGPGKKVGVVGIGGLGHMGIKLAHAMGAYVVAFTTSESKREDAKALGANEVVVSRNAEEMAAHAGSFDLILNTVAAPHDLDAFLVLLKRDGALTLVGAPASPHPSPNVFNLIMKRRTVAGSMIGGIPETQEMLDFCAEHGIVSDIELIRADEINEAYERMLKGDVKYRFVIDNATLSA

SEQ ID NO: 28601 - protein, 394 aa, Erwinia carotovora subsp. atroseptica SCRI1043
MSKEKFERTKPHVNVGTIGHVDHGKTTLTAAITTVLAKTYGGSARAFDQIDNAPEEKARGITINTSHVEYDTPARHYAHVDCPGHADYVKNMITGAAQMDGAILVVAATDGPMPQTREHILLGRQVGVPFMIVFMNKCDMVDDEELLELVEMEVRELLSQYDFPGDDIPVIRGSALKALEGEAEWEAKIIELAGYLDSYIPEPERAIDKPFLLPIEDVFSISGRGTVVTGRVERGIVKVGEEVEIVGIKDTVKSTCTGVEMFRKLLDEGRAGENVGVLLRGIKREEIERGQVLAKPGSIKPHTQFESEVYILSKDEGGRHTPFFKGYRPQFYFRTTDVTGTIELPEGVEMVMPGDNIKMVVTLIHPIAMDDGLRFAIREGGRTVGAGVVAKVIA

SEQ ID NO: 28602 - protein, 272 aa, Erwinia carotovora subsp. atroseptica SCRI1043
MKSLFKVTLLATTMALALNAGQALAADKAQASESTTAAKFKNDEQAAAYALGASLGRYMDNSLKEQEKLGIKLDKDQLIAGVQDAFADKSKLTDEEIEKTLQGFEGKVKAAAEAKMKQDAKDNADKGAKYLESFAKEKGVKKTESGLLYQVEKEGSGNAPKDSDTVVVNYKGTLVDGSEFDNSYKRGEPLSFRLDGVIPGWTEGLKHVKKGGKIKLAIPPAQAYGENGVPGIPANSTLVFDVELLDIKSEADLKAADDAKAEKPAAAEKTAK

SEQ ID NO: 28603 - protein, 408 aa, Erwinia carotovora subsp. atroseptica SCRI1043
MAAEQKAVTRDTHDKVILPVYAPAKFVPVKGKGSRVWDQDGREYIDFSGGIAVTALGHCHPALVNALRQQGETLWHTSNIFTNEPALRLASKLIDATFADRVFFVNSGAEANEAAFKLARHYAVKRHSPYKTKIIAFYNAFHGRTLFTVSVGGQPKYADGFGPKPADIVHVPFNDLAAVKAVMDDHTCAVVLEPIQGEGGITPATPEFLQGVRDLCDQHKALLVFDEVQSGMGRTGKLFSYMHYGITPDILTTAKALGGGFPISAMLTTEEIASVMTVGVHGTTYGGNPLACAVAEAALDIINTPEVLSGVADRHDRFVSELDKINQQYGVFDQVRGMGLLLGAELKPQWHGRAGEFLAAAAAQGLMVLMAGPNVIRFVPSLIIDEDDIAQGMEKFAKAVAQVVNTAN

SEQ ID NO: 28604 - protein, 254 aa, Erwinia carotovora subsp. atroseptica SCRI1043
MTTPAISLRNIHKSFGSLDVLKGISIEANQGEVISILGSSGSGKSTLLRCSNLLELPDQGEIIVGGEAIEMKPNRKGQNRPSNLKQIDRIRSQLGMVFQNFNLWSHKTVLENIIEAPVHVLKRPQAECVEHAEQLLEKVGLADKRHYYPAHLSGGQQQRAAIARALAMEPKVMLFDEPTSALDPELVGEVLRVMRTLADEGMTMLVVTHEMDFAREVSNRIVFLHQGEIEEQGTPEQVFTASQSARFRQFIASW

SEQ ID NO: 28605 - protein, 225 aa, Erwinia carotovora subsp. atroseptica SCRI1043
MKPFLIAPSILSADFARLGEDTTNVLAAGADVVHFDVMDNHYVPNLTIGPLVLKSLRDYGITAPIDVHLMVKPVDRIIPDFANAGASFITFHPEATDHLDRSLQLIKDHGCKAGLVFNPATPLSYLDYVMDKLDIILLMSVNPGFGGQSFIPSTLDKLRQVRRLIDDSGYDIRLEVDGGVKVENIGAIAEAGADMFVAGSAIFGHPDYRAVIDQMRNEISRTKHG

SEQ ID NO: 28606 - protein, 338 aa, Erwinia carotovora subsp. atroseptica SCRI1043
MILNKVTDLIGNTPVIQIPVPYGDTRLFLKVEKNNPGGSMKDRMARNMIVAGLKSGKIRPGGTIVESSSGNTGIGLALASIEYGLRFIAVVDHHAAQDKIAIMRALGAEIRYVSGDYGEDEVAVVERQRMAAQLAEEIPGAVFMNQSDNAANAGGYADFVRELFSQIGKIDAFVGCVGTGGSMTGISHGLKVHNPDIATIAVEPVGSIVFGHPGKPYYQSGTGTPAGDTVGLVLDYSCIDCGEQVSDAQAFETARYVARNYGLLVGGSTGGVIYKALELIYQDRIGGNVVLAIADGGEKYLHTVFNEEWLAERNLTDSSVWHDLDRWLGNAISLEQAS

SEQ ID NO: 28607 - protein, 449 aa, Erwinia carotovora subsp. atroseptica SCRI1043
MLSIFRPAAHQPRVSQDHVDPVYRRLRWQIFMGIFFGYAAYYLVRKNFTLAMPYLIEQGFSRGDLGFALSGISIAYGFSKFIMGSISDRSNPRVFLPAGLILSAAVMLFMGFVPWATSSIAIMFVLLFLCGWFQGMGWPPCGRTMVHWWSQKERGGIVSVWNCAHNVGGGLPPLLFLLGMAWFNDWKAALYMPAFAAILVAMIAFALMRDTPQSCGLPPIEEYKNDYPVDYNEKAEEELTAKQIFMQYVFPNKLLWYIAIANVFVYLLRYGILDWSPTYLKEVKHFALDKSSWAYFLYEYAGIPGTLLCGWMSDKVFKGNRGATGVFFMVLVTIATVVYWMNPAGNPGVDMACMIIIGFLIYGPVMLIGLHALELAPKKAAGTAAGFTGLFGYLGGSVAASAIVGYTVDFFGWDGGFMVMIGGSIMAVLLLVVVMLNEKKHKAELANRA

SEQ ID NO: 28608 - protein, 253 aa, Erwinia carotovora subsp. atroseptica SCRI1043
MISVKNLSKRFGDQVVLDNISLDIAKGEVVAIIGPSGSGKSTLLRCLNLLETPESGTIEIGEQTLDTRRYSSKEAYALRRQTAMVFQSYNLFKNKTALENVTEALIVVKKMPKKQATEVGLALLEQVGLLPQAAQYPVTLSGGQQQRVSIARALAVDPKALLFDEPTSALDPERVHEVLQVIQKLAKNDTTMVIVTHEMQFAKEVADRVIFMADGHIVEEGPAEQVISFSDNPQTQRFLRQLTKLPEPLEYDI

SEQ ID NO: 28609 - protein, 462 aa, Erwinia carotovora subsp. atroseptica SCRI1043
MAEDVKQEKLHRGLEARHIELIALGGTIGVGLFMGAASALKWAGPSVLLAYIVAGIFVFFIMRSMGEMLYLEPVAGSFAVYAHKYMHPFFGYLTAWGYWFMWMAVGISEITAIGVYVQYWFPELPQWIPAIVAVALVAGANLAAVRLYGEIEFWFAMIKITTIVVMILVGVGIIFFGFGNHGQATGFSNLTEHGGFLAGGWKGLLFALCLVVASYQGVELVGITAGEAKNPQVTLKRAINNILWRILIFYVGAIFVIVTIFPWNEIGTSGSPFVLTFAKIGIVAAAGIINFVVLTAALSGCNSGMYSCGRMLYSLANNRQLPAWLGKVTASGVPAAGVMISILCLVAGSLLNYVIPNPEKVFVYVYSASVLPGMVPWFVVLISQLRFREQHRVALASHPFKSILFPWVNYLTMAFLLCVLVGMYINIDTRMSLLVGVAFLAVVSLCYFALGLGKKTSLAGGK

SEQ ID NO: 28610 - protein, 1322 aa, Erwinia carotovora subsp. atroseptica SCRI1043
MGSTTMGVKLDEETRERIKVAAQRIDRTPHWLIKQAIFHYLERLESGLDTPETPQSANISRIEAEEIMPQSREEETHQPFLDFAEQVLPQSVTRAAMTSAYRRPESELVPILLEQARLTDEMSQLTQKLAYRLAEKLRSQKLGNGRAGIVQGLLQEFSLSSQEGVALMCLAEALLRIPDKSTRDALIRDKISRGNWQAHLGHSPSLFVNAATWGLLFTGKLVATHNEANLSNSLNRIIGKRGEPLVRKGVDMAMRLMGEQFVTGETIGEALANARERENKGFRYSYDMLGEAALTAHDAAAYLTAYQQAIHAIGKASNGRGIYEGPGISIKLSALHTRYSRAQYDRVIDELYPRLLSLTLLARQYDIGINIDAEEADRLEISLDLLEKLCMEPQLVGWNGIGFVIQAYQKRCPYVIDELIELAQRSHRRLMIRLVKGAYWDSEIKRAQVDGLEGYPVYTRKVYTDVSYLACARKLLAVPNLIYPQFATHNAQTLSAIYHMAGNNYYPGQYEFQCLHGMGEPLYDQVVGAVADGKLNRPCRIYAPVGTHETLLAYLVRRLLENGANTSFVNRIADTSMALETLIADPISGVEALAKVEWSMGAPHPRIPLPRQLYGQERKNSSGLDLSNEHRLASLSSALLSHAVQSWYAEPMIEGESEASEQKPVVNPADVHDVVGYVRDASTADVELALAAAVRAGTIWFATPATERAAILNRAASLMEGQLQSLLGLLVREAGKSFSNAIAEVREAVDFLRYYAGQVRDTFANDTYRPLGPVVCISPWNFPLAIFTGQISAALAAGNSVLAKPAEQTPLIATQAVRILHEAGVPTGVLQLLPGQGETIGAALVNDERVRGVVFTGSTAVAKILQRSIAGRLDPQGRLTPLIAETGGLNAMIVDSSALTEQVVNDVIASAFDSAGQRCSALRLLCLQEDIADRTLTMLRGAMAECRMGNPERLSTDIGPLIDAEAKENVERHIQTMRAKGHTVYQAVYPQDDAAWLRGTFVKPTLIELNDISELEKEVFGPVLHIVRYQSQQLDTLIEQINAAGYGLTLGVHTRIDETIQRVTNRAKVGNQYVNRNMVGAVVGVQPFGGEGLSGTGPKAGGPLYLYRLLAHRPDDALAAEFAKQNREQAPDTSARALLLAGLQALEDWAISGEHQDLATLCQRYKEYSVSGTTRRLLGPTGESNTYTLLPRERILCLADNDEDRLIQAAAVLATGGKLLWPEGEQEKTLYARLPEELQSRIQFTHGWQRHEVSFQGVIFHGNADRLRQISEALAERDGPIILLLGYSNGDTHVQLERLLIERSLSINTAAAGGNASLMTIG

SEQ ID NO: 28611 - protein, 468 aa, Erwinia carotovora subsp. atroseptica SCRI1043
MTLEHQFDYDAIIIGSGPGGEGAAMGLAKHGAKIAVIERHYNVGGGCTHWGTIPSKALRHAVSRIIEFNQNPLYSDNSRIIRSSFSDILRHADSVIGQQTRMRQGFYERNQCELFSGEASFIDAHTIAVHYPDNTHETLTAANIIIATGSRPYHPAEVDFNHPRIYDSDSILQLDHEPQHVIIYGAGVIGCEYASIFRGLSVKVDLINTRDRLLAFLDQEMSDALSYHFWNNGVVIRHNEEFDSIEGLSDGVIVNLKSGKKMKADCLLYANGRTGNTETLGLENIGLSTDSRGQLKVNSMYQTALAHIYAIGDVIGYPSLASAAYDQGRLAAQAIIKGDASAHLIEDIPTGIYTIPEISSVGKTEQELTAMKVPYEVGRAQFKHLARAQIVGMNVGSLKILFHRETKQILGIHCFGERAAEIIHIGQAIMEQKGEGNTIEYFVNTTFNYPTMAEAYRVAALNGLNRLF

SEQ ID NO: 28612 - protein, 161 aa, Erwinia carotovora subsp. atroseptica SCRI1043
MKYDTSELCDIYHEEVNVVEPLFSNFGGRTSFGGKITTVKCFEDNGLLFDLFEENGLGRVLLIDGGGSVRRALINAELARLATQNEWEGIVVYGAVRQVDDLAELDIGIQAMAAIPVGAGSEGIGESDIRVNFGGVTFFSGDHLYADNTGIILSEDPLDIE

SEQ ID NO: 28613 - protein, 279 aa, Erwinia carotovora subsp. atroseptica SCRI1043
MSQAERSTLRGQCIAEFLGTGLLIFFGVGCVAALKLAGASFGQWEISIIWGLGVAMAIYLTAAISGAHLNPAVTIALWLFACFDGRKVLPYIVAQIAGAFCAAALVYGLYYNLFVDFEQTNNMVRGSTESLSLASIFSTYPNPHISVMQALLVETVITAILMCLILALTDDGNGIPRGPLAPLLIGILIAVIGASMGPLTGFALNPARDFGPKLFAFLAGWGNVAFTGAREIPYFLIPIFGPIIGACLGAFGYRALIGRNLPCDVCEPEAEATTRRESR

SEQ ID NO: 28614 - protein, 255 aa, Erwinia carotovora subsp. atroseptica SCRI1043
MRHPLVMGNWKLNGSTNLVNELIAGLRKELSTVDGCGVAIAPPAIYLDQANHQLAGSRIALGAQNVDVNLSGAFTGETSAEMLKDIGAKYIIIGHSERRTYHKESDEFIAKKFGVLKDAGLIPVLCIGETEAENEAGQTEAVCARQLDAVLNTLGAKAFENTVVAYEPVWAIGTGKSATPAQAQAVHKFIRDHIAKQDAAVAEQVIIQYGGSVNAANAAELFTQPDIDGALVGGASLKADAFAVIVKAAADAKRG

SEQ ID NO: 28615 - protein, 310 aa, Erwinia carotovora subsp. atroseptica SCRI1043
MTTTNIAVIGECMIELSQKGTDLNRGFGGDTLNTAVYIARQVNADKLGVHYVTALGTDSFSTEMVAAWQKEGVKTDLIQRLDNKLPGLYFIETDDSGERTFYYWRNDAAARYWLDSPEAEKIGQGLAQFDYLYLSGISLAILNAESRQRLLALLRACRANGGKVIFDNNYRPRLWQSKEETQQSYTDILSCTDIAFLTLDDEDMLWGTKPLEAVLERTHGLGVNEVVIKRGADSCIVSERGQALVDVPAIKLSKEKVVDTTAAGDSFSAGYLAVRLNGGSTQEAAQRGHLTASTVIQYRGAIIPLEAMPA

SEQ ID NO: 28616 - protein, 453 aa, Erwinia carotovora subsp. atroseptica SCRI1043
MTSKLKPTLGALHLWGIAVGLVISGEYFGWSYGWGVAGTLGFLVTTLFIAAMYTCFIFSFTELTTAIPHAGGPFAYSRLAFGDLGGLIAGMATLIEFVFAPPAISMAIGAYLNVQYPELNPKLAAVGAYLIFMSLNILGVKLAAMFELVVTLLAVMELLVFMGVVAPGFSLSNFVAHGWAGQNEFSPSAISGMFAAIPFAIWFFLAIEGAAMAAEEAKDPKRTIPRAYVSGILTLVVLAIGVMVMAGGVGDWRQLSDLNDPLPQAMKLIVGENSNWMHMLVWIGLFGLIASFHGIILGYSRQFFALARAGYLPPGLAKLSRFHTPHRAILAGGAIGIAAIFCDGINLQGMNLTAAMITMAVFGAIVMYIMSMLSLFRLRRSAPNMARSYRAPGYPIVPAFALVCAIICLIAMLWFNPVVGGLFCTFMLLGYLYFLTTKARREHLLEPLVADAN

SEQ ID NO: 28617 - protein, 447 aa, Erwinia carotovora subsp. atroseptica SCRI1043
MATRSTIMDTNSFRAEHADALSADIRTLTDKRSKILGESYRLFYRKPVHLVRGEGQYLWDADGKKYLDVYNNVASIGHCHPAVIEAVHQQMTMLNTHTRYLHERILDYSEQLLATTPTAINRAMYMCTGSEANDLAIRVARAWSGGTGVIVTREAYHGTSDLTSGVSPALGSGQPLAATTRLVPPPDAYRVNTPDLRVWFANEIQKQIDDMAAHGIKFAAFLADSIFSSDGVHPNPRGFLRPVVDVVHRNGGIFIADEVQPGFARTGDAFWGFARHDVVPDIITTGKPMGNGIPVSGLLAKSDVLAAFSDQIPYFNTFGGNPVAMAAAQAVLKVIHDEQLQEHSRVVGAQLLAELTTLQDKYARVGNVRGAGLFIGFELVSDRESKTPDKTLALNLTEALRDRGVLTSVAGPYGNVLKLRPPLAFQTQDIDWLVGALDDCLGALTHD

SEQ ID NO: 28618 - protein, 490 aa, Erwinia carotovora subsp. atroseptica SCRI1043
MKDSAITGFPKGFLWGGALAANQVEGGWDVGGKGLSTADMAIHKKNLKREEYEKHYKITDQQIEEAIAATDASPYPKRRGIGFYHHFREDIALFAEMNFKVLRVSIAWTRIFPTGIEEQPNEEGLRFYDALFDELHKNGIEPLVTLSHYEMPIYLVNNFAGWNGRKTVDCFEKFAVTVLDRYKDKVKYWLTFNEIDSIIRHPFTTGGIVPERFSDDEIETVIYQALHHQFVASALAVKHCRRLCPEAKIGCMLTRLLTYPESCAPEDILLAYRENQLNYFFSDVQIRGRYPRHMTRRFAEKGIHIEMLPGDEEILQQHTVDFLSFSYYMSLVTSVNADKMDKVGGNIAGGVKNPYLKTTEWDWQIDPVGLRVALNDMYDRYQIPLFVVENGMGAVDQIDENHQVNDDYRIAFFQSHLKEMKEAVKDGVELMGYTSWAPIDLISASTSEMNKRYGFIYVDQDNDGNGTLARYRKKSFYWYQNVIATNGETL

SEQ ID NO: 28619 - protein, 465 aa, Erwinia carotovora subsp. atroseptica SCRI1043
MHDHLQNDFRFPANFWWGSASSAPQTEGESLSYGKSATVWDEWFATQPGRFHQQVGPADTSTFYQHWREDIALLKTLNHNTFRTSISWARLIPDGVGEPNPQAVAFYNQIIDEMLAQGITPFINLFHFDMPMVMQRLGGWENRAVVAAYAGYAATCFRLFGDRVKHWFTFNEPVVPVEGGYLYDFHYPNVVDFKRAATVAYHTMLAHALAVKAYREQSQGGEIGIILNLTPSYPRSQHPADVNAANIADLMFNRSFLDPALKGEYPQELVDLLHRYGQLPNCQPDDRALLADGVVDLLGINYYQPRRIQCRDSLVNPDSPFMPEWFFASYEMPGRKMNPYRGWEIYEPGVYDILTNLRVNYGNPRCFISENGMGVENEQRFDANGQIQDDYRIDFVREHLKQVHKGIAEGSNCLGYHMWTFIDNWSWSNAYKNRYGFVQLDLATQTRTVKKSGEWFATVAAENGF

SEQ ID NO: 28620 - protein, 480 aa, Erwinia carotovora subsp. atroseptica SCRI1043
MSIEQLPKDFLWGGAVAAHQVEGGWDQGGKGASICDVLSGGAHGVDRVITDGVQPGVSYPNHQAVEFYSHYKQDIALFAEMGFKCFRTSIAWTRIFPNGDELEPNEAGLQFYDDLFDELLKYNIEPVITLSHFEMPHHLVKQYGGWFNRKVVDFFVRYSEVVMKRYQSKVKYWMTFNEINNQRNWQYPLFGYCCSGVIFTDHDKPEQALYQTLHHQFVASAKVVKLGHDINPDFKIGCMLALVPLYPWSCHPDDVMFAQEGMRQHHLFGDVQLRGYYPSYILNEWARKGYHIDMQPEDEQTLREGCTDYLGFSYYMSNAVQYAAKGRKTEDVIVGFDGGVKNPHVKASEWGWQIDPVGLRYTLNSFYERYQKPMFIVENGFGAVDKVEADGSINDDYRIDYLKAHIEQMKKAVVEDGVELMGYTPWGCIDCVSFTTGQYSKRYGFIYVDKHDDGTGTFNRSKKKSFDWYKKVISSNGAEL

SEQ ID NO: 28621 - protein, 470 aa, Erwinia carotovora subsp. atroseptica SCRI1043
MINVKKHSFVIGYPTTVIPFFGLVLMNKSQPGLATEQGLLERVFKLKQHGTTARTETIAGFTTFLTMVYIVFVNPQILGVAGMDTKAVFVTTCLIAAFGSILMGLLANLPVALAPAMGLNAFFAFVVVGAMGLPWQVAMGAIFWGAIGFLLLTIFQIRYWMIANIPLSLRLGIASGIGLFIAMMGLKNAGIIVPNPETLVTIGNLTSHSVLLGALGFFIIVALASRNIHAAVLISIVVTTSIGLLLGDVTFSGVFSMPPSVTSVVGQVDLAGALNLGMSGIIFSFMLVNLFDSSGTLIGVTDKAGLVDARGKFPRMKQALYVDSISSVAGAFIGTSSVTAYIESSSGVSVGGRTGLTAVVVGLLFLLVIFLSPLAGMVPAYAAAGALIYVGVLMTSSLARVKWDDLTEAVPAFITAVMMPFSFSITEGIALGFISYCVMKLATGRWREISPCVVVVALLFLLKIVFIDGH

SEQ ID NO: 28622 - protein, 168 aa, Cucumis sativus
GSVRAKNTMNIMLTNVLDAAAGGLFYYLFGFAFAFGTPSNPFIGRHFFGLKSIPSTAADYSFFLYQWAFAIAAAGITSGSIAERTQFVAYLIYSSVLTGFVYPVVSHWFWSPDGWASPSRTDGDLLFGTGVIDFAGSGVVHMVGGIAGLWGALIEGPRIGRFDKTGRS

SEQ ID NO: 28623 - protein, 119 aa, Armoracia rusticana
PGSFNKILVTYETGTYNGQWSAVGRTAVTTTLAGCTAALTTLFGKRLLSGHWNVTDVCNGLLGGFAAITGGCSVVEPWAAIICGFVAALVLLGCNKLAEKLRYDDPLEAAQLHGGCGAW

SEQ ID NO: 28624 - protein, 119 aa, Brassica napus
PGFFNKILVTYESGSMNGQWSAVGRTAVTTTLAGCTAALTTLFGKRLLSGHWNVTDVCNGLLGGFAAITGGCSVVEPWAAIICGFLAALVLLGCNKLAERLRYDDPLEASQLHGGCGAW

SEQ ID NO: 28625 - protein, 119 aa, Lepidium sativum
PGSFNKILITYETGTYNGQWSAVGRTAVTTTLAGCTAALTTLFGKRLLSGHWNVTDVCNGLLGGFAAITGGCSVVEPWAAIICGFVGALVLLGCNKLAEKLKYDDPLEAAQLHGGCGAW

SEQ ID NO: 28626 - protein, 119 aa, Capsella bursa-pastoris
PGSFNKILVPYETGTYNGQWSAVGRTAVTTTLAGCTAALTTLFGKRLLSGHWNVTDVCNGLLGGFAAITGGCSVVEPWAAIICGFVAALVLLGCNKLAEKLRYDDPLEAAQLHGGCGAW

SEQ ID NO: 28627 - protein, 119 aa, Arabis alpina subsp. caucasica
PGSFNKILISYESGTVNGQWSAVGRTAVTTTLAGCTAALTTLFGKRLLSGHWNVTDVCNGLLGGFAAITGGCSVVEPWAAIICGFVAACVLLGCNKLAEKLRYDDPLEAAQLHGGCGAW

SEQ ID NO: 28628 - protein, 119 aa, Barbarea verna
PGSFNKIAVTYATGTYNGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAW

SEQ ID NO: 28629 - protein, 119 aa, Crambe cordifolia
PGSFNKILVTYESGSMNGQWSAVGRTAVTTTLSGCTAALTTLFGKRLLSGHWNVTDVCNGLLGGFAAITGGCSVVEPWAAIICGFIAALVLLGCNKLAERLRYDDPLEAAQLHGGCGAW

SEQ ID NO: 28630 - protein, 466 aa, Desfontainia spinosa
  misc_feature (122)..(122): Xaa can be any naturally occurring amino acid
  misc_feature (438)..(438): Xaa can be any naturally occurring amino acid
SVGFKAGVKDYKLTYYTPDYQTKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALXALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLAHYCRDNGLLLHIHRAMHAVIDRQKNHGIHFRVLRKALRMSGGDHIHSGTVVGKLEGERDITLGFVDLLRDDYIEKDRSRGIYFTQDWVSLPGVLPVASGGIHVWHMPALTEIFGDDSVLQFGGGTLGHPWGNAPGSVANRVALEACVQARNEGRDLAREGNEIIRXACKWSPELAAACEVWKEIKFEFEAMDTI

SEQ ID NO: 28631 - protein, 468 aa, Diervilla sessilifolia
SAGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAYYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRGACKWSPELAAACEVWKEIKFEFEAMDTLNQ

SEQ ID NO: 28632 - protein, 443 aa, Yersinia pseudotuberculosis
MTTLENNNTLNVFSDHESSARSYCRNFPVIFQRASGCYLYDQHDNAWLDFLSCAGSVNYGHNPTALKEALIAYLAADGIQAALDMHSVAKAEFITAFNAIILQPRGLDYKMQFTSPTGTSVVESAIKLVRKVTNRTNVVAFTNGFHGMSSTALGLTGNRDNRQNTIDSHVFRLPYDGYLEGLDTIAYFEKLLTDNSSGMDIPAAVILETVQGEGGINVASKTWLQRLHTLLQRHDILLIIDDIQAGCGRTGHFFSFEFASIQPDMVCLSKSLSGYGLPFSLLLFKPQWDQWKPGEDNGTFRGNTSAFVTAKAALENYWSDDQLSQHVFRQEKVVQQWLQEITARFPRFIKQTRGRGLFYGIELYSPELAQKITQHCFGQQLIVERSGDRDQVIKIMPALSIPEETLLSGLVILERAMEACLTDAEAIPSATRADALHHVGVTQ

SEQ ID NO: 28633 - protein, 219 aa, Cynodon dactylon
HTELRSRQILCKAEVNISSNIPESLPSSVPESKPEVSQYEKVVELLTTLFPVWVILGTIIGIYKPSMVTWLETDLFTLGLGFLMLSMGLTLTFDDFKRCLRNPWTVGVGFVAQYLIKPLLGFAIATSLNLSAPLATGLVLVSCCPGGQASNVATYISKGNVALSVLMTTCSTIGAIVMTPLLTKILAGQLVPVDAVGLAMSTFQVVLMPTIVGVLAHEY

SEQ ID NO: 28634 - protein, 130 aa, Cynodon dactylon
MPGASPSTSSRPPPGTSDPTVFSARGGFGSVFKGWIDENTFAPARPGTGMVIAVKKPNQEGFQGHREWLAEVNYLGQLSHPNLVKLVGYCLEDEQRLLVYEFMPRGSLENHLFRRSSHFQPLSWNLRMKV

SEQ ID NO: 28635 - protein, 135 aa, Cynodon dactylon
MASTACFVIVSKNDIPIYGAEVGSAPKKEELAYQHQFILHAALDVVQDLAWTTNAMFLKSVDRFNDLVVSVYVTAGHTRFMLLHDSRSEDGIKTFFQEVHELYIKIFLNPLYLPGSRITSSHFDTKVRALARRYL

SEQ ID NO: 28636 - protein, 175 aa, Lotus corniculatus var. japonicus
LFEPSELTSWSFYRAGIAEFVATFLFLYITVLTVMGVSGADSKCKTVGIQGIAWAFGGMIFALVYCTAGISGGHINPAVTFGLFLARKLSLTRAIFYIVMQCLGAIVGAGVVKGFEGKTKYGTLGGGANFVAPGYTKGDGLGAEIVGTFVLVYTVFSATDAKRSPETLTSPFWHL

SEQ ID NO: 28637 - protein, 192 aa, Lotus corniculatus var. japonicus
YKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLV

SEQ ID NO: 28638 - protein, 486 aa, Oryza sativa (indica cultivar-group)
MEEKPQHGSLGGLVAGVREEYESGRTKELEWRKAQLGGLIRMITEEEDAIFDALHDDLGKHRVESFRDELGVLAKSVRNTLQNLKKWASPEKVDVPLISFPCNARVVPEPIGVVLIFSCWNLPIGLALEPLSGAIAAGNAVVLKPSEFAPSTAAFLAANIPKYLDAKAVKVVQGGAELGEELMSTDGQVLFTGNARVGRIIMTKAAKHLTPVALELGSKCPCIVDCLDSKRECQVAVNRIIGAKWSTCAGQACVAIDYILVEEQFAPFLIELLKSTLKRFFTEPEYMARILNEKHFHRLTNLIEDDQVKSSIVHGGNADPKTLWIEPTIVLNPPLDSDIMMEEIFGPLLPIITVKKTEDCIAFLKSKPKPLAIYAFTNNEKLKQRIVAETSSGSVLFNDAIVQYGLDSVPFGGIGESGFGQYHGKYTFELFSHRKAVVRRSLLVEFMFRYPPWDEYKMGMLRRVFRFDYVSLVLALLAFWLLGIRR

SEQ ID NO: 28639 - protein, 456 aa, Medicago sativa
MKKSASTNLQYQSSQRTKNYNFQHSSEIDSTKKQNSALKSFKSVVKIFALIFSGRRKTASKINGSDDRKNTSKPRLMLSSSTDLSSGSSNKNSSKWRFSSSYASSSTTSEQLGTGNFTFEEIYKSTAKFSSDNQIGEGGFGTVYRGKLNDGTIVAVKRAKKEALQSHLYEFKNEIYTLSKIEHLNLVRLYGYLEHGDEKLIIVEYVGNGNLTEHLDGIRGDGLEIGERLDIAIDIAHAITYLHMYTDNPIIHRDIKASNILISENLRAKVADFGFARLSEDPGATHISTQVKGTAGYMDPEYLRTYQLTEKSDVYSFGVLLVEMMTGRHPVEPKKKIDERVTIRWAMKMLKNGDAVFAMDPRLRRSPASIKVVKKVFKLAFQCLAPSIHSRPAMKNCAEVLWGIRKDFKDETTPLPTLPSHQSENFPQREKNKHITFGIEDDDSYKFSSAPNHIHL

SEQ ID NO: 28640 - protein, 335 aa, Allium cepa
MEVERVQAIATLTANLGTIPSEFIRSDHERPDLTTYHGPVPELPVIDLANSSQENVVKQISEAAREYGIFQLVNHGIPNEVINELQRVGKEFFLLPQEEKEVYATVPDSGSFEGYGTKLQKDLEGKKAWVDYLFHNVWPKHKINYKFWPRNPPAYRKANEEYTKHLQVVVDKMHSYLSLGLGLESHVLKEAVGGDDLEYLLKINYYPPCPRPDLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDGNPPKFKTKKYKDYAYCKINKLPQ

SEQ ID NO: 28641 - protein, 337 aa, Camellia sinensis
MEAQPTAPKAACVVGGTGFVAATLIKLLLEKGYAVNTTVRDPGNQKKTSHLLALKGSGNLKIFRADLTDEQSFDTPVAGCDLVFHVATPVNFASEDPENDMIKPAIQGVVNVLKACAKAGTVKRVILTSSAAAVSINKLNGTGLVMDESHWTDTEFLNSAKPPTWGYPLSKTLAEKAAWKFAEENNINLITVIPTLMAGPSLTADVPSSIGLAMSLITGNEFLINGLKGMQMLSGSISISHVEDVCRAHVFVAEKESASGRYICCAVSTSVPELAKFLNKRYPEYNVPTDFGDFPSKAKLILSSEKLTKEGFSFKYGIEEIYDQSVEYFKAKGILKN

SEQ ID NO: 28642 - protein, 227 aa, Camellia sinensis
GDHILDAQQKGEINEDNVLYIVENINVAAIETTLWSIEWGIAELVNHPQIQKKLRHELDTMLGLGVQITEPDTYKLPYLQAVVKETLRLRMAIPLLVPHMNLHDAKLSGYDIPAESKILVNAWWLANNPDNWKNPEEFRPERFLEEEAKVEANGNDFRYLPFGVGRRSCPGIILALPILGITLGRLVQNFELLPPPGQAKIDTAEKGGQFSLHILKHSTIVLKPRSF

SEQ ID NO: 28643 - protein, 210 aa, Serratia marcescens
MKKFLIAPSILSADFARLGEDTANVLAAGGDVVHFDVMDNHYVPNLTIGPMVCEALRNYGITAPIDVHLMVKPVDRIVPDFAKAGASYISFHPEASEHVDRTIQLIKEHGCKAGLVFNPATPLSYLDYVMDKIDVILLMSVNPGFGGQSFIHGTLDKLRQVRKLIDDSGRDIRLEVDGGVKVDNIAEIAAAGADMFVAGSAIFGQPDYRK

SEQ ID NO: 28644 - protein, 472 aa, Arabidopsis thaliana
MAATLTGSGIALGFSSSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHAKSFLVKAGSGVATLGLPDSPGVPKAATSDTLTAPYNDIAAVEKLFEANKGEIAAIILEPVVGNSGFITPKPEFIEGIRRITKDNGALLILDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 28645 - protein, 337 aa, Vitis vinifera
MGSQSETVCVTGASGFIGSWLVMRLLERRLTVRATVRDPTNVKKVKHLLDLPKAETHLTLWKADLADEGSFDEAIKGCTGVFHVATPMDFESKDPENEVIKPTIEGMLGIMKSCAAAKTVRRLVFTSSAGTVNIQEHQLPVYDESCWSDMEFCRAKKMTAWMYFVSKTLAEQAAWKYAKENNIDFITIIPTLVVGPFIMSSMPPSLITALSPITGNEAHYSIIRQGQFVHLDDLCNAHIYLFENPKAEGRYICSSHDCIILDLAKMLREKYPEYNIPTEFKGVDENLKSVCFSSKKLTDLGFEFKYSLEDMFTGAVDTCRAKGLLRPSHEKPVDGKT

SEQ ID NO: 28646 - protein, 468 aa, Brownlowia elata
KASVGFKAGVKEYKLTYYTPDYQVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIRAASKWSPELAAACEVWKEIKFEFEAMDTI

SEQ ID NO: 28647 - protein, 468 aa, Dombeya sp. Chase 273
KASVGFKAGVKDYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPKSYVKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDEFIEKDRSRGIYFTQDWVSLPGVLPVASGGIHVWHMPALTEIFGDDSVLQFGGGTLGHPWGNAPGAVANRVALEACVKARNEGRDLAREGNEIIREACKWSPELAAACEVWKEIKFEFEAMDTL

SEQ ID NO: 28648 - protein, 469 aa, Dais cotinifolia
KASVGFKAGVKEYKLTYYTPEYETKDTDILAAFRVTPQPGVPPEEAGAAVAAESSTGTWTTVWTDGLTSLDRYKGRCYDIEPVPGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTLD

SEQ ID NO: 28649 - protein, 466 aa, Helicteres baruensis
VGFKAGVKEYKLTYYTPEYQVKDTDILAAFRVTPQPGVPPEEAGAAVAAESSTGTWTTVWTDGLTSLDRYKGRCYHIEPVPGEENQYICYVAYPLDLFEEGSVTNMFTSIVGNVFGFKALRALRLEDLRIPVSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRAASKWSPELAAACEVWKEIKFEFEAMDTLD

SEQ ID NO: 28650 - protein, 469 aa, Keraudrenia hermanniifolia
KASVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPPAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSIPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 28651 - protein, 469 aa, Pentaplaris doroteae
KASVGFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRVPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAICARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 28652 - protein, 468 aa, Sterculia apetala
KASVGFKAGVKEYKLTYYTPEYEVKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMMKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIRAASKWSPELAAACEVWKEIKFEFEAMDTL

SEQ ID NO: 28653 - protein, 168 aa, Sinapis alba
MPRSRINGNFIDKTFTIVADILLRVIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIQQGDSEMAEAWFAQAAEYWKQAITLTPGNYIEAQNWLTITRRFE

SEQ ID NO: 28654 - protein, 468 aa, Tuberaria guttata
KASVGFKAGVKEYKLTYYTPEYETKDTDILAAFRVTPQPGVPPEEAGAAVAAESSTGTWTTVWTDGLTNLDRYKGRCYHIEPVAGEENQYICYVAYPLDLFEEGSVTNMFTSIVGNVFGFKALRALRLEDLRIPVAYTKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGVPIVMHDYLTGGFTANTTLSHYCRDNGLLLHIHRAMHAVIDRQKNHGMHFRVLAKALRLSGGDHVHSGTVVGKLEGERDITLGFVDLLRDDYVEKDRSRGIFFTQDWVSLPGVLPVASGGIHVWHMPALTEIFGDDSVLQFGGGTLGHPWGNAPGAVANRVALEACVQARNEGRDLAREGNEIIRQATKWSPELAAACEVWKEIKFEFEAMDTI

SEQ ID NO: 28655 - protein, 469 aa, Sparrmannia ricinocarpa
KASVGFKAGVKEYKLTYYTPEYETKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYIKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSMPGVLPVASGGIHVWHMPALTEIFGDDSVLQFGGGTLGHPWGNAPGAVANRVALEACVKARNEGRDLAREGNEIIREACKWSPELAAACEVWKEIKFEFEAMDTLD

SEQ ID NO: 28656 - protein, 465 aa, Thomasia solanacea
GFKAGVKEYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 28657 - protein, 466 aa, Triplochiton zambesiacus
VGFKAGVKEYKLTYYTPEYQVKDTDILAAFRVTPQPGVPPEEAGAAVAAESSTGTWTTVWTDGLTSLDRYKGRCYHIEPVPGEENQYICYVAYPLDLFEEGSVTNMFTSIVGNVFGFKALRALRLEDLRIPVSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVTSGGIHVWHMPALTEIFGDDSVLQFGGGTLGHPWGNAPGAVANRVALEACVQARNEGRDLAREGNEIIREASKWSPELAAACEVWKEIKFEFEAMDTLD

SEQ ID NO: 28658 - protein, 468 aa, Trochetiopsis erythroxylon
KASVGFKAGVKDYKLTYYTPEYEVKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPNSYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREATKWSPELAAACEVWKEIKFEFEAMDTL

SEQ ID NO: 28659 - protein, 343 aa, Atropa belladonna
MATLVSNWSTNNVSESFVAPLEKRAENDVPLGNDVPIIDLQQDHLVVVQQITKACQDFGLFQVINHGLPEKLMAETMDVCKEFFALPAEEKEKLQPKGEPAKFELPLEQKAKLYVEGEQLSDEAFLYWKDTLAHGCHPLDEELVNSWPEKPATYREVVAKYSVEVRKLTMRILDYICEGLGLKLGYFDNELSQIQMMLTNYYPPCPDPSSTLGSGGHYDGNLITLLQQNLPGLQQLIEDAKWIAVEPIPTAFVVNLGLTLKVITNEKFEGSIHRVVTNPTRDRVSIATLIGPDYSCTIEPAKELLSQDNPPLYKPYSYAEFGEIYLSDKSDYDAGVKPYKINA

SEQ ID NO: 28660 - protein, 340 aa, Rhizopus microsporus var. chinensis
TFTLNSSCIAIAALAVAVNAAPGDKKISIPLAKNPNYNPSAKNAIQKAIAKYNKHKINTSTGGIVPDAGVGTVPMTDYGNDIEYYGQVTIGTPGKKFNLDFDTGSSDLWIASTLCTNCGSRQTKYDPNQSSTYQADGRTWSISYGDGSSASGILAKDNVNLGGLLIKGQTIELAKREAASFASGPNDGLLGLGFDTITTVRGVKTPMDNLISQGLISRPIFGVYLGKAKNGGGGEYIFGGYDSTKFKGSLTTVPIDNSRGWWGITVDRATVGTSTVASSFDGILDTGTTLLILPNNIAASVARAYGAYDNGDGTYTISCDTSRFKPLVFSINGASFQVSP

SEQ ID NO: 28661 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 28662 - protein, 475 aa, Corynocarpus laevigatus
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTIGHPWGNAPGAVANRVALEACVQARNEGRDLAREGNAIILEASKWSPELAAACEVWKQIKFEFEAMDTL

SEQ ID NO: 28663 - protein, 475 aa, Corynocarpus cribbianus
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGAPIVMHDYLTGGFTANTSLAHYCRDNGLLLHIHRAMHAVIDRQKNHGMHFRVLAKGLRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNAIILEASKWSPELAAACEVWKQIKFEFEAMDTL

SEQ ID NO: 28664 - protein, 475 aa, Corynocarpus similis
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMIKRAVFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNAIILEASKWSPELAAACEVWKQIKFEFEAMDTL

SEQ ID NO: 28665 - protein, 475 aa, Corynocarpus dissimilis
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGTPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNAIILEASKWSPELAAACEVWKQIKFEFEAMDTL

SEQ ID NO: 28666 - protein, 475 aa, Coriaria ruscifolia
MSPQTETKAGAGFKAGVKDYKLTYYTPEYETKDTDILAAFRVTPQPGVPPEEAGAAVAAESSTGTWTTVWTDGLTSLDRYKGRCYQIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMQAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSSELAAACEVWKEIKFEFEAMDTL

SEQ ID NO: 28667 - protein, 475 aa, Coriaria sarmentosa
MSPQTETKAGVGFKAGVKDYKLTYYTPEYETKDTDILAAFRVTPQPGVPPEEAGAAVAAESSTGTWTTVWTDGLTSLDRYKGRCYQIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSSELAAACEVWKEIKFEFEAMDTL

SEQ ID NO: 28668 - protein, 184 aa, Amaranthus hypochondriacus
MASSMMSNAATAVAVAATSGGAQANMVAPFNGLKSIASFPVTRKSNDITSIASNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPTAFIRIIGFDNKRQVQCVSFIAYKPADSY

SEQ ID NO: 28669 - protein, 180 aa, Amaranthus hypochondriacus
MASSLMSNAITAVVGASGAQANMVAPFNGLKSIASFPVTRKSNDITSIASNGGRVQCMQVWPPVGKKKFETLSYLPPLSDAQLLAQVQYLLNNGWIPCIEFELEHPFVYRENHRSPGYQDGRYWTMWKLPMYGCTDPAQVLNEVEEAKKAYPSAFIRIIGFDNKRQVQCVSFIAFKPPGY

SEQ ID NO: 28670 - protein, 490 aa, Zinnia elegans
MSRKMLIDGDVGSISDEDYDFDLFVIGAGSGGVRASRFSAQYGAKVGICELPFHPVSSETVGGVGGTCVIRGCVPKKILVYGASFGPEIQDAKEYGWQVNENLDFDWKKLLHKKTEEIVRLNGVYKRLLSNAGVKLFEGEGRIVGPNEVEVIQLDGTKLSYTAKHILISTGSRAHRPDIPGQELGITSDEALSLDELPKRVVILGGGYIAVEFASIWRGMGSTVNLCFRKELPLRGFDDEMRALVARNLEGRGVILHPQTNLTKLVKTESGIKVTTDHGEELMADVVLFATGRVPNTKRLNLQAVGVEVDKTGAIKVDEYSRTNVPSIWAIGDVTNRINLTPVALMEGTMFAKTVFGNEPSKPDHSNVPCAVFCIPPLSVVGLSEEQAIQQGTGDILVFTSTFKPMKNTISGRQEKTLMKLIVSAENDKVIGASMCGPDAPEIMQGIAIAIKCGATKAQFDSTVGIHPSAAEEFVTMRSVTRRITASGKR

SEQ ID NO: 28671 - protein, 443 aa, Arabidopsis thaliana
MDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLRLGRGFTIKLCHENVYLPMLKTLCLDTVDFDGDHNVFETLLPRCPLLEELVLEDQRWKQWCGSVSSPSLKRLRIRFFHIPIISLDVPGLVYLELSCIFGSKYANVNLDSLVEARLNHWVEEQELRKLRDGSSHLVPADMMDLITGIRKVKVLHLTSDALELFYFSGQELPMFDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 28672 - protein, 368 aa, Arabidopsis thaliana
MMRGAAPTGVVSVMVLMILVLLKQIESASANGSSLGLPPRKFCNIYQGSWVYDKSYPLYDSKNCPFIERQFNCKSNGRPDSEYLKYRWQPSGCNLPRFNGLDFLGRIMKGKKLMFVGDSLSLNQWQSLTCLLHNAAPKANSTSTRSPSGLSVFSFPAYNSSIMFSRNAFLVDIVGAPPKRVMKLDSISSGSLWKTADVLVFNSWHWWLHTDRKQPWDAIMSGNVTVKDMDRLVAYEKAMMTWAKWIDQNIDPSKTKVFFQGISPDHGRAREWSKQGGKGSCIGETKPIMGSSYLAGPHAAEMVVAKVIKTMKNQARLMDVTLMSQLRKDGHPSVYGFGGHRMADCSHWCLSGVPDSWNQLLYSELFHS

SEQ ID NO: 28673 - protein, 365 aa, Ipomoea batatas
MVGGGDFLAVQTHGGQYVQYDIFGNLFEVTSKYAPPITPIGRGAYGIVCSALNAETNEMVAIKKIADAFDNYMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 28674 - protein, 183 aa, Oryza sativa
QAVQELNGKKFDDKEWYVGRAQKKSGREMELKEKFEKNLQEAADKYQNTNLYLKNLDDSVDDDKLRELFAEYGTITSCKVMRDSNGVSRGSGFVAFKSAEDASRALAEMNSKMVGSKPLYVALAQRKEDRKARLQAQFSQLRPVPLAPSVGPRMPMFPPGVPGVGQQLFYGQPPPAFINTQPA

SEQ ID NO: 28675 - protein, 290 aa, Acinetobacter sp. ADP1
MRIGFIGLGAMGWHMAGHLTQLDATVMVWNRTQHKAEAHAMQFGSLAVELEQLVQADLIFSCLPTSAEVEAVIAAYPPRSGSVWIDCTSGVPASAQQLSRHLKQHGVDFLDAPVSGQTIGAEKGTLTVMIGGERTAFERAQPIIQAFAGLIEHVGDSGAGFAVKAVNNILMAANLWALSEGMSVLKAHAVHLDAALACINHSSGKSTMSETIMPQKILSRGFHKTFALNLLQKDIGIAIDLIKAVGQPADVLHCVQQMYSEMDLERATQVDFSAAIQTLEQRNQLLLDLA

SEQ ID NO: 28676 - protein, 232 aa, Acinetobacter sp. ADP1
MMKKIGLALIASSMTVTAFAASIGASSPQKDQLGYSYGYVMGRTNADTLKDLNVDAFVQGLKEGAQGKDSALSDEAMAKVLSQYKKQVEAKQLYAFQQLAQDNLKRGEAFLAENAKKSGVISTKSGLQYQVLSAGKGKSPKASSRVKVNYEGRLLDGTVFDSSIARNHPVEFQLSQVIPGWTEGLQLMKEGEKARLFIPAKLAYGEVGSGDAIGPNSTLIFDIELLEILPSK

SEQ ID NO: 28677 - protein, 235 aa, Acinetobacter sp. ADP1
MSKALPIAVAVILGGAALIPVYYASQHPATDVGSKADKNATPVQKISYALGYEVANQTPAELDVNTFVQGIRDGHAHAPAAYTEEQLQAAYKEYQQEMQKKQLDQTHQSASSSNNFLAENAKKEGVKTTASGLQYKIITEGTGKRPSASSVVKVNYKGQLTDGKVFDSSYERGQPVEFPLNQVIPGWTEGLQLLKEGGKATLYIPAKLGYGEQGVPGMIPPNSTLIFDVELLEVK

SEQ ID NO: 28678 - protein, 472 aa, Acinetobacter sp. ADP1
MTTKILPVIMAGGSGTRLWPLSRTQYPKQFLKLSPDGYTLLQATLLRLKNLDCADPLLICNEEHRFLAAEQMREIGISAKIILEPEGKNTAPAITLAALYQIQQAQDSDTIMLVLAADHVITEQDKFEQSITQALELAKLDKLVTFGIVPTHAETGYGYIEKGNSELNGFQVQRFVEKPDAATAQEYLESQKFLWNSGMFMFKADIYLNELQQHAQDIYNSCVASMQDTKADLDFIRIDKEAFKQCRSESIDYAVMEQTKDAVVVPLDANWNDVGSWSALWDIQDKDDQGNVIQGDVITVKSQNNYVFSESRLVSLLGVDNLVVIETKDAILVADKSKVQDIKKIVESIKEQGRTEHFCHREVYRPWGKYDSIDHAERYQVKRITVKPGQKLSIQMHHHRSEHWIVVNGTAKIHKGKESFLLTENQSTYIPLGEIHALENPGKVPLELIEVQSGSYLGEDDIVRFEDLYGRC

SEQ ID NO: 28679 - protein, 459 aa, Acinetobacter sp. ADP1
MQRKLSNRHLQLIAIGGAIGTGLFMGSGKTISLAGPSILYIYMIIGVMFFFLMRAMGELLLANLQYKSFVDMAHDLIGPGAGYYLGWTYWLGWVLVGIADLAAIINYLNFWLPDGTVFTPMGQALISAGCVLLVLGLNLLTVRLFGEIEFWFALIKILAIVGLIGVGGYMVFSHFQAPAGTVAAISNVWSEGGMFPKGVTGFLAGFQIAVFAFVGVELVGTTAAETRDPQKNLPKAINAIPVRIILFYVLALFVVMSVTPWNHISADKSPFVELFLHAGIPTSAIIMNLVVLSSVMSSMNSGVFSTSRMLFGLSRDGQAPQAFAHLSRRAVPANGLLFSCFFIMAGAALQYFVPNTMEAFTLASSLCVILFISVWGMIMVCYLRYRKLRPELHAQSTFKMPGGIWMSYIVLAFLMFTLVILALEPDTLKALYISPLWLILLALTYQFMYKPRLKRLMHN

SEQ ID NO: 28680 - protein, 181 aa, Acinetobacter sp. ADP1
MSQSIYHIPVQTISGQDTSLDTYRGKVLLIVNVASKCGLTPQYEGLEKLYQDKQQQGLEILGFPANNFLEQEPGSNDEIQQFCSLTYDVHFPLFGKISVAGEDKHPLYQTLIEAQPERIGEGPWWKDLVDYGLTPNPKPEVLWNFEKFLINKNGEVVARFAPDITADDPRLVDAINAELAK

SEQ ID NO: 28681 - protein, 439 aa, Acinetobacter sp. ADP1
MDLVSRIENLPIGKFHYTLLWVVGLGWMFDALDTGIIAFIMTTLVKDWALTPAESGWIVSIGFIGMALGAVFSGGLADRFGRKTVFATTLLIYSLATAACAFAPNLTWLLAFRFIVGLGLGGQLPVAVTLVSEYIPAHVRGRFIVLLESFWGLGWLVAALVSYFVIPHFGWHIAFLIGGLPAIYVYVIIKKVPESIPYLINRGRIDEAHELVQQIERHAGVPVIDTIVVKPVAQKQQVSFRQLWSGRFARRSLMLWLVWFGIVFSYYGIFTWLPSLLVKQGYSVVQSFEYVLIMILAQLPGYISAAWLVERLGRKATLAGFIGACAISAYFFGQADTVFNIMVWGCLLSFFNLGAWGVLYTYTPEQYPANIRAFGAGWASAVGRMGGIAAPIVVTHMMVAHDGFHQVFMMFTLVLLAVAAVIVILGEETQGKTLESIGL

SEQ ID NO: 28682 - protein, 265 aa, Acinetobacter sp. ADP1
MSGSTIIPWVVGNWKMNPKQSDAIQLVQQFKDLLKQQPISEQYCHVGVAPIAIALTTIQSELATANRQVATVAQDVSRFAGTGAYTGEISAELLTDSQIRYVLIGHSERRDLLGDHVEILKAKLSHALNAGMTVIYCVGESLEQREQGLAEQIVLQQICDIAPVVSAEQWQHQIVIAYEPIWAIGTGRTASPEDAQAIHAKIREGLCQITPAGSQIALLYGGSVKPENAVELAACPDINGALVGGASLNAESFYKIAQAFAQTQQ

SEQ ID NO: 28683 - protein, 257 aa, Acinetobacter sp. ADP1
MNNVQWLDEVKFNEQGLIPAIAQHHQTGRILMVAWMNRESLALTAEKKEAVYYSRSRQKLWHKGEESGHFQTVYEIRLDCDGDVIILQIEQHGGIACHTGRESCFYRKLTPQGWEIVDAQLKDPTAIYGQSAKVEAHDHGHSNEQVDVLSYLGQLMQQRKQATADSSYIASLYQKGLNKILEKVGEENIETIIAAKDYAAEPTQEHLNDLIYETADMWFHSIVMLGYFDLTPQAVLDELARRQGLSGLVEKANRNQG

SEQ ID NO: 28684 - protein, 449 aa, Acinetobacter sp. ADP1
MAKVAGFRFELKQLFHLMWPILITQFAQAGLGLIDTIMAGHLSANDLAAIAVGVGLWMPVMLLFSAIMIATTPLVAEAKGARTPEHIPVIVRQSLWVAVSLGVIAMLILQLMPFLLPILGVPESLQPKAGLFLHAIGFGMPAVTMYAALRGYSEALGYPRPVTVISLLALVVLVPLNYIFMYGIGPVPHLGSAGCGFATAILQWLMLITLASYIYRAKAYQSTQVFSHWERINLTLVKRILKLGLPIGLAVFFEVSIFSTGAIVLSPLGDTLVAAHQIAMSVTSQLFMIPMSLAIALTIRVGMYYGEKNWVSMRLVQKLGLATATFFAMCTMSLIWFARPQIVAIYTQDPAVFDIALYLLLFAMAYQLMDAWQVGAAGCLRGMQDTKGPMWITLIAYWVVAFPVGTYLARVAKMGPAGVWLGLITGLSIACVLLLMRLYRNNHKLAQQS

SEQ ID NO: 28685 - protein, 166 aa, Acinetobacter sp. ADP1
MIDSEGFRPNVGIILANDNGQVLWAKRIGHNAWQFPQGGIHFGETPEQALYRELREEVGLLPEHVQIIAQTKGWLRYRLPHRYIRPDSDPVCIGQKQKWFLLKLTASTRHIQLNLSDPPEFDEWQWVSYWYPLGQVVNFKRDVYRKAMMELCMLLPQQQTFEKSSL

SEQ ID NO: 28686 - protein, 482 aa, Acinetobacter sp. ADP1
MNSQTKTTSMTPHSFDIHHLQDVLDQQKRAYQRYPVPSAKDRIDRLARLKRILIKYQDQFAEAINRDYGNRSVGETKIGELLTCLEHVGYYSKHLTQWMKPSKRHISILHQPAKGWVEYQPLGVIGIITPWNYPLLLSVGPLICALAAGNHAMIKISSASAHFGQVLENALSEAFPQELVTVINGGGAISDAFSHLPFDKMIFTGSTSVGKTVMAAASENLVPVILELGGKSPAIVHPSMDMKEAAQRLAVGKLWNAGQTCVAPDYVFLPKGRSAEFIENFKLIALNMYPHFRDNQDYTSIINDKQYRRLQGYLDDAREHGARVIEVNPHNESLDDVRKIAPTLLTGVTTEMDIMKNEIFGPIFPIFEYDQMEDVIEFINRRPRPLALYYFDFDQARADYIAQRTHSGHFGLNTVLTHVAQDDLPFGGVGASGMGKYHGPEGFFNLSHERSMMSNPKLYSLKYILPPFNKPIHRLISKTLLR

SEQ ID NO: 28687 - protein, 267 aa, Acinetobacter sp. ADP1
MSRLATRFEQLKSQQRKALVSYVMAGDPQPQVSVPLLHKMVEAGVDVIELGLPFSDPMADGPVIALAAERALAAGTNTLDALNMVKEFRQNDSETPVVLMGYLNPVEVIGYEKFVSHAKACGVDGVLLVDLPPEEAKEFDVVLKQHDMDQIFLLAPTSTDQRIEHVVKQASGFIYYVSLKGVTGAATLDVTEAAERIAKIKTKTSVPVGVGFGISDAASAKAMGQVADAVIVGSAFVKPFATLAIDQAVEQTVNKVKELRAALDELV

SEQ ID NO: 28688 - protein, 228 aa, Acinetobacter sp. ADP1
MSKPYLIAPSILSADFARLGEDVERVLEAGADVVHFDVMDNHYVPNLTFGAGVCKALKNYGIQAPIDVHLMVSPVDRMIGDFLDAGADIITFHPEATDHIDRSLQLIKAGGAKAGLVFNPATPLHYLDYVLDKVDQILLMSVNPGFGGQKFIPMTLEKLRQARKMIDASGLDIRLEVDGGVGPANIREIAEAGADMFVAGSAIFGKPDYKAVIDEMRVELAKVGSHTA

SEQ ID NO: 28689 - protein, 487 aa, Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 28690 - protein, 370 aa, Acinetobacter sp. ADP1
MAKLFENIQFDTLRLSNKIIIAPMCQYSATDQGEITYWHEQQWANYALSGAGLCIIEASAVQAAGRISYADVGLWNDNQRDQIKMLLNKIKHLSPVPFGIQLAHAGRKASTDKPWLGKGQIPPDHVHGWQTVAPSSIAFGEHDLAPHALTRDEIQQIQADFAASAVRAVEAGFKLIEIHAAHGYLLHQFLSPLSNLRDDEYGGSFENRIRMTLEVLQAVKAVVPEGFPVGVRISATDWMPTQSWDIESSVGLSQALEQLGAAYIHVSSGGLHVMQDIKVGANYQVPFAAQIKQNVSIPVIAVGLITEPDQAEAILQNDEADAIALARAMQYDPRWPWHAAAALGAEIEISPQYLRCQPHGLKQLFKAFSH

SEQ ID NO: 28691 - protein, 294 aa, Acinetobacter sp. ADP1
MFDSIAQDIPYHTLIDGSPVRLDLKRLDLIHPHISGNKFYKLKYNLIEAKKRGCDRILTFGGAFSNHIAASAYAAHHFDFKSIGIIRGQELAYRSLNATLKTAQHYGMQLEFMSREQYRQKDQSEFLHTLQSQYPSAFIIPEGGTNALAIQGSKEILSDTDRLNYDVICCAVGTGGTLAGLIEASHHGQYVIGFSALKGDFLHNDVQRHTNKTNWHILDDYCFGGYAKTSSELFDFIAGFEQKYQIPLEQVYTAKMLYGLLDLIQKNDFDQGTRILALHTGGLQGRRHDIGVTE

SEQ ID NO: 28692 - protein, 351 aa, Acinetobacter sp. ADP1
MNKNTPILVTGATGYVAGWIIERLLNQGHTVHATVRDPSNTEKIKHLTDIAKKSEGSIHFFKADLLSEGVFDEAMQGCEIVIHTASPFVITNYKDAVKDIIEPAVNGTANVLESVNRTESVKRVVVTSSIAATYGDAIEIKATSNNEFDESCWNNTSNATHQPYSYSKVAAERKAWEMADQQNRWSLVCINPALVMGPSLTASSQSGSIELLQQFANGVTLFGVPSMWNGIVDVRDVADAHVAAALLPDASGRYIISGGSLSLLDMGKALTQRFGYRFPFPHFTVPKTAFSFVAPFLGYSREFVKLNMGYPIYFNAKRSQEELNIQYRDIRESVCDHFQQLLDDGVIKKWL

SEQ ID NO: 28693 - protein, 442 aa, Acinetobacter sp. ADP1
MLYSIFIAHQESWMVDQFDLEHIWHPYTSMINPLPTFKVKRASGVMIELDDGRQLIDGMSSWWCAIHGYNHPALNQAVKDQLEQMSHIMFGGFTHDPAIELAKILLKITPPSLDKIFYADSGSVAVEVALKMAVQYWTAQGQHQKTNFITTRSGYHGDTWNAMSVCDPVTGMHQIFGASLPNRVFVSAPKSRFDGEWDSSEMDEVEQLIQQHTQLAAFIIEPIVQGAGGMRFYHPEYLRQLKQLCEKYQLLLIFDEIATGFGRTGKLFAWEHAQVEPDIMCIGKGLTGGYMTLSATLTSQHVAEVISRGEAGVFMHGPTFMGNPLACAVALKSTQLLVEQDWQSNIRRIENRLQPLYQLAALAHVADIRTLGAIGVVELKHNVDMKTLQQQFVELGIWIRPFGKLVYVMPPYIISNDELDELIQKMMNVVRQLSCEAQHGIA

SEQ ID NO: 28694 - protein, 448 aa, Acinetobacter sp. ADP1
MQRDILSEINQNNMSRYQWFVIVVCVCLNIIDGFDVMVMAFTAPSVSAEWSLSGAQIGLLLSAGLFGMAAGSIFLAPLADKIGRRLLILICLAIAGISMLACGLVHSHSMLAALRFVTGIGVGGILASSNVLASEYANLRWRSLAVSLMSTGYGIGATLGGILSLLLIEHLGWRSIFLAGGVTTVVMLLVSLWLLPESLDYLLAKKPKQALEKINLTVQRIGLVRLNALPQHEKNTQQHSSDIAKLFQGKQGFQTLCLWFAFFLVMFGFYFVMSWTPKILIAMGMSPSQGVTTGILISIGGVFGAAIIGLLASRIKIFHALSLFLGLTAVCVWLFVAVSSQVSIALMVGLLLGTLINGCVAGLYSISPTIYDADIRSRGVGYAIGFGRIGAILSPTVAGIFLDKGLAPSTLYAYYGIVFILAIFLILSLSKAFYRQKEGLGSSIKTVA

SEQ ID NO: 28695 - protein, 403 aa, Acinetobacter sp. ADP1
MERIVVVGAGQAAGWAVSTLRQEGFQGEIHVVSNEHQIFYERPPLSKQVLSKEASYDSLNLFSPEQIDAFSVQWHKPDLATQIDRDHKQVILESGKILPYDKLLIATGSRARVPVNTWKDISNVVTLRDVQDCERLANLLETAKSIAIIGGGWIGLEIAATARKQGKQVHVFEYAERLCGRSVSPEVSEFLKEIHEQQGTKIHLNSKNLHLIESSDQTVQVLNHPETAQTFDCVVVGAGAEIAKELGVSAGLAVKDGIVVNCYGQTSDVDIYAAGDVAIHPVLGYCIQSWANAQNQAIAAAKSMLGVATEYSDIPWLWSDQYQFNIQILGTYQAQSNPKLIIRQSSPAQLSYLYLDEHNRLMNLIAVNDAKLVKLAKRWIQNSTVLDPKLLADPEFNVMKLKP

SEQ ID NO: 28696 - protein, 488 aa, Acinetobacter sp. ADP1
MVKELYIAGEWRLGRGKVIQSTFPADNSVNAEISTASFEDIEEAIVKADQAWRAPEWRNRLPHERAKILYKVADIIEARVDALAALQTRDNGKPLAETRGLVFSAAATARYVAAACETMNDELTSQRAPDFMTFSVHEPVGVVAAITPWNSPIASEVQKLAPALAGGNAVILKPAEATSLIALELAKIFEEAGLPKGLLSVLVGKGSVVGDAIVKHPLVRKISFTGGTTTGRHLAHIAADKLITTSLELGGKSPTIVLPDADIELAAKGIAYGIFSSAGQACIAGSRLFIHSSIYDQFLARLVEITKSLRVGHPEQKDVHMGSLINAAHLASVDRYVQLAKQEGGEILTGGQAMTEGEFAKGSFYLPTIITGLKNQAQVCQEEIFGPVLVVMKYEHEDDLIEQANDSCFGLAAGIWTESYRKAWRIARVLEVGTVWINTYKKFSISAPFGGFKDSGIGREKGRQGILSYMQQKSIYMGLNEQPNPWAD

SEQ ID NO: 28697 - protein, 490 aa, Acinetobacter sp. ADP1
MSDVKLHRLYIHGQYTDATSGKTFDSINPATGEVIATIQQASQTDIEAAVKSAAEGQKVWAAKTAVERSRILRRAVDILRERNDELAQLETLDTGKAFSETSTVDIVTGADVLEYYAGLATAIQGEQVPLRESSFFYTRREPLGVVAGIGAWNYPIQIALWKSAPALAAGNAMIFKPSEVTPLTAFKLAEIYSEAGLPAGVFNVVQGAGREIGQWLTEHAVIEKISFTGGVETGKKVMASAAGSTLKEVTMELGGKSPLIICEDANLDRAADIAVMANFFSSGQVCTNGTRVFIPQRLKAAFEQAVVERVKRIRMGDPQHTDTNFGPLVSFPHMEKVLSYIESGKQQGAKVLIGGERATTGLLAQGAYVQPTVFTDCHDDMKIVQEEIFGPVMSILTYDTIEEAIERANNTNFGLAAGVVTQNISQAHQIIHQLEAGICWINTWGESPAEMPVGGYKESGVGRENGISTLNHYTRTKSIQVELGDYQSVF

SEQ ID NO: 28698 - protein, 468 aa, Acinetobacter sp. ADP1
MSMSDTQFDLVVIGAGPGGYVAAIRAAQLGLKTAIVEATHLGGICLNWGCIPTKALLAGAELAHQFKHASQFGFELGDINFDLSKLVQHSRQVSAQLVQGIEHLLRKNQVSVFYAKARFIAKERLELVDAQQQKQMIRAPHIIVATGAHAASLPQIPVDGDYVWSYKEALQPKQLPKSLLVIGSGAIGSEFASLYQDLGSQVTLLDLARQILPTEDHEVAQYVRKQFEQKGMRILTESTVQHLEVCEGKVHCEIHDPSGVQSLSFDHVLSAVGVKPNTQNLGLEQLGVALTNGFIQTDEWCRTNVVGIYAIGDVAGAPCLAHKASHEAILCVEKIAGIADVHPLNRLQIPGCIFTHPQVASIGLTEQQAKAEGKQIHIGKFPMSANGKAIALGQTAGFVKTIVDVESGELLGAHMVGHEVTEQIQGYAIAQALEATDEHLAQVIFPHPTLSEAMHESILASMQRAIHI

SEQ ID NO: 28699 - protein, 111 aa, Acinetobacter sp. ADP1
MQELQIIDLKVGEGKEAVKGALITTHYTGWLEDGTKFDASIDRGNYFECVIGTGRVIKGWDQGIIGMKVGGKRKLIVPAHLAYGERKMGNIIPANSNLIFEIELFDVKTRD

SEQ ID NO: 28700 - protein, 421 aa, Acinetobacter sp. ADP1
MQTPVPEYLAHVIDQCENNQTGKLADYIPELAHANPDQVALAMSTVDGQIYAVGDEDIEFTIQSMSKPFTYAYVLQQLGLDEVLDKVGVEPSGEAFNEISLGHDKRPKNPMINSGAITTHSLIPIKDQLESAEIIRRFMSELAGRELCFDEAVYASEIKTAYRNLSIGYMLRTVGILETDPVDIVNGYIRQCSILVTVKDLVKMGSILANGGIDATTGKRLLNRDVVRQVLSVMMSCGMYDAAGDWLTTVGIPAKSGVAGGILGVLPGQVSIAAFSPRLDEHGNSVRGIEMMERLSRDMGLHLMEGTPSAQTIVQSHYRTGKNASTSIYVLRGVLKFTEAEMLLRIFQGEAVDESTIVIDLTQISLIHDVGKRMFLEGVDRLIDDGHSVLLVDPEQRLEQARTHKDRVLHVYQNMDELLEK

SEQ ID NO: 28701 - protein, 393 aa, Acinetobacter sp. ADP1
MHPIVIIGSGMAGYTLAREFRKLNPEHELVMICADDAVNYAKPTLSNALSGNKAPEQIPLGDAEKMSTQLKLQILSETWVKAINPETHELKLEKNGQETIQPYSKLVLAVGANPTRLAIAGDGSDDIHVVNSLIDYRAFRENLAKRQDKRVVILGAGLIGCEFANDLQHTGHQVTVIDLSPRPLGRLLPAHIADAFQKNLEESGIHFVLSTTVEKVSKINDGQDYAVTLANGQTLVADIVLSAIGLQPNIDLAKHAGVHTSRGILTNSLLETNLEDIYAIGDCAEVNGTLLPYVMPIMQQARALAKTLSGETTHVHYPAMPVAVKTPAAPLTVLPVPVDVDVNWETEEFEDGMLAKAIDNTDTLRGFVLLGATAGKQRLTLTKLVPDLIPAQL

SEQ ID NO: 28702 - protein, 219 aa, Acinetobacter sp. ADP1
MRIILLGPPGAGKGTQAQLICKRYDIPQISTGDMLRAAIREGTELGLKAKSVMESGGLVSDELIIGLVKERIAQPDCENGCIFDGFPRTIPQAEALENAGITIDHVIEIAVPDEEIVKRLSGRRQHPASGRVYHIEYNPPKVEGKDDVTGEELVQRPDDLEETIRKRLGSYHSETEQLVGFYQGRAASGENAPTYNKLDGLRTIDVVQKDLFAILDETK

SEQ ID NO: 28703 - protein, 414 aa, Acinetobacter sp. ADP1
MSQIAEPITIRNVTFKNRIIKGAMSEALANRAGQPNDLHFGLYQAWAQGGLGCAITGNVMVDLRAKNEPGVVAIESERDLERLKKWADIGKKYGMVQLIQLSHPGRQCPKGLNQETVAPSAVPFSPMLATMFATPRELHHEEILDIIQRFADAARVCEKAGFEGVQLHGAHGYLISQFLSPLTNKRQDQWGGSIENRMRFLLEIYHAVRAATSENFIISVKLNSADFQRGGITEEDVIAVFKAIDQAGIDLIEVSGGTYEAPAMAGVKAEKRKASTIAREAYFLEFAEKIRDSVQCKLMVTGGFRSVEGMNAALQSGACDFIGIARPFAVETDLTHRLIAGQDVKYAVKPIKTGVPFVDKMAVMEIIWYAAQFKAIGKGKKPNPKLSPLLVFLNYAKGNVKALIQGRINSRKSA

SEQ ID NO: 28704 - protein, 463 aa, Acinetobacter sp. ADP1
MLDSAAPLKRAMSTRHLVMLSLGGAIGTGLFLGSGEVITQTGPIGAVIAYMLGGLIAYMVMLCLGELAVHMPVSGSFGAYAKKYIGPGTGYMISWVYWLTWTATLGTEFTAAALLMQEWFPHTSMWIWTIIFALTIFGLNLSSTHIFAESEFWLSLVKVLTVISFIILGLLAIFGIIHFEGHASAPLFSNLTSHGWFPQGLMPIFATMLIVNFAFSGTELIGVAAGETKDPSINVPKAINAAIWRLLIFFVGTIVVISALLPYDQTGLGGHNVSNSPFVTVFQYIGIPYADHIIRFVIITALLSAANSGLYAASRMMWSLSNQRQLPSVFSKLTASGTPIIALVVTMFGAIPGLLSEQFAPETIFKNLLGVAAFTMVIVWMSICLSQFNFRRHWYKQGYHAKDLKFAAPLFPILPILGFLFCLITGLSMAKDPEMLPGFIGCLIFVACCYLSHYIFYREKSKL

SEQ ID NO: 28705 - protein, 460 aa, Acinetobacter sp. ADP1
MSQHSTLQRGLNTRHIRFLALGSAIGTGLFYGSATAIKMAGPSVLLAYMVAGIAIYIVMRALGEMAVHNPVSGSFSHYASQYIGLLAGFTTGWTYVFEMIIVALADVTAFGIYMGFWYPDVPRWIWILSLIMFLGAINLIHVKVFGELEFWLSMVKVTAIVAMILGGLGLMFYGFHTDHASFTPGIQNLWIHDGFMPNGIAGLVACLSVVVFAFGGIEIIGITAGESQDPKTTLPKAINAVPVRILLFYVLTIFVLMSIFPWNQIGSQGSPFVQIFENLGIGSAATVLNIVVITAAISAINSDVFGAGRMLYGMSNRGQAPQIFQKLSKNGVPWMTIVVMAGVLLVGVVLNYLIPENVFIIIASIATFATVWVWLMILVSQVAMRRKLSKAEIKALDFPVVGWPYAPAFAIVFMLFILAMMGYFPDSRPAIYVGAIWLILLWIAYMVWVKPNTIKTDMEL

SEQ ID NO: 28706 - protein, 432 aa, Acinetobacter sp. ADP1
MSLSPKQVQLFEQASKHIPGGVNSPVRAFNGVGGTPVFIKKAQGAYLWDEDDKRYVDYVGSWGPMILGHAHPDIIQAVQTAAVDGLSFGAPTVHETTLADIICDIMPSIEMVRMTNSGTEATMTAIRLARGYTGRDKIVKFEGCYHGHSDSLLVKAGSGLLTLGEGEPTSKGVPVDFAKHTLTLPYNNIEALKECFAKFGHEIAGVIVEPVAGNMNLVTPIDGFLQAIRDVCDEYGSVFIIDEVMTGFRVALGGAQSVYQVKPDLTTLGKIIGAGLPVGAFGGKREIMECIAPLGGVYQAGTLSGNPLAMRAGITMFKHLREPDFYSKLEAKLQKLLTGLQAAANEAGIAFKTQQVGGMFGLYFTDQEDITSFDSMLACDTDAFKKFFHGMLERGVNLAPSAFEAGFISSAHSDEDIELTIQAAKETFAEMK

SEQ ID NO: 28707 - protein, 456 aa, Acinetobacter sp. ADP1
MSVNSVNPATNSTNEYYLTRQSQMESNVRSYPRKLPLAIARAQGCWVTDVEGTQYLDCLAGAGTLALGHNHPAVIQSIQDTLASGLPLHTLDLTTPLKDAFTEALLSFLPGGKEEYCLQFCGPSGADATEAAIKLAKTYTGRSSVISFSGGYHGMTHGSLAMTGNLSAKNSVNNLMPGVQFMPYPHEYRCPLGLGGEAGVDALTYYFENFIEDVESGVTKPAAVILEAIQGEGGVVTAPVKWLQKIREVTERHNIVLILDEVQAGFGRSGKMFAFEHADIEPDVVVMSKAVGGGLPLAVLGIKRKFDAWQPAGHTGTFRGNQLAMGTGLVVLDTIKNENLAQNAQERGEFLQAELKKLANEFPCIGNVRGRGLMIGVEIVDERQSADRIGSLPADAQLAAAIQTACFNNKLLLEKGGRNGSVIRLLCPLIITQDECVQVIERFKKSVAEALKAVRG

SEQ ID NO: 28708 - protein, 404 aa, Acinetobacter sp. ADP1
MNHITLAPVQSDQPTHLMATYGRQAISFVRGRGSYLYTEDGTEYLDALTGIAVCGLGHAHSVIAEAIAEQAATLVHTSNIFEIPWQTAAAQKLAEVSGMQEIFFSNSGAESNEGAIKIARKYGSQQGIQHPKIIVAEKSFHGRTLATLSATGNAKVQEGFFPLVEGFIRVPFGDIEAIQEAALHHPDIVAILVEPIQGEGGINTAPQGFSYLEEIRALCNQHNWLMMLDEIQTGNGRTGKFFAYQHTNITPDVLTTAKGLGNGFPVGAVMTQGKAVGLLGPGSHGSTYGGTVLGSRVVYTVIDTIQKENVVENADKMGRYIVEQLRQAFNELDIQVRGFGMMIGIELPKPCAELVNITRDEYKLIVNVTAGNVVRLLPPLNMSKDQADDLINRLVPAIQNFLAA

SEQ ID NO: 28709 - protein, 439 aa, Acinetobacter sp. ADP1
MTTPNPSASLLERLFKLSENKTNFRTEVLAGVTTFLTMCYIIIVNPLILSETGMDHGAVFVATCLAAAIGCLVMGLIANYPIALAPGMGLNAYFTYSVCLGMGVPWQTALAAVFLSGIVFLAISFFKIREAIVNAIPMSLKFAIGGGIGLFLALIALKNAGIIVANQATLVGLGDLKSPTVLLAFLGFLIIVVLHQFKVRGAIIISILAITAISTLMGLNQFKGVVGAIPSLAPTFLQMDFEGLFTATMVGVIFVFFLVDLFDSTGTLVGVSHRAGLLQDGKLPRLKKALFADSTAIVAGAALGTSSTTPYIESASGVAAGGRTGLTAVVVAALFIACLFLSPLAQSVPGFATAPALLFVGVLMIHGITNIDWDDITEAVPAFLTIVFMPFTYSIADGIAMGFISYALIKLLTGKAKSVPYMVWIIAVLWAFKFAAFGG

SEQ ID NO: 28710 - protein, 403 aa, Acinetobacter sp. ADP1
MSIHHLNRQDFNQFMVPVFAPAQFIPVRGQGSRLWDQDDKEYIDFAGGIAVNALGHAHPIAVNALIEQGQKLWHIGNGYTNEPVLALAKQLVDHTFADKVFFCNSGAEANEAALKLARKIGLSKNKSKIVAFNNAFHGRTLFTVTAGGQPKYSQDFAPLPAGIEHVAFNDLNAAAAVIDDQTCAVIVEPIQGEGGVLPADLEFLKGLRRLCDETGAVLIFDEVQTGVGRTGALYAYMNTGVVPDILTTAKALGGGFPIGAMITTDQYANVFVVGDHGTTYGGNPLACAVAGAVFNFINTADVLDGVKQRSQQFIDELEQLNHTYAVFQEIRGQGLLLGCVLRPEYAGKAKDIVTLAGAEGLLALIAGPNVVRFTPSLVISEQEISEGLQRFGRALSQFVAVHQ

SEQ ID NO: 28711 - protein, 509 aa, Acinetobacter sp. ADP1
MEFDWEYFFSLFGFAEFWKACVTVIVISSLSWFIGMVLGFVLACAKVSAPRWIKIPVELYIWFFRSIPLMVLLVFVYNLPQMFPITQPLLGVPFIAGLISMTVTEAAYMAEIHRGGLLSVTKGQNEAGHALSFGFFGIQRLIVIPQAFRIALPTLINEFITVIKLSSILSVISLPELLLTGQRLYADNFLVMETLLAVAVYYVTIVTLFTWLFKWLENFLNLQRRSPQTLKESECMALRQSLNAPASNLNTKELIAGSPVALDLRDIYKSWGQHQVLKGINLKVKNGEVLSIIGPSGSGKTTLIRTINALESVDDGEIVLYGESYIKGGAVIDKQKMRAGVRRIGMVFQGFNLFPHRTVLDNVMLAPMYHKLFDHTVVKEQALYLLDRVGLLAHIDKYPHQLSGGQQQRVAIARALALKPDIMLFDEPTSALDPELVGEVLKVIQSLASEGMTMLIVTHEMDFALSISDRVIMMEHGVVQCDASPDDIRCSSSASFSRVHEFMQVKSEG

SEQ ID NO: 28712 - protein, 319 aa, Acinetobacter sp. ADP1
MAKNLHQPLGGNEMPRFGGIASMMRLPVIETPEELAKLDAAFVGIPLDIGTSLRSGTRFGPRQIRAESVMIRPYNMATGAAPFDCINVADIGDIAINTFNLLHAVEIIEQEYDRILSYGIIPLTLGGDHTLTLPILRALKKKHGKVGLVHIDAHADVNDHMFGEKIAHGTTFRRAVEEDLLDCDRVVQIGLRAQGYSADDFNWSRRQGFRVVQAEECWHQSLAPLMAEVREKVGGGPVYLSFDIDGIDPAWAPGTGTPEIGGLTTIQALEIIRGCEGLDIIGGDLVEVSPPYDTTGNTSLLGANLLFEMLCILPNVMKK

SEQ ID NO: 28713 - protein, 321 aa, Acinetobacter sp. ADP1
MKKKVVVFSQIDPRILEQLKQQYQVVVLDPKKGDINEQICQEVVDADGMIGAGRLLNENNLAPAQHLKIVSTVSVGYDNYDVQYLNQKKIWLAHTPHVLTETTADLAFTLLVSAARKVPQLDAWTKAGEWKRTVGAAQFGQDIFGKTLGIIGLGNIGAAIARRGLYGFNMNILYHNRHEKLVLAQPLNAEYCSMQDLLQRSDFIVVAVDLNTESQALIGTQEFEQMQSHAVFVNISRGSVVDESALIEALKQKQIFAAGLDVYQKEPLQASELFDLDNVVTLPHVGSATAETRLKMSQLAYKNLVDALEGKTPRYLVNPDF

SEQ ID NO: 28714 - protein, 458 aa, Acinetobacter sp. ADP1
MTDQHAHELKKGLSNRHVQLIALGGAIGTGLFLGISHTIQLAGPAVLLGYAIAGMIAFLIMRQLGEMVVEEPVSGSFSYFAHKYWSSMAGFMSGWNYWVLYVLVSMAELSAIGIFVQFWWPQIPTWLTALVFFVLINAINLINVRFFGELEFWFSCIKIIAIISMIGFGAYLLLSGTAGAHAGIANLWQHGGFMPNGWTGLIIAMAFIMFAFGGLELVGIAAAETKNPTQTIPKATNQIVYRILIFYIGAIAILLSLYPWNQVAQGGSPFVMIFQSLNNTGVAHVLNMVVLIAAISVYNSCVYSNSRMLLGLAEQGNAPKLLKRVNARGIPVYAVYASVMVTALCVLLNYVMPEKAFNLLMMLVVAALVINWLMISITHLKFRQYMLEAGRKPIFRSLGAPFTNYITIAFVFFILLIMSYTSEMRIAVFLVPVWLGILYIFYRFKAPASKMTESVLDQ

SEQ ID NO: 28715 - protein, 170 aa, Acinetobacter sp. ADP1
MTTTVPFVTCDLLDDHTDKDIQVLTPSLDGRFFKSYGARKIFSGQIVTVKCFEDNSRVKELLATDGTGKVLVVDGGASMRCALMGDMIAESAVKYHWDGVVIYGCIRDVDALAELDLGIHALAAIPQKSNRQGIGEVGVNLYFGGVTFQAGCYIYADNNGIIVSKQKLID

SEQ ID NO: 28716 - protein, 171 aa, Acinetobacter sp. ADP1
MNHFELFDLPVALDIDLVALKANFLKLQQLHHPDKALDKDQALIMSSDINQAYKILSQVDSRAAYLLSLKKQDHHLDQSIHDFEFLQSALEIREQLDEADSQEQLITLKNEVKQWVDGLIREFKIDYSDEDWSEARDTVRKLRFFQRVLNDIDKAEDQLLDEDSFDLDDDF

SEQ ID NO: 28717 - protein, 326 aa, Acinetobacter sp. ADP1
MLQSLDPQLASFFAMLENQGAPAFDIGTLNDPNINEMRNWYLNFGPHVAGQFIELQDVEDLWIQVDDGSLRLRLYKTQRQHSESCETLIYFHGGGWCIGSIETHDLLCRHLVNDLDVNVISVDYRLAPEYPYPQAAHDAIHATQWIFEHASALGIHPDHLYVAGDSAGGNLAAITALTFKEQTYRTSLAGQILIYPCIDLTVIHDNKYPSFEKQKLTPPLSAEQMSKMIQIYLKNEDFAYQWLASPLLAQSHQHLPSTLIITAEFDPLHDQGCVYFEKLKSSLVNTEYHEIKGVVHGFFEMYGVLNKTKETINIIRAWLKNNTKSK

SEQ ID NO: 28718 - protein, 371 aa, Acinetobacter sp. ADP1
MTKFTEITAAVTECKGADFELKQLKIREPQNDEVLVKIVATGMCHTDLIVRDQYYPVPLPAVLGHEGSGIIEAIGPNVKDLAVGDHVVLSYGFCGSCEQCSSGQPAYCQDFFGRNFSGGDPDGHSAVCSHDHHKIHDHFFAQSSFATYAISRENNAVKVSKDVPLELLGPLGCGIQTGAGAAINALKVAPASSFVTWGAGAVGLSALLAAKVCGATTIIAVDIVESRLALAKELGATHVINSKTQDPVEAIKEITGGGVKFALESTGRPEILKQGIDALGILGSIAVVGAPPLGTTAAFDVNDLLLGGKSIIGVVEGSGVPKKFIPALVSLYQQGKFPFDKLVKFYDFKDINQAAIDSHKGITLKPILKIG

SEQ ID NO: 28719 - protein, 506 aa, Acinetobacter sp. ADP1
MVLNNRKNEIIEKARTGRYEVYMTLLDASIWNKKLFNGGWFESGQPYGVVEVATGEQLGQTGSASPTDVAQAAKEAQTAQRQWWALDYLERQAVFEKAVQIATEHQDELVNWLIRESGSLALKAQFEVKVSIQMLKNCIAFPQLDQGNILPSRNGKLSLAKRLPLGVVGVISPFNFPLYLALRAVGPALAFGNAVVLKPDERTAVCSGYAIARIFELAGLPKGLLHVLPGGADTGEALTLDPHIASIQFTGSTQVGRIIGANAGKTLKKVSLELGGKNSLIILDDADLDLAAENIAWGAFLHSGQICMTSGKILIHEKIYDALKARVIEKVKRFVVGNPLEQNVTIGPLINEKQSKRVEALVQAAVEHGATLEIGGKANGPFFEPSVLSQVQADNPIFSEEIFGPVAVLIPFASDEQAIELANMGDYGLSAGIISSNVGRAMQLGAQLNVGLLHINDQTVNDETINPFGGFGASGNATRIGGPANPDEFTQWQWMTIQAEAPHYPF

SEQ ID NO: 28720 - protein, 447 aa, Acinetobacter sp. ADP1
MVTRSTIMDTNSFRAEHAAALDAETRKLTDKRSQVLGESYRLFYRNPVHLVKGQGQYLWDAAGHKYLDVYNNVASIGHCHPAVIEAVNEQMKMLNTHTRYLHENILNYTEELLKTTPSEIDRAMYMCTGSEANDLAIRIAREYSGGTGIIVSQEAYHGTSELTSGCSPALGSGQALAATTRLVPAPDAYRIAADDLGDWFAAQIQQQIDDMNANGIKFAGFLADSIFSSDGVMPNPVGFLKKAVDVIHANGGIFIADEVQPGFARTGDSFWGFGRHGVVPDIITTGKPMGNGIPVSGLLAKSDVLAAFSDNIPYFNTFGGNPVSMAAAQAVLKVIHDEDLQAHSKYVGAKLQAELSKLMDIHECVGDVRGAGLFIGFELVKDRDSKSPDKALALNLIEELRNTHRVLTSVAGPYGNVLKLRPPLAFQEHDIDWLVSALDQSIRKLKD

SEQ ID NO: 28721 - protein, 337 aa, Acinetobacter sp. ADP1
MKAVGYKEQGEITRPDALVDIEIDQPVARGKDILVEVKAISVNPVDTKVRKRAAAEAGQWKILGWDAAGVVVSVGDEVTEFKVGDEVWYAGDLTRPGSNAQFQLVDARIVGHKPKRLSFAEAAAMPLTTITAWEMLFDRLKIEDPVPGGDRSILIIGGAGGVGSITIQLLKAKSDLKVIATASRAETQAWVKQLGADYVIDHSKPLKAQMDELGLKAPSYVFSTNYTDQYMEQIAALTAPQGRLGLIDDPAELSISPLKTKSISLHWEFMYTRSMYQTEDIAQQRELLNAVAKLVDDGVIQTTLTEVYGKINAENLKEVHSLIEGGKAKGKIVLEGF

SEQ ID NO: 28722 - protein, 487 aa, Acinetobacter sp. ADP1
MNARFQELLPELALYAGSKKLDVNQTFQDINPCDEILIAHIPKASVEDLNAIVAVAKQGLNSTAWHEVTPLQRENLIRCFADAIEKDSTRLAQLESIDAGKPISITQTVDIPAVVAWLKYYAGWASKIMGSAGELSNVAGSFHAYSRRQPVGVVAAITPWNFPSVLSMWKIAPALAAGCCIVLKPASDTPLTALRLAEIAREIGFPEGVFNVVTGNSDIGHALATHPDIAKVAFTGSTQTGRSILQASIADFKRVTLELGGKSPVILHKDADLDKAIPTIAMGCFFNTGQVCYAGTRLYVHHDIYDEVLARLAAFTKTLKIGSSDDPNTQLGPVVNARQQHSIQEFLNKAEQQGIESLDLSAMTLPEHGFYVRPAILKNVPAHAAIMKEEVFGPVLATAAYQSLDEAIQLSNDSIYGLAAHLWTQDLSIAHQVSAALDAGTVFVNCALLADPNFPFGGFKQSGIGRENGQEVLDAYLESKSVIMALS

SEQ ID NO: 28723 - protein, 371 aa, Acinetobacter sp. ADP1
MKITAAVARQAHQDFSIEQVELDEPKDHEVLVRIEGVGLCHTDLVARDRLIPIPLPAVLGHEGAGVVEKIGKAVTKVAVGDHVLMSFNSCGECPRCKEHLPPYCTQFPQLNYVGARPDGSSTLKQNDQAVSGYFFGQSSFASHALANERNIVKVAQDLPIEILGPLGCGLQTGAGGVMRSLACPQGSTIAIFGGGPVGLAAVMGAVIQQCATIILVEPMASRRELALELGAHHVIDPAQGNITEHIRNILPQGVDFAFESSGRGEVVEAALASLGSHGLLGLVGVPPSVETTLNVNLVSLITFGHRIHGIIEGDSDLDTFLPELIQHYQAGKFPFDKLIKKYALSEINQAIQDQAQGRCIKAVLIPEHAHH

SEQ ID NO: 28724 - protein, 413 aa, Acinetobacter sp. ADP1
MSNYDVIIVGTGHAGGQAAVALRQQGFTGSILMIGEELHLPYERPPLSKEYFSGEKTFERILLRPEQFWKDKNIDLKLGQRVIQIDAQSHRILTQQNHEYHYGKLIWATGGKPRRLSCEGADLDGIHYIRNREDVDRINQELDRVQKCVVIGGGYIGLEAASALRKINRDVTLVEAQSRVLARVAGPIISDFYQQYHQQKGIEFYLGQGVDHLEGDQGRVHTVILANGTRIATDMVIVGIGLNPEINALIEAGAISSNGIETDRRCRTSLPDIFAIGDCANHENIFADGQRIRLESVQNANDQAMIVAKEILDKGEDYAAIPWFWSNQYDLKLQTIGLSIGYDQEVLRSEPDSGSFTVIYLRQGTIIALDCVNRPADFIQGKAIIQQSISIPTEQLSDHTLPFKELIQRYKNS

SEQ ID NO: 28725 - protein, 297 aa, Acinetobacter sp. ADP1
MNIAFIGLGNMGGKMVQNLLKTGATVYGFDLSQTAIAHFVEAGGIASDSPHDAAKNADIVITMLPAAKHVKEIYLAEDGVFTVLKQGSICIDSSTIDPQSIKDIAKIGAEKGIKVCDAPVSGGTIGAQAGTLTFMVGTDADLFEQVKSVLSSMGKNIVYCGEVGSGQIAKICNNLILGISMTAVAEGMALGAKLGIDPQILAGVINSSSGRCWSSEVCNPWPDVSANAPAGRGYSDGFATQLMLKDLGLAIEAAGQVKQPVLLAGLVQQQYQQLCMQGNAQLDFSSIIQQYLPQNSQ

SEQ ID NO: 28726 - protein, 1262 aa, Acinetobacter sp. ADP1
MSLEFGMNMMDNDPQMDTAKPHFGYISEFKEKTELEQHINDAWRRPEPETVETLLQAASISDELNHKIYELAFELANGLRERKTSSGKAGIVQGLLQEFSLSSQEGIALMCLAEALLRIPDAATRDLLIRDKINQGNWKDHVGQSSLMFVNAAAWGLMLTGKLMETPKQGSLSGLLTSILARSGRGVIRKAVDVAMRMMGEQFVTGETIEEALDNAKSHEHKGFRYSYDMLGEAALTTHDAERYFNDYTQAIHAIGQASNGKGVYDGPGISIKLSALHPRYQRSQIARVHDELYGKVFNLALLSKKYDIGLNIDAEEADRLEISLELLERLCFEPELADWKGIGFVIQAYQKRCFYVVDYVVDLAKRSKKRLMIRLVKGAYWDSEIKKAQIDGMHDYPVFTRKVHTDLSYIACAKKLLAAPEQIYPQFATHNAQSLATIYELADPGKYYAGQYEFQCLHGMGEPLYEQVVGSRSDKKLGIPCRIYAPVGNHETLLAYLVRRLLENGANTSFVNRIADQNLKIEDLIQSPFDEIAINAQREGQAGLKHPAIPLPHNLYGSLRQNSKGFDLANDATLTALNETAQQLEHKVWESRPLLAQTVDQIDVSPQALLNPAVHLDIVGYVQEATLEQVDVALESATQAQQAWANTEKNHRAATLKKAANLMESRMQELMVLLCREAGKTYANAISEVREAVDFLRYYATQIESLKPTAQIEPLGTVLCISPWNFPLAIFTGQIAAALGAGNCVIAKPAEQTPLIAAQAVHILHEAGIPKSVLQLLPGRGETVGAKLSSDQRIQGVMFTGSTEVAKILQKTVAKRLSPSGHPIPLIAETGGQNAMIVDSSALTEQVVIDVLNSAFDSAGQRCSALRILCVQEDNSKTLVTMLKGAMQQLIMGNPFLLKTDIGPVIDLEAKQTIDQHIQKMRSKGYPVYQLIFNHEAASQAQLSQGTFVTPTLIELPNLDDLEREVFGPVLHVITYKHGEIKQLLQHINAKGYGLTMGLHTRIDETINTVVQHAEVGNLYINRNIVGAVVGVQPFGGEGLSGTGPKAGGPLYLYRLMASCTEKAIQTPFGIPAENVAVPLTQLSLFREFSAWIKKQYPAHQLPNVVPLNVGHAFDLQGPTGETNRYMMLPRKRILAIASNELELCHQMLAIFAVNSQVALLESNPSLQKFGQDLPTVVRQAIIEIRGVEHGDFDAVLHHGSTEELQVLQTQIANRQGPIVGITHLQNSEQVIPLERLVIEHAISVNTAAAGGNASLMTMSE

SEQ ID NO: 28727 - protein, 408 aa, Acinetobacter sp. ADP1
MNQMVDKVTKSGRVHFNWEDPFLLEQQLSEEERMIRDSAFAYCQDKLMQRVLEQFRHEKTDPNIFREMGELGLLGPTIPEQYGGAGLNYVSYGLIAREIERVDSGYRSMASVQSSLVMVPINEFGTEEQKQKYLPKLATGEYIGCFGLTEPDHGSDPGSMITRAKKVEGGYRLTGAKMWITNSPIADVFVVWAKEVSSEGHVGEIRGFILEKGWDGLSAPAIHGKVGLRASITGEIVMDNVFVPEENAFPEVRGLKGPFTCLNSARYGIAWGAMGAAEFCWHTARQYTLDRKQFGRPLAANQLIQKKLADMQTEISLGLQVALRFGRMKDEGIAAVEGTSLIKRNNCGKALEIARLARDMMGGNGISDEFGVARHLVNLEVVNTYEGTHDVHALILGRAQTGIAAFSN

SEQ ID NO: 28728 - protein, 332 aa, Acinetobacter sp. ADP1
MSTDQEFKAPANLGIAVYSNNAEAIGNTPLVRINRIIKTGATVLGKVESRNPAFSVKCRIGAALIADAEKRGVLKSGMHIVEPTSGNTGIALAFVAAAKGYPITLTMPASMSLERRKVLKAFGANLVLTEPAKGMKGAVEEAVRLATEQPDIYFLPQQFENPANPKIHEQTTGPEIWDATNGQVDILVAGVGTGGTISGISHYFEKVQNKPIYSVAVEPAESPIITQTKRGEEITPAPHKIQGIGANFIPKNLDLDIVDEVMPITSDEALEWARKCATQEGILGGISCGAALAAAAKIAERPENEGKTIVVILPDSGERYLSSVLFEGMFEE

SEQ ID NO: 28729 - protein, 413 aa, Acinetobacter sp. ADP1
MYSNNQRSRIGSHTWKIAFLFAFLALLVDGADLMLLSYSLNSIKAEFNLSTVEAGMLGSFTLAGMAIGGIFGGWACDRFGRVRIVVISILTFSILTCGLGLTQSFIQFGVLRFFASLGLGSLYIACNTLMAEYVPTKYRTTVLGTLQAGWTVGYIVATLLAGWLIPDHGWRVLFYVAIIPVLMAVLMHFFVPEPAAWQQSRLAPSKQTETVKTSAFKLIFQDKRNRNMFILWALTAGFLQFGYYGVNNWMPSYLESELGMKFKEMTAYMVGTYTAMILGKILAGFMADKLGRRFTYAFGAIGTAIFLPLIVFYNSPDNILYLLVIFGFLYGIPYGVNATYMTESFPTAIRGTAIGGAYNVGRLGAAIAPATIGFLASGGSIGLGFVVMGAAYFICGVIPALFIKEKQYDPQQS

SEQ ID NO: 28730 - protein, 457 aa, Acinetobacter sp. ADP1
MPKEANMASQDYATQRSSLDAQALINDAPLSRYQWLIAIVCFLIVFVDGIDTAAMGFIAPALAQDWGVDRSQLGPVMSAALGGMIIGALVSGPTADRFGRKIVLSMSMLVFGGFTLACAYSTNLDSLVIFRFLTGIGLGAAMPNATTLFSEYCPARIRSLLVTCMFCGYNLGMAIGGFISSWLIPAFGWHSLFLLGGWAPLILMLLVIFFLPESYRFLIVKGKNTKKVRQILSRIAPQKVQGVTEFHVPEEKVEAGTKKGVFGMLFSAKYVKGTVLLWVTYFMGLVMIYLLTSWLPTLMRETGASLERAAFLGGLFQFGGVLSALFIGWAMDRFNPNRIIAGFYLAAGIFAVIVGQSLSNPTLLALFILCAGIAVNGAQSSMPVLSARFYPTQCRATGVAWMSGIGRFGAVFGAWIGAVLLGNNWSFTMILSMLIIPAAAAAIAIFVKSLVAHTDAT

SEQ ID NO: 28731 - protein, 509 aa, Acinetobacter sp. ADP1
MTAQAKKLDSADRKALPSHIYDSFIVGAGISGIAAAIRLDQVGYANYKIIEKASRVGGTWRENTYPGCGCDVPSALYSYSFAPSAQWSHLFARQPEILNYLEDVSHKFNINEKIEFETELNKAAWDNERNLWVLDTNKGQFLSRTVVFATGPITEAQIPKLDGLDSFKGEMFHSARWNHDYDLSGKRIAVIGTGASAIQFVPQIQPLAKELFVFQRTAPWVVPKPDMELGDFSKSVIAKLPIIQSTWRKAVAQSLNAINFGLRNPAVLKPVGELFKQVLKSQVKDPELLKAVIPDFTIGCKRLLFANNYYPALQASNTKLIPHGLVKVEGNTVIAANGERHEVDVIIWGTGFEVSHPPIGRRVYNDKGECLNDLWKQSSPEAYLGTNIENVPNAFLVLGPNVLVYDSFIGLAEAQLDYIVDGLQKIKKHNISKLTIKPQVIHAHNERVQKHLKTTVFNAGGCKSYYLDANGRNFAAWPWSLKKLRQRLKSLNIRDYDVTYQTTTNKIDA

SEQ ID NO: 28732 - protein, 333 aa, Acinetobacter sp. ADP1
MTDLPTTMRHIEISQSGDPDVLHIVETSLPKIKIDEILIEVKAFGINRPDVLQRKGLYPMPKDVTPIPGLEVAGIVTAIGENVSQFKVGDRVCALTNGGGYAEYCAVPETQTLPIPSNLSYIEAAAIPETYFTVWANLFDIGQLSVGETALIHGGASGIGTTALTLCHAMGIKTFCTVGSDDKVDALNKITTAINYKKHNFEEVILEQTQNKGVDVILDIVGGKYFQQNMNTLKRDGRLVILGFMGGRYAKEFDLQQLILKRAKVTGSTMRARTDQEKSEITQSLRQHVWPLLSEGKSLPLIYKSFSFEDISKAHTCMEESEHIGKIVITLTE

SEQ ID NO: 28733 - protein, 283 aa, Acinetobacter sp. ADP1
MADIDYLLNKQSFIEMDARERAKSLFDLNSCKELLDPFAGVMSPWLLRQNIVPQADDGVVVMKGFIEQQPAVVISVEGSFQGGSLGEVGGAKIAGALELAIEDNCNHIPTRAILLLETGGVRLQEANLGLAAIAEIHSAIVELRHYQPVIGVIAGSVGCFGGMSIAAGLCSYLIMTQEGRLGLNGPQVIEQEAGIDEYNAKDRPFIWSITGGEQRFASGLIDAYVEDDRELIKQKVIAYIQQGIPQVQRSTQSTFYLSKLFQLDTSDQILPVDVRKLYQGEQA

SEQ ID NO: 28734 - protein, 287 aa, Acinetobacter sp. ADP1
MNKMNNNILKKNDLSSQEESTHEIQDVLDQLDFYTYKIALFLDIDGTLADFKIDPLACFISKKILKSIQDIQSKGCLVSVITGRDYNSAQKLLADVSLPIAALHGLDIHINEKTQLNAINQNNQIFIQNFLCRLKEEIKYQPDLSIENKHHSIALHYRKNPDLYDIAKHIMNTVKKDNDEFKVIEGKYVFELIPKNSNKGSAIKTLLSYFDAEHYLSIFIGDDITDEDGFNMVNQLEGISIKVGSGKTVARFRLKNIEHVEEFLNLLSHHFPDSSTQITKKYGEQHV

SEQ ID NO: 28735 - protein, 450 aa, Acinetobacter sp. ADP1
MSTMSLNINDLLNQAKFSKFHLSVVFWCTLINICDGYDLVIYGVVLPRLMEQWSLTSVQAGMLASTAMCGMLVGALSCGILADKFGRKRVLLLCVFFLSTFTLLGSFASTPTEFAILRFLAGLGIGGAMPNVVALTSEYSPKKSRVTMVSIMSCGYAVGAIISALVGSILVERFGWQIMFILAGIPLLFIPIIWKYLPESLVFNVKKNNTEKAHALIAKVDPTVLVSQHTKLVLNESLEKAYGSRRVLFQEGRAAGTLKFWIAFFMCLLVVYALSSWLPKLMYNAGYPLGKSILFLLAMNVGGIIGGTTSGMLADKFKIKPVVISLFCIAALSLIALGFNTSAIILYTLVAVAGASIQGASILLYSYVAQFYPLVANSTGIGWASAIGRTGAIMGPILAGMLLVLNLPHLMNFVLISVPALIAAISIGFLTTSKKKVEQPVALVTQQSLE

SEQ ID NO: 28736 - protein, 383 aa, Acinetobacter sp. ADP1
MTIEYSKLFESFALTPDIELRNRIIMAPMTTWSANPDGTVSEQELNYIRQRVNCVGLVITGCTHVQENGIGFTNEFAAFDDRFIASLKELAQAAKSGGAPAILQIFHAGNKAIPDLIPNADLVSASALIKTPTGSFVDSQMMTRALSHEEILEVIHAFGETTRRAIEAGFDGIELHGAHGFLIQNFFSPLFNQREDEWGGSLEKRMRFSLEIVKEVKSVIKQYAKKPFALGYRISVEEYDENGLRIGDSLQLIDRLIDSGIDYLHVSLTDILNSKPVDSTDEKLTIQRVIDHVNYRISLISAGKIRTPHQALQALALGLPLVAIGKALVINPDWVILVANHQADQISTELELEKDAELHIPDHLWDEIKIRKGWFPMRQIEQV

SEQ ID NO: 28737 - protein, 469 aa, Acinetobacter sp. ADP1
MRLIKYLFFIIISTFASHVFADYVATNSSGSVTGSTAIQACVNLWNTQNSKYPDSASPSGNITANNSACQRAGGGFGTVTLSTSCPSTVTSTPISVPGWHSWTYEQTVSYSQAISSQTACYQGCRYKGPAMAGDDPSMHLVFGDPVKDSSCPNTDTKPSTPVPNFQGGDGGSGGDSGSGGDSGSGTGGSSGGTGNCTVSGNTINCVGANGGSGGDGGSGANGGAGAGGGAGGSGGSGSGGGNGGAGGSGGAGGSGGAGGSGGAGGSASVTVNFDAAGIISAVNALGTSLKTSITDLKTSLTSAINDVKSSLNDMKSQIADGFKSVTDMLGITNSKLDEINQNGKDTNKKLDDLNKKAQQTNDKLDELNDKAKELNDFVKEEPNLPNNDNKVSIDETVPDIPNTQYLSWSGYCPFSANANTVSINGQTTAIGSDFTSWCTMAENVKPFVLAAGAIMAFLIASGVWMGRGE

SEQ ID NO: 28738 - protein, 369 aa, Acinetobacter sp. ADP1
MKSRAAVAFGPGQPLQIVEVDVEPPKAGEVLIKVTHSGVCHTDAFTLSGDDPEGVFPAILGHEGAGIVIEVGEGVTSVQPGDHVIPLYTAECGECLFCKSNKTNLCVSVRATQGKGVMPDGTTRFSYNGEPIYHYMGCSTFSEYTVVAEVSLAKINPEANHEQVCLLGCGVTTGIGAVHNTAKVQEGDSVAVFGLGGIGLAVVQGARQAKAGRIIVVDMNPEKFELAKEFGATDFLNPKDYDKPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLDEINHAFDLMHEGKSIRSVIHF

SEQ ID NO: 28739 - protein, 448 aa, Acinetobacter sp. ADP1
MSSNLDLTAKKATKINLFNFSVPAMRAFHMSWLAFFVCFFAWFACAPLMPVIAGEFHLTKDQIANINIAAVAITIVVRLIVGPLCDKYGPRKTYTALLLIGSLPVFGVAAANSYESFLFFRLLIGAIGASFVITQYHTSIMFAPNVVGTANAASAGWGNAGGGATQALMPLLLSALVMFGVEQAMGWRVALLVPGAMMVIVGLLYWKYTQDCPQGNFKELRAQGIQVGSDKKGGMAILMHAARNYRVWILFGAYAACFGIEIFIHNIVAMYYVNHFNFGLKEAGLAAGIFGLLALFARALGGIISDKVAIKKGLDGRTKVLFAMIVGEGLFLIIFSQMNSAMLAIMIMTLFALFTHMACGATYALVPFIDRDALGGVAGIIGAGGNVGAVAAGFLLKGMMDIQTCLMVLGGLVIIAGGFVMLIRFSAEHKVKEQRLFEQAVLERNNLA

SEQ ID NO: 28740 - protein, 395 aa, Acinetobacter sp. ADP1
MNFKRMTDLDLSEKRVLIREDLNVPVKNGQITSDARLRAALPTIQAALAQGAAVMVCSHLGRPVEGEPKPEQSLAPVAAYLSDALGQEVKLLTDYLEGVEIAPGQVVLLENVRFNLGEKKNNAELAQKYAALCDVFVMDAFGTAHRAEASTEGAARYAKVAAAGPLLATELDALGRALQTPEKPMVAIVAGSKVSTKLDVLTSLSDICGQLIVGGGIANTFLAAAGFNVGKSLCENDLIDTAKAIAAKVSVPLPTDVVVADATEIDFADFLGSLAKAQAIVKKVEDIADNDMILDVGPDTAKAFAEILKTAKTILWNGPVGVFEVDQFGEGTKTLSLAIAESKGFSIAGGGDTLAAIDKYKVADKIGYISTGGGAFLEFVEGKTLPAVAVLLERA

SEQ ID NO: 28741 - protein, 431 aa, Acinetobacter sp. ADP1
MFMSQIVDIRAREILDSRGNPTIEADVILASGVVGRACAPSGASTGSREALELRDGDKARYLGKGVKTAVNNVNTIIRDALVGKSVFEQKDIDNTMIELDGTENKEKLGANATLAVSLAAARAAADEKKIPLFQYIADLRGQTILTMPVPMMNIINGGSHADNNVDIQEFMIEPVGFTSFSEALRAGAEIFHSLKSVLNKKGLNTAVGDEGGFAPNLRSNEEAITVILEAIGQTGYKAGSDIMLALDCASSEFYKNGQYILAGEGNKAFTSNQFSDYLAGLVNQYPIISIEDGLDESDWEGWSYLTSILGDKIQLVGDDLFVTNPKILQRGINEKVGNSILIKYNQIGTLTETLDAIYLAKDNGYSTVISHRSGETEDSTIADLAVGTAAGQIKTGSLCRSDRVAKYNQLLRIEELTKAAYRGKAEFKGLN

SEQ ID NO: 28742 - protein, 503 aa, Acinetobacter sp. ADP1
MRYIDPNQPGSKVQFKAQYENFIGGQWVPPVKGEYFGNSSPVDGKVFTQIPRSSVEDIELALDAAHKAKADWNKASPTVRSNVLLKIADRLEENLELLAVAETWENGKPIRETLAADIPLAIDHFRYFAGCIRAQEGGISEIDEDTIAYHFHEPLGVVGQIIPWNFPILMAAWKLAPALAAGNCIVLKPAEQTPSSILVLAELIQDLLPPGVLNIVNGYGAEVGRPLATNPRISKIAFTGSTKVGQMIMQYATENIIPVTLELGGKSPNIFFEDILDKEDDYLEKTLEGFAMFALNQGEVCTCPSRALVQESIADKFLEMAVERVKRIKTGHPLDTETMIGAQASKQQFDKILGCIDTGRNEGAQLLTGGDARHDVDGGFYIEPTIFKGNNSMKIFQEEIFGPVLSVTTFKDFDDAMRIANDTIYGLGAGVWSRSAHTSYRAGRAIEAGRVWTNCYHLYPAHAAFGGYKQSGIGRENHRMMLDHYQQTKNLLVSYSTKPMGFF

SEQ ID NO: 28743 - protein, 490 aa, Acinetobacter sp. ADP1
MQLPVYHSTQIQAWEQRWFEQQNSSLGLMQQAAWAISQKLHHHILKNSLSIKKIAVWCGSGKNAGDGYYIAIYLKSLGYNISIFTMPAGQSTDLKQAVADAHANQLPISNHFDVNNDYDCHIDALFGIGLNRELDQNWQSIVHHFNRLSGFKVAVDLPSGLNANTGASLPVAIKVDVTYTILAEKIGLFTGQATEYVGQLELISLIPKDNMLQAFAYLSTQQVKLPIRQSFGHKGTYGHVLVVGGHKNMGGAVIMAAEAAFHAGAGKVTVICDALHHSAILARAPNIMIKDINQIDAQEIEQILKEIDAVCFGMGLGRDQWAKQTFDVWFQQLHQQQKLHVVLDADALWFLSDQSIKLGQNFYMTPHAGEAARLLDISVAQIEQDRFTAIRQLQQRYNGAWVLKGAGSLSLFHDKIMICTAGNAGMGTGGMGDVLAGMIASLKAQFDDQICLSDVVTLHAQAGDLLAQNGQRGIQAYDMAKAIYHVVNHP

SEQ ID NO: 28744 - protein, 160 aa, Acinetobacter sp. ADP1
MTNLYQFEAELLEGDTKSLADYQGKVLLIVNTASKCGFTPQFAGLEKIYEKYKDRGFEVLGFPCNQFGGQDPGSNNEIGAFCQRNYGVSFPMFAKVDVKGPEAHAIFRYLTREAKGILGSENIKWNFTKFLVGRDGKVLNRYAPTTKPESLEEDIEKALA

SEQ ID NO: 28745 - protein, 369 aa, Acinetobacter sp. ADP1
MIHDDQKPSSSLDLQEIRIQIDSVDQQIQELINRRATLAEAVAKAKFASEENPLFYRPEREAQVLRKVMERNQGPLSDVTMARLFREIMSACLALEAPQSIAFLGPEGTFTQSAALKHFGKDAVVRPLPTIDEVFREVEAGSAHYGVVPVENSSEGVVNHTLDCFRTSQLNVIGEVELRIHHQFLVSHNTRKDSIKQIYAHQQALAQCRQWLDTHYPGVERVALSSNAEAARRIRNEWHSAAIASDIAASMYDLEIFHSNIEDNPENTTRFLVIGREKIPQSGNDKTSLLISAHDRAGALLEILAPFAKHKISLTSIETRPALPEKWAYVFFIDLEGHIEQENVAAAIDDIRPLVKELRILGSYPAAVL

SEQ ID NO: 28746 - protein, 471 aa, Acinetobacter sp. ADP1
MPRKKEVVSGNFVRYDAVILGSGPAGEGAAMKLAKSGKRVAIVDIREQLGGNCAHVGTIPSKALRQTVSSIIRYQRDPMFQKVGEWKKFTMKQVLSHAHRVIQQQVATHTRFYDRNNIDVFYGRAYIQDQNTVLVFTPEGIKESIIFEQLVIATGSRPYQPQGLDFKHKRVFDSDKILDLDYPIHKIIIYGAGVIGCEYASIFIGLNHKVDLINTQHKLLSYLDDEIADALSYHLREQGVLIRHNEQIDHLETHDDYVVLHLQSGKKIKADAILWCNGRSGNTDGLGLENVGLKPNGRGQLAVNEKYQTEVENIYAAGDVVGWPSLASAAYDQGRCAGANMSGEENVKPVTDIPTGIYTIPEISCFGKTEQQLTEEKIPYEVGQSSFRHLARAQITGDTVGELKILFHRDTLEILGIHCFGNNASEIIHIGQAVMQSPNNSLKYFMETTFNYPTMAEAYRVAALNGLNRLF

SEQ ID NO: 28747 - protein, 290 aa, Acinetobacter sp. ADP1
MIQSVAFIGLGAMGYRMASHLPRHFDTVYVWNRSFEKAKQHATEYGTQAVELSQAVQADIIFSCLPTSADVAQLVENLELKPGTIWVDCTSGVPDLARQLVTQLKNQGVDYLDAPVSGQTIGADNATLTVMVGGDFTAFERAYPAMQAFGKLIKHVGESGAGFAVKAVNNMLLAVNLWSVAEGFTTLKAHGVNLGEALDCINASSGKSGVTETIFPQRVLNRSFPVTFALPLLAKDAGIALDLVHAAKLPAPLIALTQSLIQAANQTAEENSDFSAAVKMYESWSKITLE

SEQ ID NO: 28748 - protein, 174 aa, Acinetobacter sp. ADP1
MSKGQTLQDPFLNSLRKERIPVSIFLVNGIKLQGHIESFDQYVVLLKNTVSQMVYKHAISTVVPARNPRPAGAPTGAPQGGGFGGQGGGFGGQGGGFGGQGGGFGGQGGGFGGQGTGFGGQGGGFGGQGGFGGQGGFGGQGGFGGQGGFGGQGGSGFDNDTKFEDGQEDDSNNR

SEQ ID NO: 28749 - protein, 471 aa, Acinetobacter sp. ADP1
MSMANKVLKLIQESGAKWVDFRFTDTKGKEQHVTYPADSIDEDTFEDGKMFDGSSIAGWKGIEASDMILRPDAETGFIDPFFAEPTVVVTCDVIEPSTGQGYERDPRSIARRAEEYLKSTGIGDTAFFGPEPEFFVFDEVKWEIDMSGARHTLIAEEAAWSTGKDYESGNSGHRPRVKGGYFPVPPVDSSHDMRAEMCNKIEEIMGPGRVEVHHHEVASCQLEIGVSFNTMVRKADEVQQFKYAVHNVAHQYAKTATFMPKPMVGDNGSGMHVHMSISKDGKNLFAGDEYAGLSEMALYFIGGVIKHARALNAITNPSTNSYKRLVPHFEAPIMLAYSARNRSASIRIPYVSSPKGKRIEARFPDPMMNPYLGFAALLMAGIDGIQNKIHPGEAADKNLYDLPPEEEAKIPTVAHSLDMALEALQADHEFLLKGGVFTKEMLDAYIELKTEEVRRLNTTTHPVEFDMYYSL

SEQ ID NO: 28750 - protein, 234 aa, Acinetobacter sp. ADP1
MDKVYKSAALALQDIVKDHQTLAVGGFGLCGIPEALIGALKDTQVKHLTCISNNAGVDDFGLGLLLQTKQIKKMISSYVGENKEFERQYLNGELEVELTPQGTLAEKLRAGGAGIPAFYTQTGVGTLIAEGKEQREFDGKTYILEPSLTADIALVKAYKADRAGNLVFRKTARNFNPECAMAGKITVAEVEQIVETGELDPDEIHLAGIFVHRVVLNSAPEKRIEQKTLKAQGA

SEQ ID NO: 28751 - protein, 463 aa, Acinetobacter sp. ADP1
MLQQAVKEMFDHHELTSQPMYRPEVQKVIDQHHLKYVLAQFVDIHGAAKTKSVPISGLKAIEKDGVGFAGFAISGMGMQPHGPDFMVKGDLSTLTPVPWQPGYGRVVCEGYVNGKPHPYDSRYVLRQQVERLSAQGWTLNTGLEPEFSLFRRSEDGKLKMVDDSDNLDKPCYDYKGLSRSREFLERLTEALIPVGFDIYQIDHEDANGQFEINYTYADAMKSADMFTFFRMAAGEIANDLGMICSFMPKPDPKRAGNGMHFHLSIGSDECSNLFHDASDPSGMGLSKMAYHFIAGLLEHGPALCAFCAPTVNSYKRLVVGRSLSGATWAPAFIAYGGNNRSAMVRIPYGRIELRLPDAGCNPYLVSAAIIAAGLDGIERELMPPTACNENLYSLGLEEIAARGIQTLPQSLKEAIDALKADPLFAQKMGSEIVNEFIEQKSMEWVEYCRHVSDWEIQRYTEFF

SEQ ID NO: 28752 - protein, 493 aa, Acinetobacter sp. ADP1
MFKMSQINSIDANRYEIKSSADVSRLVSKFAGQGKSNKVIWLALIGVFIDAYDLTTLSFGIDQVVQEFSLTPVMTGVVASAIICGTIVGNLVGGWLTDKIGRYRVFMADMVLFVIAAIVAGFAPNVWVLIIARFIMGISVGIDLPVAMSYLSEFSKFSGKSNKAARLAAWCPMWYAASSVCFGIVLALYFLLPPEHINWLWRASLIFGAVPALFIIFIRSKYLTESPIWLANQGNLAGAAKILRESYDINAFASPEPVIKKAAIKPPKLSFKVLFNKTYLPRTIVSLVIHVSVAFQYTTIAFFLPSILMRFFHTDVLTTITTTLGLNLLFAFTGGLLGIYVASRLASRHILLVGFFLQFIALIVLSYIGEPQNPYLVYTAIIMLGLWLFAEGFGPGAQMMVYPTMAYPAEIRGIGVGFNRAVTGVAQASAMFLLPIWMARYQTDVFLIISIFAVIPLVVIGLLIKYEPTAQDIDAKDPEHDKKSGLDAVAVAD

SEQ ID NO: 28753 - protein, 483 aa, Acinetobacter sp. ADP1
MDLQQQPLFRQKALVAGQWCDADNAEKTPIFNPATQELIGYVPNMGRAETERAIEAAYASWEMWKTKTAKERSALLKKWYDLILLNLDVLAEILTTEQGKPFNEAKGEIIYAASFIEWFAEEAKRIYGDIIPSPYPDARIVVNKQPIGVVAAITPWNFPAAMITRKVAPALAAGCPCIVKPAPETPFTALALADLAIQAGIPAEIMSVVTGDAAQIGDAIFASDHVRKFTFTGSTPIGKLLLEKSAKTLKKVSLELGGNAPFIVFDDADIEAAVEGALIAKFRNAGQTCVCVNRFLVQSGVYEKFIQVFKAKIESLKIGNGLEAGSEIGPLINAQAVAKVQSHIEDALSKNGRLITGGQVHATGELFFEPTLIADANTEMMVATQETFGPLAAIFKFDTEQQAIQMANDTEFGLAAYCYTRDLGRAWRMSEQLEYGMVGINKGLISNEVAPFGGIKHSGLGREGSKYGIEDYLEIKYTLFGGL

SEQ ID NO: 28754 - protein, 488 aa, Acinetobacter sp. ADP1
MQQFQLYINGKFEDGAAQFDSINPATGEIWAKMPEARTDQVNRAVDAAEQAFYDSSWSGLTASQRGKLLYKLADLVEKSAPRLAALETTDTGKIIRETSSQIAYVAEYYRYYAGLADKIEGSFIPVDKPDMQAWLVREPVGVVAAIVPWNSQLFLSAVKVGPALAAGCTVVLKASEEAPAPLLEFAKLIDEAGFPAGVVNVITGFGPECGAVLSAHPKVAHIAFTGGPETAKHIVRNSAENLAKVSLELGGKSPFIVFADTDINSALNAQIAAIFAATGQSCVAGSRLLIEESIKDEFLQRLAERVQSIKMGLPDDMQTEYGPLCTLKQREKIQQVVQRSVEQGAKLITGGQVCDGAGYYYPPTILDCSGVSDAQSIHTELFGPVLSVDTFSTEAEAIQKANSTPYGLASGVFTSNLTRAHRMTRAIRSGIVWLNTYRVVSPLAPFGGYGLSGHGREGGLSAALEYTTTKTVWLRMSDQPIDDPFVMR

SEQ ID NO: 28755 - protein, 353 aa, Acinetobacter sp. ADP1
MSIQVKNIEKHFGAFHALKNISLDFPEGQLVALLGPSGCGKTTLLRIIAGLESADEGKILLEGADATNIHVRERQVGFVFQHYALFRHMSVFDNIAFGLRVRPRSTRPSEAEIKKRVTRLLDLVQLGFLADRYPSQLSGGQRQRIALARALAVEPRVLLLDEPFGALDAKVRKELRRWLRTLHDELHITSIFVTHDQEEALEVADQIIVMNKGNVEQIGSPREVYEKPATPFVFDFLGQANRFDGQYHENKVELGEDQIILPNVSEVPHGKVIAFARPDELHIHAQPQDNTIQATFLREVWIAGKVVAELQDRNGRLIEIALSPDEARLHLFRPNQTVWISVSQLHLFADHVA

SEQ ID NO: 28756 - protein, 470 aa, Acinetobacter sp. ADP1
MSNEMHGQPSGEGELSRSLSNRHLQLIAIGGAIGTGLFMGSGKTISLAGPSILFIYLIIGVMVFFVMRALGELLLSNLQYKSFIDFSTDLIGPWAGYFVGWTYWLCWITIGIADLSAIIYYLQFFNNGMPFTPTEGAMISVAAIFFIMGLNLMTVKLFGELEFWFAMIKITAIVVLILVGLWMIFTGFTSTSGEVASFTHLWANGGFFPTGMHGFLAGFQIAIFAFVGVELVGTTAAETKNPEINLPKAVNSIPIRIIIFYVLALLIVMSVTPWNRIDPNISPFVNLFSQAGIAAAAIIMNLVVLSSVMSSMNSGVFSTSRMLFGLSKEKQAPQAFGALNKGRVPANALYFSTVCLLLGAALQYVVPNTVEAFTLATTLSTILFICVWLMIIWSYMVYYKKRPELHAKSIFKLPGGLFTCWILIIFFVGMIYVLSLEPDTMKALMVSPIWLVILVIGYFGFYKPRLKSKK

SEQ ID NO: 28757 - protein, 459 aa, Acinetobacter sp. ADP1
MSKVKTVYRCEQCGADHPKWAGQCSECGEWNSLTEVRLETSTNHRAKPKLGGYAGEISTVTTLNQISVSHETRVATGIGEFDRVLGGGLVTGSVVLIGGDPGIGKSTILLQTATYMASSNSSALYVTGEESLSQVALRAQRLDLPTDKLKVMAETCVERICEILAHERPTVAILDSIQTLYTETLQSAPGGVSQIRESAALLTRFAKHSGTALFIVGHVTKEGALAGPRVLEHMVDCVLYFEGQSDSRYRMIRAVKNRFGAVNELGVFGMTDKGLREVANPSAIFLSRYDEAIPGSIVMISREGTRPLLVEVQALVDDAQGQPRRVALGLEQNRLNMLLAVMHRHGGVQTSGQDVYVNVVGGLKITETGSDLAVLLACASSLRGKALPQQLAVFGEVGLSGEIRPVPNGQERLKEATKHGFTHIILPRGNAPQKKIEGVHVIAVARLHEALQTAMELSS

SEQ ID NO: 28758 - protein, 357 aa, Acinetobacter sp. ADP1
MNQIFKPILIGQYQLANRLAMAPMTRSRAQFDGTPSELAAEYYTQRASVGLIIAEGAQPSEDGQGYLATPGIYTDSHIAGWKKITNAIHAKGGRIFIQLMHVGRMSHPDNTPHHRQAVAPSSIAPGTVTFTPTGMQEIPKPRALTIKEIKQTIQDFRHAARSAIEAGADGVEIHGANAYLFQQFFAPTANTRTDEYGGSIENRARFAIEVATAIAEEIGADKTAIRLSPGSLLWGIDEGQEGPELYHYLVKELNKLGLVYLHIMHLGNETLLQDIRQLWTQALIVNRPGRPREQIGTDVESGLADLESYGEMILANPDFVNRLQQNLPMNEADKTTYYGGDAKGYVDYPALNASDKI

SEQ ID NO: 28759 - protein, 446 aa, Acinetobacter sp. ADP1
MNILKDILFPILKLALPLILIQICQASLGVINTMVAGRYYYIDLAGIGLGSNMWTPVFILFTGILYVLVPKISAMQQHSSQEIGVLIQQGKRVAFLLSIFGFILIQLLAFLCPWLIGDQQVAQIAKQYLHFVAFGVPGLVYMTLFRFVSEGHSLLKPIILTYAILLVCDASLCLVLVNGIGFIPEMGGAGTGLATAMSAYIACFCMYQFVSKAIPELKIKRIQVGFKESLGLLKQGLPIGITLILQILALATLAFFASQLGAKAIAAHQIVINIAMLIIMIPIAISSATTIRIAYFSATNHHQGKISTSLCVVVLTLIYSFLMAGILIGFAQHIVSLFTQDAEVLNVAVGLMSYVAIFLIFDAIQTVASGVLRGLHQFMQPLFIILFCYWFVIIPLSYLMGVQGWLQVRANVDVIWIVLTCGISLAAVLLTIQSYCHVTGIMNKRS

SEQ ID NO: 28760 - protein, 477 aa, Acinetobacter sp. ADP1
MSQQFDLVVIGGGPGGYEAAIRAAQLGFKVACIEKRVHKGKPSLGGTCLNVGCIPSKALLDSSHHYEDTIHHLGDHGITTGEVNIDIAKMLARKDKVVENLTGGVAQLLKGNGIEWLQGTGKLLAGKKVEFVPFEGETQVLEPKYVILASGSVPVNIPVAPVDQDLIVDSTGALEFAEVPKRLGVIGAGVIGLELGSVWRRLGSEVVVFEALDAFLPMADKALSKEFQKILTKQGLDIRIGAKVSGTEVNGREVTVKYNQAGEDKEQVFDKLIVCVGRKPYAEGLLAEDAGIKLTDRGFIEVNDHCATSLEGVYAIGDLVRGPMLAHKAMEEGVMAVERIHGHAAQVNYDTIISVIYTHPEAAWVGLTEEQAVANGHEVKTGQFPFAVNGRALAAGEAAGFVKFVADAKTDRLLGMHVIGPGASDIVHQGMIALEFVSSVEDLQLMTFGHPTYSEVVHEAALAVDGRAIHAIQRKRK

SEQ ID NO: 28761 - protein, 452 aa, Acinetobacter sp. ADP1
MNNDSSKLQRGLKNRHIQLIAMGGAIGTGLFLGSAQVIQSAGPSIILGYAIGGLIAFLIMRQLGEMIVHEPVAGSFSHFAYKYWGKFPGFLAGWNYWVLYILVAMTELTAVGKYINYWWPQIPAWQSVLFFFVVITLVNLTNVKFYGESEFWLAIIKVVAVISMIIFGLYLLFTADSSSTASFSNLWAHGGFFPNGFEGLFYMLAFLMFAFGGIELIGMAAAEAENPAKTIPKAINQVVFRILVFYVGSLTILLSLVPWNQLDLGGLDKSPFVMIFSQLGIGWAAHLLNFIILTAALSVYNSGMFANSRMLFGLAQQGNAPKIFTKVNKQGVPIPAVLFSALLIFGCVLLNYFVPEDALGHLMYVVVGALVLNWAMISLTHLKFKAAVKKLKLNVTFPALWAPVSNYLVLIFIALVLFIMWQQGFKESVIMIPVWIVLMFGLFHLLTNKDHT

SEQ ID NO: 28762 - protein, 436 aa, Acinetobacter sp. ADP1
MTSTTTTASPEIATNSKTRVLFASLVGTTIEFFDFYIYATAAVLIFPHLFFPASSGSAAVLQSLATFAIAFIARPIGAALFGHLGDRIGRKATLVAALLTMGVSTVCIGLLPSYAQIGIVAPLLLALCRLGQGLGLGGEWSGAVLLATENAPEGKRAWYGMFPQLGAPIGFILATGSFLLLGVLMSDQAFMQWGWRIPFVASAILVIVGLYIRLKLHETPAFQKVLDKQKEVNIPFKEVITKHFPKLVLGTIAAICTFVVFYLTTVFALNWGTTKLGYSRGEFLELQLIATLCFAAFIPLSAIFAEKFGRKLTSISICALAAVFGLFFSDMLASGNTFVVFLFLCTGLSIMGLTYGPIGTVLSELFPTSVRYTGSALTFNLAGIFGASFAPLIATKLAEAYGLQAVGYYLSAAAILSLIAFLLIRETKDQDVNNQI

SEQ ID NO: 28763 - protein, 307 aa, Acinetobacter sp. ADP1
MNTVEPNFLADEFLLDHYVGKTPLVRLQRLACHTQSVVLAKLEGNNPAGSVKDRPAYNMIMQAEKRGKIRPGDTLIEATSGNTGIALAMVAAMRGYKMKLIMPNNMSQERKDAMLAYGAELIEVTQQQGMEGARDLALKMQSEGQGLVLNQFGNPDNVEAHYLTTGPEIWQQTNGKITHFVSSMGTTGTIMGVSKYLKEQNPDIQIVGLQPSEGSSIAGIRRWPQEYLPTIFEPSRVDRIIDIPQIEAEKTMRRLAREEGISAGTSSGGAVWASLKIAEEQPDAVIVCIICDRGDRYLSTGLFSVQD

SEQ ID NO: 28764 - protein, 462 aa, Acinetobacter sp. ADP1
MYDIIIIGAGTAGISAYKEAVKYTQNILIMNDGPWDTTCARVGCMPSKVLISSANRFHDLTHLEEVGLKAHIEREIDTSNVMSHVRQLRDEFTAATLKDVNHWPKQRKISGKAVFIHPDTVQINNQQYQARSFILAVGSTPSVPAELKQRLKDRLITSDDIFELPTLPESVAVIGSGVIAIELAQAMSRLGVKTTIFARSKRIGTLTSPALQELAQQILSAELDIKFEILPDDMSLDQNKVKVSYTENGKKRTQHFDYLLHATGRDSLLATLDLEQISSQFSDVKKLPIDPDTKQLANLPIFIAGDAHTTTPVQHEAAYEGKMLVHNCLNFPKIENVKTLTPLGIVFCSPEMAIAGKSYKQLKEHDIDFITGYVSYEKQGRAKVLGKNKGATEIYIDPKSRQLLGAEILVEQGEHLAHLLVWMISEQSTIDTILNHPFYHPTLEEGLRTALKHARRQIDQIV

SEQ ID NO: 28765 - protein, 272 aa, Acinetobacter sp. ADP1
MNNPTPSTTQALIEVQNLSFNRGDRVIYDNVNLSIRRGQITAIMGPSGTGKTTLLRLIGGQLTPDLGEVLLDGKNIANMTRHELFAARARMGMLFQSGALFTDMSVYENVAFPIRAHTQLPEHLIAELVALKLESVGLRGAEKLMPTELSGGMNRRVALARAIALDPDLIMYDEPFAGQDPIVKGVLTRLIRSLREALDLTTIIVSHDVAETLSIADYIYVVAEGKIQGEGTPEQLQAHASPFVKQFLTGSEEGPVEYQFSQRAYLDNEVYP

SEQ ID NO: 28766 - protein, 343 aa, Acinetobacter sp. ADP1
MGSLMKAAVVTAFNQPLEIKDVEIPKVTSGKVLVKMIATGVCHTDLHAMHGDWPIKPSLPFIPGHEGVGEVVEIGEGITHLKIGDTVGVPWLYSACGHCDHCYAGWETLCKQQQNSGYSVNGSFAEYCLADGEYVGVIPEGVDLLEIAPILCAGVTVYKGLKMTEAKTGDWVAISGIGGLGHVAVQYAKTMGFNVVAIDVDDSKLELAKQLGADVGINALKVDVKEEVLKATGEGCHGVLVTAVSPKAFEQAVSVVRRGGTMVLNGLPPGKFDLSIFDMVLDGITVRGSIVGTRLDLKEALDIAARGKVKAHISVEPLENINDIFERMEQGKIDGRIVIDLKL

SEQ ID NO: 28767 - protein, 473 aa, Acinetobacter sp. ADP1
MAERLNNDFQFLDVARQDPEKKDIDVRKSEFVEIYKPFTAEVAANQTHRCLGCGNPYCEWKCPVHNYIPNWLKLIAEGRIFQAAELCHQTNTLPEVCGRVCPQDRLCEGACTLNDGFGAVTIGNAEKYINDTAFALGWRPDMSSVKWTNKKVAIIGAGPAGLGCADILVRNGVKPVVFDKRPEIGGLLTFGIPEFKMEKDVMKRRREIFTGMGVEFRLNVEIGKDVTIEQLLEDYDAVFMGMGTYTYMKGGFPGEDLDGVYDALDFLIANVNRTQGWEQNPSDYISVEGKKVIVLGGGDTAMDCNRTSIRQGAEEVTCAYRRDEANMPGSRREVQNAREEGVNFLFNRQPIEIVGENGQVTGVKVVTTQLGAPDSRGRRSPEPIPGSEEVLAADAVLLAFGFRPSPADWFASSSINLDGSGRVVAAEQQQYKFQTSNPKIFAGGDMVRGSDLVVTAIWEGREAAEGILDYLDV

SEQ ID NO: 28768 - protein, 482 aa, Acinetobacter sp. ADP1
MIQESLQYLLKHPDISFTAPTSGAVIEVNDAAKGTPLAWVKSHDRSGVEAAIQRSAQAQAKWKTQTALQRADVLWAWFHLINEHKENLAQILTAEQGKPLAEARGEIGYAASFIRWFAEQARRIDGEILPPTMAHQRLLVIKQAIGVTAAITPWNFPAAMITRKAAPAIAAGCSMLVKPAELTPLTAYALEVLALQAGLPQDILINISGDSVEVGKTLCESDVVRKLSFTGSTPVGRILMQQSAPSIKKLSLELGGNAPVLVFDDANLDQAVQGIMASKFRNSGQTCVCANRIYVQSGIYDALTTKLVDAVKALKVGDGREEGVTQGPLIDARAVAKVQSHIEDATSKGATLQTGGQLAAQGGTFFEPTVLSGVTQEMRVAKEETFGPLAALFRFETEEQAIAMANDTEFGLAAYLFTQSTARQWRVGEALEYGMVGVNTGAISNEVAPFGGVKQSGLGREGSQHGIEEYLEMKYLCVDLSE

SEQ ID NO: 28769 - protein, 428 aa, Acinetobacter sp. ADP1
MDTKHSALNQRKQQATPRGVGVMCQWYADKAENATIWDAEGNTYIDFAGGIAVLNTGHRHPKVLAAVKAQLERFTHTAYQVTPYESYVALAERINELAPIAGPAKTTFFTTGAEAVENAVKIARCYTGRQGIITFGNGFHGRSFMTMAMTGKTAPYKRDFGLMPGGVFHARYPVESRGISVDDALESIENIFSEDVAPHDVAAIVLEPVQGEGGFNVVPADFLKRLRALCDKHGILLVADEVQTGFARTGKLYAMDHYETKADLITMAKSLGGGFPISGVVGRAEVMDAPNPGGLGGTYAGNPVAVAAAHAVIDAIQEEKLCERANELGAELVHVLKGLQQSTDQVITDIRALGSMVAAEFETAEQAKAVQNYAMQNGLLLLTCGKYGNVIRFLYPLTIPVEQFRSGLDILKQGVASLATDHTTQAIG

SEQ ID NO: 28770 - protein, 479 aa, Acinetobacter sp. ADP1
MAAPKNVSESGHSEGLKSGLQSRHLTMISIAGVIGGALFVGSGSVIYSAGPAAILAYTLGGLLVLLIMRMLGEMAVMNPDSGSFSTYADRAIGRWAGFSIGWLYWCFWTLLMGWEAYVAGKILNSWFPFIPIWGYMLLVIVGLVWVNLQDVKNYGEFEFWFALIKVVAIVMFLVVGSLAIMHLWPWGDPSAAGFTNLTAQGFMPGGFSSVITALLGVMFAYMGAEIVTVAAAESKDPAKEIRKASNSIVWRIILFYVGSMFITVCLIPHNNPLLKDPTWGTYSVTLSTLGIPEARHIVNFVVLTSVCSCFNSALYTCSRMMFSLSKRGDAPKIFAKTNRNSSPWAGVIFSSIFSIVAVYLTATESMNVYDVLMLATGTVALYVYLAVAFSQLRMRKKIEAEGKAVDFKMWLFPWLTYAVIITIIGAIITMLIEGTYFKEVTYTTGLALVIVILGILTHKFNWGKDAREKMLEQSKKSMT

SEQ ID NO: 28771 - protein, 505 aa, Acinetobacter sp. ADP1
MEFDWTYTLGLLLNKNFWMATWTVIELSILVWLIGILLGFVLAFAKQSSFKPLAWMSGTYIWFFRSLPLLVLLVFVYNLPQIFPASSVVLASPFLAGLIAMTLSEAAYIAEIHRGGLTSITKGQIEAGKALGMKSLGIQRFIVIPQAFRVALPSLANEYVSIVKLTSLVSVISLTEILLVGQRLYTQNFLVLETMLAVAFYYVLIVTVFGWLIQWFEHKIDVTNRKPGLLNELDPLNKLPNISNASISVRKIIVPERQGEFALEAINIHKAYGDHEVLKGIDLKVRWGEVISIIGPSGSGKTTFIRTLNGLESLNRGTINLLGQPFLKDDVLTEDSPEYKNQIVRVGMVFQSFNLFPHKTILENVMLAPNYHKMGSTLENKVTALAMLDKVGMKQHAYKYPHQLSGGQQQRVAIARALAMKPSIILFDEPTSALDPELVNEVLKVIEELAQEGLTMIIVTHEMSFAFKVSDRVMFMENGHVVAEDTPEVLLNSSNERLKQFMHKV

SEQ ID NO: 28772 - protein, 356 aa, Acinetobacter sp. ADP1
MAELSSPLKIGAFEIKNRLVMAPLTRSRSGEDRIPNDLMLEYYQQRAGAGLILTEATVISPKAVGYEDTPGLWSEEQASAWHPIVDAVHQKGAKIVVQLWHVGRISDPQLLGGDIPVAPSAIQPEGHVSLLRPKRPFVTPRALSIEEIHEIVAQYQHAAELAKVAGFDGVELHAANGYLIDQFLQSGTNQRSDEYGGSLENRARLLLQVVDAFIDVWGAGRVGVHIAPRGDSHDMSDANPLETFGYVMRQLSERHIAFVFSREYEAADSISLQLRQKFNGVWIANENLSAESAKRILAQGDADAVSFGKAAIANPDLYERLIHNAPLNSVNPDTLYAKGAEGYTDYPTSQESALEA

SEQ ID NO: 28773 - protein, 488 aa, Acinetobacter sp. ADP1
MLTIVQEALTFDDVLLLPAYSTVLPKDVSLKTRLTRGIQLNVPLVSAAMDTVTESRMAIAMAQNGGIGILHKNMDIAAQAAEVRRVKKFEAGMVKDPITVSPETTVRELIAITQANNISGVPVVKDGQVVGIVTGRDTRFETNLEQPVSNIMTPQDRLVTVKEGASKESIQALLQKHRIEKVLVVDDLHALKGLITVTDFRKAELYPNACKDELGRLRVGAAVGTGAETPARVEALVEAGADVIVVDTAHGHSAGVIERVRWVKQNYPQVQVIGGNIATGDAALALLDAGADAVKVGIGPGSICTTRIVAGIGVPQISAIDNVARALKGEIPLIADGGIRFSGDMAKAIAAGASTIMVGSLMAGTEEAPGEVEFFQGRYYKAYRGMGSLGAMSGASGSSDRYFQDAKAGVEKLVPEGIEGRVPYKGPMSAIVHQMMGGLRSSMGYTGSADIEAMHQNTQFVKITAAGMQESHVHDVTITKEAPNYRIG

SEQ ID NO: 28774 - protein, 301 aa, Acinetobacter sp. ADP1
MYIMWKQYLTEAVLKTTIRAPSRFSLPPATLRVALNQMCRVFPLNKEVSIRPIRLAGIRAEEIKPQSSSTQLIFHIHGGAFFLGSLNTHRALMTELAARTQMQVLHVDYPLAPEAGFPDALDALYDIYQTLLDQGVLPKDIILSGDSCGANLALALALRLKDDPEQLPSGLILMSPFLDLTLSSESLRLNKKHDALLCIEALEAGIDYYLGDSMPKDDPRVSPIFDNLRGLPPTMIQVGSKEILLDDAKRFRDKAKEADVKVEFKLYTGMWHNFQMFSAWFDEAKQAISDLAVFAHQLDRD

SEQ ID NO: 28775 - protein, 470 aa, Acinetobacter sp. ADP1
MKHRLSDYFVRQGEPMTPKRSLITQQKLWKTFLIFLLPLIATNILQNLSGTINTVFVGQMMGVDAIAAVAVFFPILFCMMAFIIGLSAGSTVLIGQAWGAQNIEKVRCVVGSTLFMTIIGGCIIAALGVFFSREILTLLGTDASVMHLSLPYVQWMLAGSPLLFVYIIYTSILRGVGDSITPLIALGMTSLIGLVITPVLIAGYFGFPKLGIVAPAIATIIGYLSVLAFLAVYLNKKNHPLKPDLALLRHIRHHSEISRLILRLGIPTGVQMITTSVAGLVIVGLVNRFGAHATAAYGAVNQVLNYIQFPALSIAIAASIFGAQAIGMGKSDLLARVTRTALWMNIIITGTLVILAYLFSKYLMALFITDESVVQLGQELLFIVLWSILFFGAAAIFASIMRSSGTVTVPMLINIAAILFIEVPCAYWFSTLWGLKGIWIGYALAFVCLCIMQAAYYQFVWKKKTIKALI

SEQ ID NO: 28776 - protein, 333 aa, Acinetobacter sp. ADP1
MQIVKIKMERGRMMALLRFTAFVQKTFALWVVVFAALAFWMPDVFVWLKAYIPWMLGIIMLGMGMTMSLQDFQGILRYPKAVLIGVVAQFVVMPGLAFLLCQLFQLPSEIAIGVILVGCCPGGTASNVITYMARGNIALSVACTSVSTLLAPLLTPAIFYLLASQWIQIDAMSMFVSILQVILFPILIGLLLRRFFARQVNRYIEVMPLISVFAIVAIVAAIIGASKAAILQSGALILAVVMLHNGLGFLIGYWASRWLRLSDYDSKAIAIEVGMQNSGLGVALAAVHFAASPITAVPSAIFSLWHNISGAMLATYWARQSKQKTQQEPRDNF

SEQ ID NO: 28777 - protein, 243 aa, Acinetobacter sp. ADP1
MALLHIHNLHKRFGEHHVLKGIGLDVEAGSVVSIIGRSGSGKSTLLRSINGLETIDEGYIEVDGTLLEVGQTDLRALRLKVGMIFQQFNLFPHLTVIENVMLAVQIVKKMDKAATRDLALIMLDKVGLKHKADAMPSQLSGGQQQRVAIARALAMSPKILLCDEITSALDPELVNEVLAVVRDLAQEGMTLIMVTHEMRFARDVGDYLLFMHEGRVHEYGSAKELFAHPQTEELRSFIHLTHA

SEQ ID NO: 28778 - protein, 340 aa, Acinetobacter sp. ADP1
MTTNVIHAYAAMQAGEALVPYSFDAGELQPHQVEVKVEYCGLCHSDVSVLNNEWHSSVYPVVAGHEVIGTITQLGSEAKGLKIGQRVGIGWTAESCQACDQCISGQQVLCTGENTATIIGHAGGFADKVRAGWQWVIPLPDELDPTSAGPLLCGGITVFDPILKHQIQAIHHVAVIGIGGLGHMAIKLLKAWGCEITAFSSNPNKTDELKAMGADHVVNSRDDAEIKSQQGKFDLLLSTVNVPLNWNAYLNTLAPNGTFHFLGVVMEPIPVPVGALLGGAKSLTASPTGSPAALRKLLEFAARKNIAPQIEMYPMSELNEAIERLHSGQARYRIVLKADF

SEQ ID NO: 28779 - protein, 186 aa, Acinetobacter sp. ADP1
MKTFSCFRFLHMTIEMSVMISTEEIQAKVKQLGEQINAHYANSHKDLVLIGLLRSSFIFMADLCRAIAKPHELDFMTVSSYGAGTVSSRDVKILKDLDGEIRGKDVLVVEDIIDSGNTLSKVLEILQTRGPNSIELCTLVSKPSRREIELEVKFLGFEVEDRFIVGYGLDYNQKYRHLPFIGEIGL

SEQ ID NO: 28780 - protein, 505 aa, Zea mays
MASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 28781 - protein, 486 aa, Pseudomonas sp. M1
MIPVPVEAIYCRIAAPVENDQSADIRRVFAAQRDTALQLRSYTAEERIHKLKRLRKDIEARREQNYSQRVRWNFGKPAIEVEMTEILTVIMEISHTCKHLKKWLKPKKIPSTALMLGTSASVRYEPRGRCLIISPRKYPLTMTFGPLVPAIASGNTVIIKTSELTPNLSAVMVDIIRDTFEESEVAIFEGDASVATELLSLPFDHSFFTGSPAIGKVVMRAAAEHLTSVTLELGGKSPTIIDESADLEMAVKTITWGKFLNAGQTCIAPDHLYVAASVKERFVQLLKQHLDKVYGEGEKARTAPLARIVNQRHAGRIAGLIKDAVERGAKPIYGASVDAQERFISPTLLEEVPADAKIMEEEIFGPVLPIITFEYLDDVIQRINNAPKPLALYIWSKNRQNIEHILQNTSAGASCINHIAGHFLHNNLPFGGVNNSGIGSYHAEWGIRAFSHERSVLESKIMLSSLFFPPYTQTTRRVLSWLFKFF

SEQ ID NO: 28782 - protein, 367 aa, Pseudomonas sp. M1
MKITAAVTRANSNGFSIENLELDEPRDDEVLVRIVGVGICHTDLVAAAGVLPIQPPAVFGHEGAGVVIKTGSKVTGVQSGDHVALSFHSCGECPRCRVDDPSYCHSFGLLNFTGIRQGGSNLHDATGAAVAGNFFGQSSFASHCVANQRNVVKVSKDIPLELVGPLGCGIQTGFGGVARALACEADSSILILGGGAVGLSAVMAAVIRGCQQIILTEPHAARRALALELGATAVIDQISEDVEQLFKGFLPAGVNYAFDTSGIGAALETAYRCLAPRATFGLVGVPQDWEQKLPGTLAEMVQSGIIFKGIIEGDSDPQQSIPELIALYQAGRLPIDKLVTTFPLAQINKAIAAQHAGTCVKHVLLAG

SEQ ID NO: 28783 - protein, 471 aa, Pseudomonas sp. M1
MDTPLLRHPGYHAKCAPERIAVLIAETGASLTYHELDAFANRLARLYQSLGLEYGDHVAYQLENRVECPALQWGAHYAGLYYTFLSTRLTPAESAYIVEDCDAKLLVLSAKCATPELLAAIASLPSAPRVFILDAQRPATESLLAAVQQYSPATLEDPREGSEMLYSSGTTGRPKGVKPKLTGLPLGSTEVIAQQLEKAFAVNEHSVYLSPAPYYHAAPLKWVRGVHVLGGTAILMEKFEPEAALAAIDEYQVTHSQWVPTMFHRLLNLPNETRNRYSLSSQQVSVHAAAPCPIPTKQAMIDWWGPILYEYYGSTEQIGMTMASTDDWLRHPGTVGRAIYGRLHILGEDGRELPAGEDGLVYFSDSLPFSYHKDPVKTAEAYNDKGWACVGDIGHLDADGYLYLTDRKSHMIISGGVNVYPQETENVLLSHPQVLDAAVIGIPDNDLGESVHAVVQLHDHNQASDAFAAEL

SEQ ID NO: 28784 - protein, 314 aa, Arabidopsis thaliana
MMTCASSDDNESEKDKDSESFVEVDPTGRYGRYGELLGSGAVKKVYRAFDQEEGIEVAWNQVKLRCFSDDPAMTERLYSEVRLLKNLKNSNIITLYKVWRDERNNTLNFITEICTSGNLREYRKKHRHVSMRALKKWSKQILKGLDYLHTHDPCIIHRDLNCSNIFVNGNIGQVKIGDLGLAAIVGKNHLAHSILGTPEFMAPELYEENYTEMVDIYSYGMCVLELVSLEIPYSECDSVAKIYKRVSKGLKPEALNKVNDPEAKAFIEKCIAQPRARPSAAELLCDPFFDGILDDDDEDGENNDNNGAGRIVVS

SEQ ID NO: 28785 - protein, 351 aa, Arabidopsis thaliana
MMNRTLLMPSLSASLFYKEVDKLRPIPFDKVFQFERFNSLCSGFVRLSRFSDVKNRAQVFDLEKGSGRRWTVERDLEHLKQSARNESIDEFEVIRLIGKNPFLWHDHWPVEDYAKVFECMVVVDEISREADKVVMKIREAGEAERAKLASKTEILGPVPFVAVHMRIEIDWMIHCKKLEQRKKISEICSSKREILDRVGNISGLKTPTVLYLAVADTLLEEKEEDSSVLSGWRDGLIPFEKKKLGVKEEIYGKYSYLIQSAIDYEVCLRADVFVGNSFSTFSSLIVLERTQKARRLGFMSSCKDGGNKWRSYAYNLAGESNGVPRRWMTNMTHSSLQAISYGSNSVSCSSG

SEQ ID NO: 28786 - protein, 439 aa, Arabidopsis thaliana
MVTLTPSSASTPKTSFDFMKNNNSHSSLYVSSSSYLSSKEDALVTTKKLMEPSKTLNMSINPKQEEFGDEKKMVKKAPEDPEIGVFGAEKYFNGDMDSDQGSSVLSLTNPEVERTVVDSKQSAKKSTGTPSVRSESSWNSQSVLLQNKLVNSCNSSFKEKKNSNGQIQKVTNNKKSFLANLGCKCACSDGDSVDVDEKTSVKRSADPNISVITMRSSADMNTELIKIQKQEELSQRKSLEVFGSPVAIEKKSSVVQKKLPLPPWKSRTEEDDTKSEGSDSSSDLFEIEGLTGNPKPFLTRQGSDPASPTCYAPSEVSVEWSIVTASAADFSVMSECATSPVRRNRPTQIPRIPITAKSAPQRRKSSSSSGGNGFLMSCKSHKSVMVSGDLDRRSSMNKTQPSYVPRFPMETTKPKSFETRRRISNSSISHTQSSLLYSQ

SEQ ID NO: 28787 - protein, 170 aa, Oryza nivara
MPRSRINGNFIDKTFSIVANILLRIIPTTSGEKRAFTYYRDGMLAQSEGNYAEALQNYYEATRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 28788 - protein, 168 aa, Nymphaea alba
MPRSRINGNFIDKTSSIVANILLRIIPTTSGEKEAFTYYRDGMSAQSEGNYAEALQNYYEAMRPEIDPYDRSYILYNIGLIHTSNGEHTKALEYYFRALERNPFLPQASNNMAVICHYRGEEAIRQGDSEIAEAWFDQAAEYWKQAIALTPGNYIEAQNWLKITGRFE

SEQ ID NO: 28789 - protein, 486 aa, Nymphaea alba
MEKWWLNSMLSNEDLGRRCGLSASLGPIGNTSGSEEPIINDSEKNVNSWSGRGSYSCSNVDYLFNLGGVKDVWSLISGETFWVRDSNGDSYSIYFDIENKIFEIDTDSYFLGELESLFSSYLNLNNGSKSYNRYYDHYVYDTRHSWKSHINSCIDSYIRSETNMDSCIPNGSNNSSDNYIYSYICSDSERGSDRGSSNLKTSGVSDSDFGRHNDLDRNKRYRHLWVQCENCYGLNYKKFFSSKMNICEQCGYHLKMSSSDRIELLIDPGTWDPMDENMVSMDPIEFHSEEDPYRDRINSYQIETGLAEAVQTGIGKLNGIPIAIGVMDFKFMGGSMGSVVGEKITRLIEYATDRSLPVIMVCASGGARMQEGSLSLMQMAKISSALYNYQSNKKLFYVSILTSPTTGGVTASFGMLGDIIIAEPNAYIAFAGKRVIEQTLKKTVPEGSQVAEYLFNKGLFDPIVPRNLLKGVPSELFQFHGFFPRP

SEQ ID NO: 28790 - protein, 306 aa, Escherichia coli
MSTRVWVLGDAVVDLLPESQGRLLQCPGGAPANVAVGIARLGGKSAFIGKVGDDPFGRFMYQTLSKENVDTRYMSLDPQHRTSIVAVGLDEQGERNFTFMVRPSADLFLQPDDLPAFGPGEWLHLCSIALSAEPSRSTAFLAMEKIRQAGGNISFDPNIRSDLWQSEALLRKYLDRALSLANIAKLSEEELLFISGESQVQQGAYSLVQRYSLTLLLITQGKNGVLVYFQGQFIHYPAKPVSVVDTTGAGDAFVAGLLAGLADSGIPTNTRQLERIIAQAQICGALATTAKGAMTALPRQHDLPSQ

SEQ ID NO: 28791 - protein, 435 aa, Oryza sativa (japonica cultivar-group)
MSVAAGVSDAAITVRDKLRGKIGQTKVKRYWPGKAPEWADDGEDDADLRTANKVSLDKAFPKDEDGDAPPLKDDRRLRRLAQTRAENKEELRADHRRIRQAEIVSTVDEENERQEAELEEEDDEEAQEERRRRIRARQLLREQEELLPQEEEPIEEEEESEESEYETDSEDEQTGMAMVKPVFIPKSQRDTIAERERLEEEERQLEELVKKRLEARKIETRQIVVEEIRKEEHIEKTLNEEANIEDVDTDDELNEAEEYESWKNREIARIKRDREERDARLKEKEEIEKVRNMTEEERREWERKNPKPLRENKQKWKFMQKYYHKGAFFQEGADDVIQSAGKDDIYARDFSAPTGEDKMDKSILPKVMQVKHFGRSGRTKWTHLVNEDTTDWNAPWATNGPLRAKYNAKMAGMNAPIAKPKGSKKMKDWDTKQDD

SEQ ID NO: 28792 - protein, 363 aa, Oryza sativa (japonica cultivar-group)
MVCFASLRRALPLLLRATTTTTPRFLLPRALSGGVGGGAAVDARALLRGHSGWRGLRVAARMMLDSSDSAAAAGQMQPQQRAAGAVACSAQDGGAAGYASGGWAREDGKLKCGYSSFRGKRATMEDFYDVKLTEIDGQAVSLFGVFDGHGGPRAAEYLKENLFENLLKHPEFLTDTKLAISETYQKTDTDFLESESNAFRDDGSTASTAVLVGGHLYVANVGDSRAVVSKAGKAMALSEDHKPNRSDERKRIENAGGVVIWAGTWRVGGVLAMSRAFGNRLLKPFVVAEPEIQEELVNEDLECLVLASDGLWDVVENEEAVSLAKTEDLPESVARKLTEIAYSRGSADNITCIVVQFHHDKTE

SEQ ID NO: 28793 - protein, 185 aa, Oryza sativa (japonica cultivar-group)
MANDSLATGRVIGDVLDPFISTVDLTVMYGDDGMPVISGVELRAPAVAEKPVVEVGGDDLRVAYTLVMVDPDAPNPSNPTLREYLHWMVTDIPASTDATYGREVVCYESPNPTTGIHRMVLVLFRQLGRETVYAPAVRHNFTTRAFARRYNLGAPVAAVYFNCQRQAGSGGRRFTGPYTSRRRQA

SEQ ID NO: 28794 - protein, 504 aa, Oryza sativa (japonica cultivar-group)
MEETWLFLLFSISLVAVLLATARRRRSSSIKARLPPGPSPLLFLAKFLRLRRSIFDLGPLLRDLHARHGPVISIRLFGTTLVFVADRRLAHRALVQGGSTFADRPPLPELGRLFTSDTRDINSSPYGPYWRLVRRNLASEALSPARVALFAPARRRARDVLVRGLRDRGGDGSRPVELRPLLRRAMFELLLYMSLGARLAPEALEEVERLELWMLRAFTSFPVFSFFPAITKRLFRNQWAAHVAVRRRVGEIYVPLINARRAGDGDGDDPPCYTDSLLQLRVAEEGDRPLTDDEIIALCSEFLNAGTDTTVTLVEWIMAELVNRPDIQAKVHDEVRRRPELTEADLQAMPYLKAVVLEGLRLHPPAQFLLPHGVQSDAEVGGYVVPRGAELNVWVAELGRDEVVWTAAREFMPERFMDGGEVEVDVTGSREITMMPFGVGRRMCPGYTVGTLHAEYLVGSLVRELEWLPETEGEAADMAEELDFTTVMKHPLRARVLPRPSSLY

SEQ ID NO: 28795 - protein, 489 aa, Oryza sativa (japonica cultivar-group)
MDMVLGFLYQSIPRPPVSASASLSAAAATGDGGGDDRISLLPDDILRAVVSRLPAKDGARTAVLSSRWRRLWRSTPLVLVDTHLLPRRGGGRPARAGAASRAVADAVSRVLEAHPGPFPFVSLSCSFIGDDAQRGVAARWLDLLAAKGVEHLVFVNRPCPLPGVTLPAALFNCSSLRRLYIGSWELPDTASIPLPRAAAAAAFPNLRELVLGCVVMVDGDLPFLLAASPALETLAVFGILNTLRARLSSGSLRCAQFCLSFMEEVAVLDAPHLERLFLWRNIKNTRVKIGHAPQLRMLGYLQPGVHQLEIGNTIIKARTIVRPGTTVPSVNMLALHLHFGVRNEVKMLPSFLRCFPNVETLCIESEEAPGRTSNIDVNFWQEAGPIECVQSHLKMMILREFQGEESELSFLKFVGENARVLEKMVIVMKLGRYSAPEEVAAKVMDLQSAKWAREGNKLGFLISRLRAGGSAWSLRDGTDLSCDDPFMCL

SEQ ID NO: 28796 - protein, 210 aa, Oryza sativa (japonica cultivar-group)
MRGPSTTTMATFKQSFLKNLLSSLKSSSKNKAAMSTLSERKRAIKSSADIAMATARTGIAGAARWPHAILASSSSSSSSSSSSSSSSSMPRTTFPCKMMQGKVRRRCKSIVRRRTPLMSSSSEVARRLVKKRDKVLRRMIPGGELIADEISLLHEAMDYVVHLHAQVDVLRRVSRAAVARRSSASSSSSGGLAQLKERTVQISGETENPC

SEQ ID NO: 28797 - protein, 361 aa, Oryza sativa (japonica cultivar-group)
MEEHGKAAVGWAARDDSGVLSPYNFSRRAQKDDDVTIKVLYCGICHTDLHVVKNDWGNAMYPVVPGHEIVGVVTGVGAGVTKFKAGDTVGVGFFVGSCRTCDSCGKGYENYCPTMVITSNGKDYGGAATQGGFSDAIVVNEHYVLRVPAGLPLDGAAPLLCAGVTVYSPMVIHGLNAPGKHVGVVGLGGLGHVAVKFAKAFGMRVTVISTSPGKRREALEHLGADEFLVSRDAGQMAAAAGTMDGILNTVSAWHPVAPLFALMKPMAQMVFVGAPTRPLELPAYAIVPGGKGITGNCVGGIRDCQAMLDFAGEHGITAEVEVIKMDYVNTAMERLEKNDVRYRFVIDVAGSSLGGSGDDKI

SEQ ID NO: 28798 - protein, 499 aa, Oryza sativa (japonica cultivar-group)
MGRVRPLHHAARRLLLLFPRPRAFSSAAAAAPSREPLHVCVVGSGPAGFYTADKMLKGHEGAQVDIIDRLPTPFGLVRSGVAPDHPETKIVVNQFSRVAANDRCQFYGNVTLGRDVSLSELRKTYDVVVLAYGAESDRSLGIPGEDLRGIHSAREFVWWYNGHPDMCNLAPDLQSTDSAVVLGQGNVALDVARILLRCTSELAATDIADYALDALRGSTIKKVYLVGRRGPVQAACTAKELREILGLKNVHVFIKEADLVTLPADEEEIRNSRIKRRVYELLSKAAIAHKGKNNNGQKELHFVFFRRPTRFLPSEDGVTVGAVQLEKTCLKDDGVAGKQVAVGTGEFEDLKCGLVLKSIGYKSLPVEGLPFDKYRGIVPNLKGRVLSSESENATVEPGLYVVGWLKRGPTGIVATNLHCAEETVASILEDDKKGLFMGPSDSKKQGRRGLLEILEQKNIRFVPFDGWEKIDSKEKMAGELKNKPREKITTWNEILMASN

SEQ ID NO: 28799 - protein, 453 aa, Oryza sativa (japonica cultivar-group)
MGAIGEWRRGPVIGRGATATVSIATDRRTGGVFAVKSVDVARAGALRREQGMLSALASPFVVPCVGSGVSAAVDGSGGACYDLFLEYAPGGSLADEIKRCGGRCEEPLIRSRVGDVLRGLAYVHAAGIAHCDVKGRNVLVGADGRAMLADFGCARWMAAEDCNAGGVTIRGTPMFLAPEAARGEAQGTAADIWALGCTVIEMATGGAPWPRFADPVAALHHVAHSVDVPESPAWFSAEGKDFLARCLIRDPAKRWTAEQLLEHPFVASAASDSTSKAVQIEQRVSPKSILDQCLWESTSTDSDATVALAPADRLRALSAGASVAPDWTWSMDDWIAVCGGRADDHDTTPSPQPDTTTSFFRGDEASSDLVFPGGGELAAAADGPRGHDDDDDDDDHGVSSSPCSWRRSNSAISGCETERGAVAVAATVPLMAKSSEITGVERSIESRVASGSG

SEQ ID NO: 28800 - protein, 511 aa, Oryza sativa (japonica cultivar-group)
MAGGGVAALGVKKERAAEYKGRMTLAVGMACLVAAVGGAIFGYDIGISGGVTSMDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILEPRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 28801 - protein, 506 aa, Oryza sativa (japonica cultivar-group)
METLVCVAVWAVAMAMVVASVMWAYRWSHPRANGRLPPGSLGLPLLGETLQFFAPNTTCDISPFVKERLNRYGSIFKTSVVGRPVVVTADPEMNYYVFQQEGKLFESWYPDTFTEIFGRDNVGSLHGFMYKYLKSLVLRLYGQENLRAVLLDETDRACRTSLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWADYKSMTFTSQVTLEMVRLANIVPGIFRKALQDIEFKGYTIPAGWGVMVCPPAVHLNPEIYEDPLAFNPWRWQMQLTLVVLMLSGLSVGLIPKIYRVQQDKVEITGGSKHFMAFGGGLRFCVGTDLSKVLIATFIHHLVTKYRWKTVKGGNIVRTPGLSFPDGFHVQFFPKN

SEQ ID NO: 28802 - protein, 204 aa, Arabidopsis lyrata subsp. petraea
ITMEKIKDACENWGFFECVNHGIPHELLDRVEKMTKEHYKKCMEERFKESIKNRGLDSLHSQVNDVDWESTFYLKHLPVSNLSHVPDLHPDYRTLMKEFAGEIEKLAEELLDLLCENLGLEKGYLKKVFCGSKSPTFGTKVSNYPPCPKPDLVKGLRAHTDAGGIILLFQDDKVSGLQLLKDGDWVDVPPVKHSIVVNLGDQLE

SEQ ID NO: 28803 - protein, 190 aa, Arabidopsis lyrata subsp. petraea
HFLSFLLIPIMAIVAVELLRMGPEEILNVWNSLQFDLVQVLCSSFFVIFISTVYFMSKPRTIYLVDYSCYKPPVTCRVPFATFMEHSRLNLKDNPKSVEFQMRILERSGLGEETCLPPAIHYIPPTPTMDAARSEAQMVIFTAMDDLFKKTGLKPKDVDILIVNCSLFSPTPSLSAMVINKYKLRSNIKS

SEQ ID NO: 28804 - protein, 212 aa, Arabidopsis lyrata subsp. petraea
VVIDNLTNVWARLYVPMMTTTKSSVSKLLPLIVYFHGGGFCVGSTSWSCYHEFLARLSSRSRCMVMSVDYRLAPENPLPAAYEDGVNAILWLNKARNDNLWTKLCDFGRIFLAGDSAGGNIADQVAARLASTEDLTLKIEGTILIQPFYGGEERTESEKRVGNNKSSVRTLEGSDAWWRLSLPRGADREHPYCKPVKINSSTVIRTLVCVAE

SEQ ID NO: 28805 - protein, 498 aa, Emericella nidulans
MEPMLPEAGEAALLSSYAPQASGSMGVDPDPITGLVSTSAAPLVRVEEAPKFELESYIANYTGRTRFNRLYLIGTCSSYLAVDALKAAIAEAKSGKDVARYLRAVQALADVAPNEPEATIDSDWVERSQKVVKAETDRLEHELRGYKNNLIKESIRMGNEELGQHYHRIGDLTSAFKAYSRMRDFCTTPSHIASMLFKIINVAIERGDWLNVQSNVHRLRSQGGKPEEQAKHQPKISAAMGLSQLHSGSYLEAANSFIATDPSLGDTFNEVLTSNDVAVYGGLCALASMDRNELQRRVLDNSSFRNFLELEPHIRRAISFFCNSKFRPCLEILEAYRADYLLDIHLQRHVQVLYNRIRTKSIQQYLIPFNRVSLESMAKIFVLGNPTSQSSQSDSKSAFVQELISLIQDGTLDARIDLEKHVLVSTQGDKRIEVQEAVLDSLDNYVREAHLRLLRSNIIRAGLEVRPLGEDRRTKLEERGKKGHSAIGNLLRATGMKQ

SEQ ID NO: 28806 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIDEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 28807 - protein, 173 aa, Prunus armeniaca
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 28808 - protein, 450 aa, Prunus armeniaca
RLFVGLPLDTVSDCNAVNHARAIAAGLKALKLLGVEGVELPVWWGTVEKEAMGKYEWSGYLAVAEMVQKAGLKLHVSLCFHASKQPKISLPEWVSRLGESQPSIFLKDRSGQQYKECLSLAVDELPVLNGKTPIQVYHDFCESFKSSFAPFLGSTITGISMSLGPNGELRYPSHRRLVKNKIPGVGEFQCYDESMLSNLKQHAEATGNPLWGLGGPHDVPNYDQSPNSSNFFKDHGGSWESPYGDFFLSWYSNQLISHGDRLLSLASSTFTDAEVTIYGKVPLIHSWYKTRSHASELTSGFYNTSSRDGYEAVAQMFARNSCKIILPGMDLSDERQPQDSLSSPELLLSQITTACRKHGVEIAGQNSSVSGGHGGFQQIKKNLMGENVMDLFTYQRMGADFFSPEHFPLFSKFVWTLNQPALQSDDLPIEEEVVESVRSNSESVTHMQAA

SEQ ID NO: 28809 - protein, 179 aa, Alyssum lesbiacum
GFVNREALATTISSRKATFFSRSRSSLWIKGETSNNFINILDVYIDCDRDSIIYLGTPDGPTCHTGAETCYYTSVFDQLNDEEPIGNKLALTTLYSLESIISKRKEESTVPQEGKPSWTRRLLTDDTLLCSKIREEADELCRTLEDNEEVSNTASEMADVLYHSMVLLSKRDVEIEDVL

SEQ ID NO: 28810 - protein, 419 aa, Musa acuminata
  misc_feature (145)..(145): Xaa can be any naturally occurring amino acid
MLVLCIAPFLSLGLVGSLGRSHLHKRQQSHGRRGNGGHRLKSPVDSPADPPAAGTSTTVTPSNSSSDSCFFDVRSFGAVGDGVTDDTEAFRSAWRAACSVESATLFVPSDGVFMITSTIFPGPCQPGLVFQVILSTKITCSGCIXLLLWIQLIRFFMSCNLTVRDLRIENSPQFHIKFDACEDVHIEGLSINSPAFSPNTDGVHIENTRSVTIYNSMISNGWKRLLSGSGDDCISIGPGCSDVDIQNVTCGPGHGISIGSLGMHNSEACVSNVSVKNAVIRNSDNGVRIKTWQGGMGSVSDISFDTVYMENVRNPIIIDQYYCLSESCLNQTSAVYVSDVSYTGIRGTYDVRDVRPSTWHAATLFPLHPTSLYPEVGAASCPRRLSSPIHFCWNAYGATETLTIPSGVVLVGGLTSIDY

SEQ ID NO: 28811 - protein, 320 aa, Musa acuminata
  misc_feature (145)..(145): Xaa can be any naturally occurring amino acid
MLVLCIAPFLSLGLVGSLGRSHLHKRQQSHGRRGNGGHRLKSPVDSPADPPAAGTSTTVTPSNSSSDSCFFDVRSFGAVGDGVTDDTEAFRSAWRAACSVESATLFVPSDGVFMITSTIFPGPCQPGLVFQVILSTKITCSGCIXLLLWIQLIRFFMSCNLTVRDLRIENSPQFHIKFDACEDVHIEGLSINSPAFSPNTDGVHIENTRSVTIYNSMISTGWKRLLSGSGDDCISIGPGCSDVDIQNVTCGPGHGISIGSLGMHNSEACVSNVSVKNAVIRNSDNGVRIKTWQGGMGSVSDISFDTVYMENVRNPILIDL

SEQ ID NO: 28812 - protein, 512 aa, Sclerotinia sclerotiorum
MTILVAMGGFIFGYDTGQISGFLEMHVFLQRFGERSSNLVAHPAGYYFTNLSIGTLIGCLVAGPLANRFGRRTCIPPFVIGVVIQMAVGKGEWVGIVMGRWVAGLGVGGLSVLVPMYMAETSPVPVTGAVISCYQLFITIGIFTADCINYGTESFKSTASYRIPMGVGFIWAIILGGGILFLPETPRYNWNHGKPEKAQETMAAFYGVEESHPMIRTEVAEIEKVRAATVGDHPWYEAVTGPRMLYRVSLAMALQMLQQLTGANYFFYYGTTIFAGVGIKNSYVTAMILGGVTVGATFFGVYMARHFRRRECLYIAALWQTMCFLIFASVGQFIFKDAAEGSHTAKTSGTVMIVFAVLFIVGFASTWGPLVWACIGEMFPYRYRAVAMAFATSAKWFWNFMLAFFTPFITQDINYAYGYVFAGCNLAAFFVVFFFLVESSGKTLQEVDAMYLMGVKPIGSHAFQFDSELRESLGTDINTDAMNLETRNGRVQKVNEAGQGGVFHDEGGNVKE

SEQ ID NO: 28813 - protein, 350 aa, Sinorhizobium sp. BR816
MQIRELGPSGLKISVLGLGTMSWGEQNTEAEAHAQMDAALDAGINFVDTAEMYPVPPRVETHGLAERYIGSWIGKTGRRQDIVLATKPVGSARAGKANLPYVRDGRVSYTRANLFEAVDASLQRLKTDYIDLFQLHWPDRSTNVFQSLDYQYELDEDTVPILETLEALDALVKSGRVRHIGLCNETPWGLARFLYHAELQGLTRVISTQNPYNLLNLDFEYGLAEMALREQVGLIAYSPLAMGMLTGKYFDGERPTGSRLDLFGRFFRYSTERAQHAALAYTTLFREHGVDPVHGALSFVRRRPFVATILVGATSVQQLQHNIASLEVNLSREILDGIQSIYQRYGTPSP

SEQ ID NO: 28814 - protein, 336 aa, Eucalyptus cordata
  misc_feature (4)..(4): Xaa can be any naturally occurring amino acid
  misc_feature (7)..(7): Xaa can be any naturally occurring amino acid
  misc_feature (10)..(10): Xaa can be any naturally occurring amino acid
  misc_feature (32)..(32): Xaa can be any naturally occurring amino acid
MPVXALXGSXQTVCVTGAGGFIASWIVKLLLXRGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 28815 - protein, 336 aa, Eucalyptus globulus
  misc_feature (175)..(175): Xaa can be any naturally occurring amino acid
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAXAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 28816 - protein, 336 aa, Eucalyptus globulus
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 28817 - protein, 336 aa, Eucalyptus globulus
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 28818 - protein, 336 aa, Eucalyptus globulus
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 28819 - protein, 283 aa, Eucalyptus globulus
ELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 28820 - protein, 287 aa, Eucalyptus globulus
GHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 28821 - protein, 179 aa, Eucalyptus globulus
  misc_feature (5)..(5): Xaa can be any naturally occurring amino acid
EQMVXPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPT

SEQ ID NO: 28822 - protein, 286 aa, Fraxinus excelsior
MESKEEDVRVGANKFNERQPIGTAAQSQDKDYKEPPPAPLFDPGELSSWSFYRAGIAEFIATFLFLYIAILTVMGVSKSDSKCSTVGIQGIAWAFGGMIFALVYCTAGISGGHINPAVTFGLFLARKLSLTRAIFYMVMQCLGAICGAGVVKGFGKTLYMTKGGGANVVAPGYTKGDGLGAEIVGTFVLVYTVFSATDAKRSARDSHVPILAPLPIGFAVFLVHLATIPITGTGINPARSLGAAIIYNKDHAWDDHWIFWVGPFIGAALAALYHVVVIRAIPFKNK

SEQ ID NO: 28823 - protein, 487 aa, Mesoplasma florum L1
MKKLNFPKSFLWGGATSAAQIEGAWNIDGKSLTLPEIQPFIELKDKSDLSKLHNERNIIFKNALEGKFEGHYPKRFGIDFYHRYKEDIALFKEAGMNIFRMSISWARIFPNAFDEKPNLNGLKFYRDVFEECKKNNMEIMVTMSHFDYPFELMKSNPKGWLDPKVKELFLKYAKTILDEYADIVKYWLPFNEINIGAFAVEAGLGIMPDSKRTEAETKELSIKGLHNLFVAQAEIVKYAKKFKNIKLGCMMADMTTYSLDCNPVNVLANMKREQILKFMFYDVMIKGKYPGYFKNIVKTLTNKEITFDENELKLLKENPLEFISFSYYMSNTVSTDPNQEKTQGNLTSAGKNPFLKATDWGWQIDPIGLRYVLNQLWDRYEVPLFISENGIGVLETLNEENAVNDDYRIDYLSKHIEQIDLALKDGVDVFGYTMWTPIDLVSASTCEMAKRYGLIFVDYDDYHNGTGNRYPKKSFNWFKEFIKTKEI

SEQ ID NO: 28824 - protein, 464 aa, Mesoplasma florum L1
MNKFPKDFLWGASTSAYQFEGAIKQGGKVSSIMDRFDEQPSYPKGITGFKEASDHYNHWKEDVKLMSEMGFKSYRFSISWPRIIKNKEGEINKEGIKFYNDLIDELFKHKIEPIVTMFHFDIPDFIQEIGGVCTNEFTKQFEIYSEVLFKNFGSKIKYWLTINELNMFALAGQIIGVVPSDQKINSWQLMHHLNVAQAKAIVLCRKICPSAKIGPAPNISTVYPDSNKPLDYVAKLNLDMVRNWVYLDIVCRGEYSPIFINGLKKMGLEITITEEEKQILKNSKPDFIAFNYYSTMTVKMPTEESLKNTKKDQQQGLSMPGFGESVKNDKLEKTQFGWEIDPVGFRNTLREVYDRYQLPIMITENGIGARDVLEEDGKIHDNYRIEYYEKHIQQMALAIADGVEMIGYMPWSAIDLVSTHEGISKRYGFVYVNRDEFDLKDMKRYKKDSFHWYKELIKNNGENI

SEQ ID NO: 28825 - protein, 484 aa, Mesoplasma florum L1
MTKKLEFPSNFLWGGATAASQIEGAYNVDGKSLSAIEMIPFIELKDRKDLSQTRKLTTQDLLDSIENKKGLHYPKRFGIDFYHKYKEDIALFKEAGMKVFRMSVAWTRIFPNGDETEPNRKGLEFYKNVFEECKKQGLEIMVTINHFDMPFSIIQKYGGWKNRQVIDMYFKYSKTLIDEFHSYVRYWLPFNEINLGVLFSAMGLEGNNEEKSLAERLAGTYQDLHNQFVAQAKFIEYSKKFSNTKVGCMVADTTTYAIDCNPVNVLENQRKEQMKKFFYYDVMTKGEYPSYSKRYFKENGINIVKEKTDDELLKNNTVEFLSFSYYMSSTIAKEEVELTEGNLMKMGKNPFLVATEWGWQIDPIGLRYCLNQLWDRYHLPLFISENGMGVLETLNENNTVDDDYRIEYLSRHFEQMSEAIKDGVNLFGYTMWTPIDVVSAGSNEMSKRYGLIFVDYDDYHRGTGNRFKKKSFTWFQNFMKTSEV

SEQ ID NO: 28826 - protein, 483 aa, Mesoplasma florum L1
MKFEKKDFLWGGATSASQVEGAFDAEGKSLTIAEMRPFNPNLDRKSVDELNKYTRSDYEKSIDNKDNLHYPKRIGIDFYHRYKEDIALFKEAGMNIYRMSIAWSRIFPNGDEAQPNAAGIKFYKDVFEECKKNGMEVMLTIQHYDVPYPITKKYGGWSNKKVIDLYIKFATVIMKEYKDLVKYWLPFNEINVATLAPTTGLGIFREDFDTTEDYKNASWQGLHNQFYAQAKVIELAKSISSNIKIGCMVANMTTYSSDCNPVNIWENLATQQMQRYFYYDVMVKGDYPSYSKRYFKENNIKFETTPEEMEVIKNNNIQYITFSYYMTSTISKELKDAAGGNLMMGGKNPFLKATEWGWQIDPIGLRITLNELWDRYQLPLFISENGIGVIETLNENNTVDDDYRIEYLSKHFEQINEAIKDGVDVFGYTMWTPIDVVSLSTNEMSKRYGLIFVDYDDYHKGTGNRFKKKSFEWFKNFIKTKEL

SEQ ID NO: 28827 - protein, 452 aa, Mesoplasma florum L1
MKVIVLGTNHAGTTAVRTLKRLNPEIEVTTYDRNDVISFLGCGIALWVKGEVKDPNGLFYATPEILESEGINVKMKHEWVSIDADKKTVLIKNLETGETFEDNYDKVIVATGTWPLLPPIPGLDLKGVQICKNYDHAKKIQQANLDDSIKKVTVVGAGYIGVELVDAFVAHGKEVTLVDFADRIMPVYYDAEFTKHVEERMEKAGVKLALSQGVKEFKGANGKVTHVVTDKEEIPTDYVIFSVGVVAQTKQLEGVVELNDRKAILTNEYCQSSNPDIYAIGDCSTVFNKALNMEMPIQLATTAVRTGILAAANIVNGNKLASPGFTGANGIEVFGFKMASAGVSETSAKKMGLDYEAILLSDSDRPEFMSTYKEAWIKLVWDKKTRKIIGAQVASENNHTEIMYMLSLGIQKELTIDELPLVDIFFLPHFNKPYNFVTLAGLEVLGLNYFKK

SEQ ID NO: 28828 - protein, 320 aa, Mesoplasma florum L1
MYAFDYEDIQLIPNMCVVNSRSECNTSVTLGKHTFKMPVVPANMATVINEELSIMLAEKNYFYVMHRFDFDAVSFIKKMKEKKLISSISVGVKEQDFKMINELTELNLIPDYITIDIAHGHANSVKEMIEHIRTKMGDQTFIIAGNVATPQAVRDLEHWGADATKVGVGPGKVCITKLKTGFGTGGWQLGAIKWCSKAATKPIIADGGLRVNGDIAKSIRFGATMCMIGSLFAAHEESPGKNVTVDNVLFKEYYGSASEYNKGEKRYVEGKKELIKVRGKLMDTYKEMEEDLQSSISYAGGKTLKAIKKVDYVILKTSNF

SEQ ID NO: 28829 - protein, 478 aa, Mesoplasma florum L1
MNKKELQARVKRTKIITTTGPSTNEPEQIRELFENGMTTIRLNFSHGDYEEQGYRIAGAKKVREELGKPVSILLDTKGPEIRVGKFVDGKQEVTANQSITIYTDAESFKNKECLSGEMTVAYDMSVDLKIGDTILIDDGKLEMTVEEVKPGVVKAIAFNNHLVKTNKRVNLPGVDFSMPFLAQKDINDIKYGVEQGVDYIAASFVNSAENVKEIRDILAEANGSDIQIISKIESQVGIDNIDAIIEASDGIMIARGDLGLEIPYYDVPYWEKIMIRKCREAGKVVIVATQMLETMTENPAPTRAEVTDVYFATELGADATMLSGESAAGDYPFITVNTMATINKRAEIEFYKKAYYQTQLENAKNSTSGPRADIAMDLAERTRDGQYEFAVVLSRTGALLKTISKFRPNVTILGVSESERLWTAFGVWHSIFMNKTANLLELEENVAQISEIAKLWGAKSGSKILVVRNKDIREITVA

SEQ ID NO: 28830 - protein, 223 aa, Mesoplasma florum L1
MQKITIAPSFLSANFADLKNEIKRCKEANIEWIHYDVMDYDFVPNLTFGSKVLKDIVNSSDFKIDIHFMVKVKTKRFEDFFSEYIKCKPTMMTMHVESMSKKEINMFYNICKTNNIMFSLAVSPKTNIKVLNKWIDKLENILIMSVEPGFGGQSFIPEVLEKVKHLAELKKTNGYTYSIEIDGGINDETSKKAIDAGVEMIVAGSYLFESKNFLEKVESLKHD

SEQ ID NO: 28831 - protein, 328 aa, Mesoplasma florum L1
MKTRTLGKDLIVSEMGLGCMGLSYSQPPFPTKEEAIKFLREAYEQGVTFFDTAEVYGPFDNEELLGEAFKDIRDKVVIATKFGFSFDGKNITGVDSSRENIMRAIEGSLNRLQTDYIDLYYQHRVDPNTSIEEVAQVMKELMEQGKIKHWGLSEASAKTIRKAHAICPVTALQSEYSMFWREAETKVMPTLEELGIGFVPFSPLGRGFLTGTIKPGHIFPEGDFRNSIPRFNTPEYLENNFKLVKYVEELAEQKNTTPAAVALGWLLAQKPWIVPIPGTKKIERLKENNSGTNVMFSKEELENIKKMLDTIELVGHRYNDATESRVDK

SEQ ID NO: 28832 - protein, 426 aa, Mesoplasma florum L1
MIKVDLQHSGLSIADLNEAKVKKVHEMIINKSGKGNDFLGWIEWPKTFDKKEYEEMKKVASSLRNKIDVLVTVGIGGSYLGIRAADEMIRGINHSDKVQVIYAGHTMSSTYVAQLSEYLKGKKFGICVISKSGTTTEPGIAFRALEKQLIEQVGVEASKELIVAVTDSSKGALKTLADNKGYPTFVIPDDIGGRFSVLTPVGIFPLLVAGVNTDNIFAGAIKAMDELVQGDLTNEAYKYAAARNALYNAGYKAEALVAYELQMQYTAEWWKQLFGESEGKDNKGLYPTSMIFSTDLHSLGQWVQEGARNVLFETVIKVKEPVANMLVEADTDNYDGLNYLSGKSFHEINSTAIEGVIDAHVNTGKMPNIVLEFDKMNDVQFGYLVYFFEIAVAMSGYLLEVNPFDQPGVEVYKYNMFKLLGKPGVK

SEQ ID NO: 28833 - protein, 472 aa, Mesoplasma florum L1
MEKFKAIINNQEIESNSWLDIMDPTTDEVYAQVSALSAQEIDSAFKAAKAAQKKWEAIGIEKRTEFLIRWRDLLLKNEEDLATTMMHEIAKAYKDCLTEVRRTAEYIDLTISEYNDLQVLTFDKNSKGVTEDIVAEYKRIAKGVGVGISPFNYPINLAVSKLAPGLLTGNTFVFKPATQGSVVGIKIGQLAIEAGIPAGVLNVVTGRGRDIGDVIVTNPLIDFISFTGSVPVGRRLMEISSSKDLVLELGGKDAAILLDEHNLENIAKDIVAGAFSYSGQRCTAIKRVITTDNIADKITPLIKAEVAKLTVGLPNENPIITPMIDKKSADFVTDLINDAVKKGATLVYGGTRDKNLLQPTLLDNVTVEMNVAWEEPFGPVLPIIRINEIEDMISVANKSNFGLQTSIYSKDVDLAYKVAEQLEVGTVNINRRTQRGPDVLPFLGVKDSGFGVQGIKETILSTTRYRGIIIKK

SEQ ID NO: 28834 - protein, 469 aa, Mesoplasma florum L1
MEIKKLKKFDDDFLWGASISAFQAEGASTKDGKGLSIQDVKKISEKYSDFSVAADFYNNYKEDIALLKEMGLSSFRFSISWTRIIPDGDGEINKKGIIFYHNLIDELKKNGIEPIVTIYHFDLPFSLQQKGGWSNRDMIVKAFLKYSKVLFNEYAKKVKYWLTINEQNVMIMIGSKMKFLNGGDKKFNQNELYNQSHNMFIAQALVMEEMHNNFPNCLIAPALNIVSIYPNSNKPQDYLAAMNASVMRNWYYLDAIVRGEYNPIMYKYLEDNNFLPDFRKGDYEILKKAKPDFIAFNYYTSATVKSEINNFIEVEELIDQQRLFDVPGMFSYCENPNLEKTEYGWDIDSTGFRVTMREMYERYRLPLMITENGLGHSEQLNENNTVDDDYRIQYYEKHLNELRKCISEGIKIISYNAWTAIDIVSSHQGFSKRYGFIYVDRTEKDLKEMKRYPKKSFYWYKEYIKKIKY

SEQ ID NO: 28835 - protein, 380 aa, Mesoplasma florum L1
MRINMNKDLNGKIINEAITFDDVLLVPNYSEVLPHEVCLKTKLTKNIELNIPIISAAMDTVTESELAIAIASIGGIGIVHKNLTIEQQANEIKIVKSIKPTDEFPNACVDANGFLRVGGAVGVNDETLTRVEGLISAGIDVLVVDSAHGHSKGIIDVVKAIRVKYPNLDIIAGNICTVEGAEALYKAGADCVKVGIGPGSICTTRVVAGVGVPQITAINDVYNWSINKDVTLIADGGIKYSGDVVKALAAGAHSVMLGSMLAGTEEAPGQEVIINNKRYKTYVGMGSLAAMKRGSSDRYFQKGAKKLVPEGIEAVVPFKGTLEEVIFQLVGGLRSGMGYTGSNTIETLRHNAKFVKITGASLKESHPHDVEISAEAPNYK

SEQ ID NO: 28836 - protein, 509 aa, Mesoplasma florum L1
MDNKSLKQTQVENESELFINETPEQTAQRNKEAFVFSNNKAIRSIEKYFKFDTLGAIMKKEIIGGITTFLSLMYILTVNPGLVSGTPSINTGAGNMNYFGIFFATALVSGICCIIMGLFANIPVAMSTSMGMNALVSVNIGISGGLGFEGAMIVTMLSSVVFVTVSLTPLRSFIIKSIPKGIVLAIGIGIGLFIAYVGISSMGWLAQENGIPMASVATLKDNYLPIILGSITLLLILFLAFKKIPGAVAIAILSMSVIAIILASTLPSDSKAISLLGSADLRKWEGWNYDFDGFAWNWTSTFKAFGNAKIWTSPVTYISIFVVMLINFFDATGTMAAFTHQLDQKTNQHKEISQKALVIDSMGTMMASVTGTTPLGVFAESAAGIEQGAKTGLAAVVNGILFLLAIIMFPIFKLIPQPITSAACVYIGIMMIKEAAHVEWDKPEFLVPTFLSILFMIATYEIANGVAMAFIGYSFMMMITAKAKKVHPAVYCLSFLFIIYFIAFAFIQI

SEQ ID NO: 28837 - protein, 374 aa, Mesoplasma florum L1
MAKRDYYEVLGVSKTSTEQEIKSAYRKLAKKYHPDMNKESGAEEKFKEVNEAASVLLDADKKAKYDQFGHAAFDGSSGFGGSGFGGFEDFFSNMGGGMDFGDIFSDLFGGGRSGRSSRRGPSKGQDIGLEATLTFKELVFGVNKKTILNLVKTCTKCDGVGAENPSDVHICTKCNGAGQIIVNKQMGPFQVQNQVTCDKCNGVGKEFKSKCKNCHGKGVESKREEVEIPLPKGLWPGQQFVMRGKGHASLEGGIPGDLYITIGIVKSDVFELIPNSNDLIMNYNISYLDAILGNEVIIKTLDGPVRLKIPKGVYSGQLIKVHDKGLYKNQTSDKRGDLLIKISISIPTSVSKEEKKILKELEQLSNFEPKNIID

SEQ ID NO: 28838 - protein, 452 aa, Mesoplasma florum L1
MLKFPKNFHIGASMSAMQTEGKGITEIGDLTFDAYFKENPELFYHGVGPDLTSDITRHYKDDIEKFKYIGLDSVRTGFSWARLFPDGINLNKEAVKFYHDYIDEYLKNDIEIIMTLFHFDMPLWAHELGGWESREVIEKFISYCEFVFKEYGSKINYFVTFNEPLVPVFEGYVGKMHYPAKDSPKEAVAQAYGIFLAHAKAVKLFKELKIDSKIGVVYNWNFTFPFSDSAEDKISAEIYDAYVNRGPLNIMYNGNINPIIIKTLEEYNITPFHTSEEIEIIKQTEIDFLGVNYYFPCRVKTNENVKNRWALDQMHIEIPADAKINPFRGWEIYPEGLYDISIAIKKELNNIPWYIAENGMGVENEDRFRNENGQIDDDYRIEFLETHMSELKRGLDAGSNCFGYHIWAAIDCWSFRNAYKNRYGLIEVDLKDQSRKFKKSAYWYKELIENKE

SEQ ID NO: 28839 - protein, 480 aa, Mesoplasma florum L1
MEKLSKDIMLGTSISANQAEGSWNINGKGLSIAEMRRYNPSLDQKDINTERKMTEDKIKEALDPNSKFYYPKKNGIDFFKHFKEDIKLLAEMNNDCFRTSIAWTRIFPNGDETDPNEEGLKFYDQLIDELIKNNIEPIITISHYEMPYYLVEKFGGWKNRALIDFYTKYAKTLLIRFKDKVKYWIPFNEMNAANYSVWAGAGLRDDEHENILGLSIYALHNIFVANASIIKEGRKINSEFKFGSMIATLLSYADDSNPLTVLKADKDQQMKIYAYFDVLHRGEYPKYALNLYKSFGMNLKISEEDRIVLKENTCDFVGFSYYMSGVVSLNEDSLTEGNLVKVGKNKHLKENDWGWQIDPVGLRILMNRLYDRYQKPLFILENGVGFKEENPNLEMINDDYRIEYLKSHLQQVQKAVDDGVECIGYTMWSPFDIVSHGTSEMAKRYGLIYVDQDDMGNGTKKRIPKKSYYWFKEVCEKREI

SEQ ID NO: 28840 - protein, 189 aa, Mesoplasma florum L1
MKLHPLVKNVLFTEEQIKERTIEVAKEIKSFYEQNDKEDQSLLVIGLLKGCIPFYQTFCMNFDFLIDMDFMVVSSYLGGTKSSGEPKINLDVNMSVKDRNILIVEDIVESGLTLEFVQNYLLNKGAKSVKILTMLDKPTERKVDIKPDWTCFSIAKHFVIGYGLDYQEKLRNLPYVAVCDTDKLADWKW

SEQ ID NO: 28841 - protein, 453 aa, Mesoplasma florum L1
MSRIEKIIAREVLDSRGTPTVEVELWTEFGGYGIAKAPSGASTGENEALELRDGDKARYNGKGVLKAVANVNDKIAPALIGHDVQDQLGLDRVMIKLDGTEFKKKLGANGMLAVSLAAAHAAASELEVPLYRYIGGVQAKRLPVPMLNVINGGEHADSAIDFQEFMIMPVGAPTFKEALRWSSETFQALKSLLHDKGDITAVGDEGGFAPHFSWAYAKQDLASFKAKTPAEIALDLLVEAITKAGYKVGKDGIMIAMDCASSELYFEDKKYHFKKIEKVTGQEWAFTTEEMIAYLEKLVNNYPIISIEDGLSEKDWDGFVQLTEKIGDRVQIVGDDLFTTNPRFIKEGISKDAANSTLIKLNQIGTLSETVEAITMTQKAGWTAVVSHRSGETEDATIADLAVAFNAGQIKTGSMSRSDRIAKYNRLLQIEDQLGEDAIYDGYATFYNLKINK

SEQ ID NO: 28842 - protein, 275 aa, Mesoplasma florum L1
MLLSFLFHWFSYCYIIKNVQKNKRRNIMRQKVIFGNWKMNGTNAELVTFLKKVDKAAKKSDVVAGLGLPFTLLSKGIEKAKNVKVAAQNVHFAEKGAFTGEVSISMLQEVGVQYVIIGHSERREMFAETDETVNKKATALLAAGITPIICCGETLETKEAKKTVTFVNAQIKKAYKGISAEDALKTIIAYEPIWAIGTGKTATSEDAEKVCEAIRKNLTKIYDEKTAQQITIQYGGSVNPSNIAELMSQPNIDGALVGGASLKADDFIALINYKK

SEQ ID NO: 28843 - protein, 350 aa, Mesoplasma florum L1
MENNILELRNVTKDYDGKVVLKGIDLNIKEGEFITLLGPSGCGKTTTLRIVAGFEKPNSGQIMFEGKDLLPIPINKRQFNTIFQSYALFPHLNVFDNIAFGLRTKKTKKDILQREVLKQIRQVGLEGFEDRNINDLSGGQKQRVAIARALVMKPKVLLLDEPLAALDVQLRQHMREELKRLQREIGITFLMVSHDQEEALSISDRVVVMNEGSIQQIGTPEDIYNEPENLWVAKFIGQSNIIEDGIFIEDNKVQIDGKTFVCDDTNFGENEKSIDIVIRPEDIEIKKTNAGFFNGTVMHTTFKGVHWELLVETTKKRIWKIHTTQAFKVDDKVSIKWNDEAIHVMWKEVE

SEQ ID NO: 28844 - protein, 404 aa, Mesoplasma florum L1
MNYNLKKTLKDINVKGKKVLVRVDFNVPLKDGVITDDNRIQAALPTIKYLVENGAKVILFSHLSRIKSEDDKKTKSLAPVAKRLEEVLAQSVNFVNQTRGTELETAINALNEKEVLLFENTRFEDVKDGEVVKAESKNDPELGKYWASLGDVFINDAFGTAHRAHASNVGIASNISESALGFLVQNEIEMLGKGIDAPERPFVAILGGAKVSDKIGVIDNLLTKVDKILIGGGMTYTFHKAMGLEIGNSLLEADKVELAKEYLEKANGKIMLPVDSLCAPEYADVAPTLCGENVPAGMMGLDIGPKTIEMYEKELANAKTVVWNGPMGVSEFENFKAGTVAVCEAAAKRKADGGFTLIGGGDSAAAAIKLGFKDEFSWISTGGGASLEYMEGKELPGIAAIQNK

SEQ ID NO: 28845 - protein, 483 aa, Mesoplasma florum L1
MKFIKDDFLWGGATAASQVEGAYNEGGKTLTLLEMKPFLPIKNRKAIHFGGQTKEEMLDSIENKQNLHYPKRFGIDFYHRYKEDIALFKEAGMNIYRMSIAWSRIFPNGDDEKPNEAGIDFYRNVFEECKKAGIKVMVTMHHFDTPYEITKKYGGWTNRKVIDLFVKYAKTLFEEFDDVVDFWLPFNEINVAIWSTEVGLGVFESDFKSKNERDQAAYQGLHHQFIAQAKVIELGKKMCKLKTKFGCMVANITTYALDCNPINEIENLKSQQISRWFFYDVVAKGEYPTYIKRYFTENNINIIMENDDEKVLKNNTVDFISFSYYMSATVAVQGKDKASGNVSTGGKNPFLEATEWGWQIDPIGLRVSLNQMWDRYQKPLFISENGIGVLENLDSNNTVKDDYRIDYLGKHFEQINEAIKDGIDVFGYTMWTPIDVVSASTNEMSKRYGMIYVDYDDYHNGTGNRFKKKSFNWFQNFMKTKEF

SEQ ID NO: 28846 - protein, 466 aa, Mesoplasma florum L1
MNKFPKDFLWGAATSAYQVEGGIYQGGKVPSSMDPSSKKHANKEITDFSVAADHYNHWKEDVALMAEMGFKSYRFSISWPRIIKDKEGNINQEGIDFYNNLLDELIKNNIEPVVTIFHFDIPMFVEDDGGLESKNVYKHYERYCSVLFKNFGSKVKYWLTVNELNVMVLVSQIINTNKEKSSSNEWQVMHNMNVVQAKAILMCREMCPGVKIGPAPNISVNYPASCKPEDFTAKLNMDLLRNWVYLDILCRGSYSKKFLKYLEENNKQIKTTEEEMELFKVAKPDFIAINYYSSGTVEAINSSNGDDGATNNDQQSGFAFKGFAKSVKNPNLQKTQFGWEIDPVGFRNTLREVWERYQLPIMVTENGIGAKDVLTEDGKVHDDYRIDYYKKHIHQMGLAIEDGVEMIGYMPWSAIDLVSTHEGISKRYGFIYVNRDEFDLKDMKRIRKDSFYWYKELIKNNGDYNE

SEQ ID NO: 28847 - protein, 394 aa, Mesoplasma florum L1
MAKEAFDRSLPHVNIGTIGHVDHGKTTLTAAITKVLADKGGAEFKDYANIDNAPEERERGITINTSHVEYKTENRHYAHVDCPGHADYVKNMITGAAQMDGGILVVAATDGPMPQTREHILLSRQVGVPKIVVFLNKCDMVDDEEMIDLVEMEVRDLLSAYDFDGDGAPVIRGSALGALNGEAKWVAAIEELMAAVDEYIPTPTRDSDKTFLMPVEDVFTITGRGTVATGRVERGTIKVNEEVEIVGLVEEAKKTVVTGLEMFRKLLDFAEAGDNVGALLRGVDRESIERGQVLAKPGTIKPHTKLQASVYALTTEEGGRQKPFFNKYRPQFYFRTTDVTGEVILPAGTDMVMPGDNVEMTVELIKPIAVEDGTKFSIREGGRTIGAGTVISVQ

SEQ ID NO: 28848 - protein, 227 aa, Mesoplasma florum L1
MNNKKVAVSIYVFNFLEIGKKIDELIEAGMEWIHVDIMDGNFVNNYALCQKFCKDIKDKYPKIKVDAHMMCSNSEKYIESFAEAGCDYFIFHYETLTDKNPITVNNIINKIKSYNMKPIIALNPETSFEHIKTYCDDLYAVMCMNILPGFNGQKIIESSYSKINIINKYRKENNKVFKIMTDGGLREDTYKEILDAGADIVVVGAFVNVENNKLKGQFEKIKNYEIK

SEQ ID NO: 28849 - protein, 442 aa, Mesoplasma florum L1
MKTVIIGGSATGMGVAAKLKRLNEQNEIVVIQDKDYVSLGACGIPYYIGHNFENPETLIARKIEKFEESQISVISNSKVNKIDFENKKVIFEESQISYDNLVIAVGAKPITPEIKNIDAKNIFTVNSKEDAIEIRKTINDDSNVLIIGSGLIGLEMVENIKHSTAAKISIIEKADRVLKNLFDEEFSELVEKEILNQEIELFKNNEVIEFVKDNNGKVTGAKTINGEIIKCDVVILSIGVIPNTSFLRDTDLELENNGAIKINEYCETNIPNVYAGGDCCSSLSYLYKNTRTFYLATVANKQAKIIANNVNKNKSSKFVGALGTTIIRFFDLELARTGENRMFIDMNSIETKEVLIKDKDHTNYVTGQEDIWLKVIIDVKTKEIINVQMIGKNKSVLRIYGLVGLIWSRSKVDETLEQIDLPYSPPFSRTTDIIHIALSKLI

SEQ ID NO: 28850 - protein, 123 aa, Oryza sativa (japonica cultivar-group)
MEDFYVTIPYGAAVLVGGVAGYLKRGSKASLAAGGGFGGALLLAGALSARAFARGHPSGSLFAAVLQTVCAVALTVVMGIRYIKTRKVMPAGIIAAVSALVLIFYIYKISNGGNKVYVPVSAE

SEQ ID NO: 28851 - protein, 271 aa, Oryza sativa (japonica cultivar-group)
MATLSSCSRLSTGGGAVQRRPRRPASAATITCHRSSSSSSSARVVRTGAAAAPAAATAPAVPQTNECSLPTWAEFELGKAPVYWKTMNGLPPSAGEGLILFYNPAATKMTPNAQFGIAFNGGFNQPIMCGGEPRQMTLQERGSADPPIYTIRIRVPQHAMTLVFSFTNGVDWDGPYTLKFRVPKPWLNKPLSFFNEGLADELNREGACDRAIFPDENVVITSCEMGSYYEEGGDRCKLDIVSGCMDPNSHMFDPLATVDDGSCPMDSDSEE

SEQ ID NO: 28852 - protein, 248 aa, Corynebacterium diphtheriae
MTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 28853 - protein, 510 aa, Vibrio vulnificus YJ016
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 28854 - protein, 1012 aa, Desulfovibrio gigas
MLIKRRAFLKLTAAGATLSAFGGLGVDLAPAKAQAATMALKTVDAKQTTSVCCYCSVGCGLIVHTDKKTNRAINVEGDPDHPINEGSLCAKGASTWQLAENERRPANPLYRAPGSDQWEEKSWDWMLDTIAERVAKTREATFVTKNAKGQVVNRCDGIASVGSAAMDNEECWIYQAWLRSLGLFYIEHQARICHSATVAALAESYGRGAMTNHWIDLKNSDVILMMGSNPAENHPISFKWVMRAKDKGATLIHVDPRYTRTSTKCDLYAPLRSGSDIAFLNGMTKYILEKELYFKDYVVNYTNASFIVGEGFAFEEGLFAGYNKETRKYDKSKWGFERDENGNPKRDETLKHPRCVFQIMKKHYERYDLDKISAICGTPKELILKVYDAYCATGKPDKAGTIMYAMGWTQHTVGVQNIRAMSINQLLLGNIGVAGGGVNALRGEANVQGSTDHGLLMHIYPGYLGTARASIPTYEEYTKKFTPVSKDPQSANWWSNFPKYSASYIKSMWPDADLNEAYGYLPKGEDGKDYSWLTLFDDMFQGKIKGFFAWGQNPACSGANSNKTREALTKLDWMVNVNIFDNETGSFWRGPDMDPKKIKTEVFFLPCAVAIEKEGSISNSGRWMQWRYVGPEPRKNAIPDGDLIVELAKRVQKLLAKTPGKLAAPVTKLKTDYWVNDHGHFDPHKIAKLINGFALKDFKVGDVEYKAGQQIATFGHLQADGSTTSGCWIYTGSYTEKGNMAARRDKTQTDMQAKIGLYPGWTWAWPVNRRIIYNRASVDLNGKPYAPEKAVVEWNAAEKKWVGDVPDGPWPPQADKEKGKRAFIMKPEGYAYLYGPGREDGPLPEYYEPMECPVIEHPFSKTLHNPTALHFATEEKAVCDPRYPFICSTYRVTEHWQTGLMTRNTPWLLEAEPQMFCEMSEELATLRGIKNGDKVILESVRGKLWAKAIITKRIKPFAIQGQQVHMVGIPWHYGWSFPKNGGDAANILTPSVGDPNTGIPETKAFMVNVTKA

SEQ ID NO: 28855 - protein, 362 aa, Perilla frutescens
MVTSAMGPSPRVEELARSGLDTIPKDYVRPEEELKSIIGNILAEEKSSEGPQLPTIDLEEMDSRDEEGRKKCHEELKKAATDWGVMHLINHGIPEELIDRVKAAGKEFFELPVEEKEAYANDQAAGNVQGYGSKLANNASGQLEWEDYFFHCVYPEHKTDLSIWPTKPPDYIPATSEYAKQLRALATKILSVLSIGLGLEKGRLEKEVGGAEDLIVQMKINFYPKCPQPELALGWEAHTDVSALTFILHNMVPGLQLFYEDKWVTAKCVPNSIIMHIGDTLEILSNGKYKSILHRGLVNKEKVRISWAVFCEPPKEKIVLQPLPETVSEVEPPRFPPRTFAQHLKHKLFRKTDGDLDEKPTY

SEQ ID NO: 28856 - protein, 499 aa, Hordeum vulgare
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 28857 - protein, 414 aa, Methanococcus maripaludis
MFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 28858 - protein, 290 aa, Vicia faba
MEAKEQDVSLGANKFPERQPIGIAAQSHDDGKDYKEPPPAPLFEPSELTSWSFYRAGIAEFVATFLFLYITILTVMGVNKSQSKCATVGIQGIAWSFGGMIFALVYCTAGISGGHINPAVTFGLFLARKLSLTRAVFYIVMQVLGAICGAGVVKGFEGKAFFGEKGGGANFVAPGYTKGDGLGAEIIGTFVLVYTVFSATDAKRSARDSHVPILAPLPIGFAVFLVHLATIPITGTGINPARSLGAAIIFNQDRGWNDQWIFWVGPFIGAALAALYHTVVIRAIPFKSRS

SEQ ID NO: 28859 - protein, 421 aa, Thermoplasma acidophilum
MGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 28860 - protein, 387 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTDKCLWNEGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 28861 - protein, 383 aa, Daucus carota
MAASTFLYHRHQQPFYPKSLVFDPSIIKNELNIPQEFIWPDHEKPSSHTPQLDVPLVDVGGFLSGDPVAAEKASKLVGQACREHGFFLVTNHGVDGNLISDAHKSMDLFFELPLMEKQKAQRKLGEHCGYASSFTGRFSSKLPWKETLSFEHSTKKTSSTLVEDYFASALGKDYAKLGKVYQDYCNAMSRLSFGIMELLAISLGIDRSHFKNFFEENNSIMRLNYYPTCRRPELTLGTGPHCDPTSLTILHQDDVGGLEVFVDNQWQSIPPNPSSFVVNLGDTFMALSNGKYKSCLHRAVVNKQNPRRSLAFFLCPQKDKVVRPPTELVDQDNPRLYPDFTWSALLEFTQKHYRADMNTLQAFSSWLTTFNNKEHLGEGHVIN

SEQ ID NO: 28862 - protein, 344 aa, Daucus carota
MLTEESYQTQYLDLNSIKELPESHTWTSLQDDCTDCLSNESESLPIIDLNDPDVLALVRHACETWGVLQVKNHGVSLRLLEDMEAATTKLFSLPIEQKLKVSLSSSNDISGYRLPKISPFFPKFMWREGFTIFGSPVEHAVKLWPQDYKPFCDLVEEYGKEMKNLAERLMWLMLKSLGITEEDINWSSLGGAAIQLNSYPVCPDPDRAMGLAEHTDSSLLTILYQNNTTGLQIFREGTGWLTVQPHTGVLVVNIGDLMHILSNGLYPSVLHRALVNRKQQRISVAYIYRPPANVLISPLPKLVDHYHLCLFRPITWTEYLELKSKHFTNTLSLIRISGSPNVVS

SEQ ID NO: 28863 - protein, 353 aa, Daucus carota
MPSRVSDSLALHPVFQHNHNQYLDLNSLEELPDSHAWSSELDKLSSSPDDHGESNLPVIDLSDSINGPKHLVHACKTWGAFQLINHGISNQLIDSMEAATRKLFSLPIEQKLKAERQEGGCGYGPFRISSFFPKRMWSEGFTIVGSPLQHARLLWPEDYSVFCDVTEEYQKEMKKLAGKIMWIMLEALGITKEDIIWAGPNGEFEASGAALQLNSYPVCPDPDRAMGLADHTDSTLLSILHQSNQSGLQVFQEEMGWVTVPPVEGALVVNIGDLLHILTNGSYPSVLHRVTVNRERHRYSMAYLYGPPHSAEISPLSKLVDHQHPPLYRPVTWSEYLGMKAILFYNALSSLRL

SEQ ID NO: 28864 - protein, 439 aa, Klebsiella pneumoniae
MHDKYDVLIIGGGPGGYVAAIRAGQLGLRTVLVEKQHLGGICLNWGCIPTKALLHGAEVAHTITHASQLGISVGEVNVDLQKLVQFSRTVSQQLTAGVAYLLKKNGVRVIDGTARLRGKGQITVEDARGEARDYRADHVILATGARPRALPGIAPDGEHIWTYFEALRPKLLPKSLLIIGSGAIGVEFASLYNDLGCKVTLVELASQILPVEDAEVSAAVRKSFEKRGIQIHTQTLVTQVQLTDTGVRCTLNNTGGEYSQDVERVLLAVGVQPNIEDLGLETLGVELDRGFIKTDAACRTNVFGLYAIGDVAGPPCLAHKASHEGVLCVETLAGVEGAHPLDRDYVPGCTYARPQVASLGLTESTALARGRPIRIGKFSYQSNGKALVSGETEGFVKTIFDAETGELLGAHMVGAQVTEQIQGFASPVTWRPQTKASCR

SEQ ID NO: 28865 - protein, 327 aa, Oryza sativa (japonica cultivar-group)
MCSFGGRILPRPGDHQLRYVGGETRIVSVPRAATFDALVAALAKVAPALFPAGGPSPALRYQLPQDDLDALISITSDDDVDNLIEEIDRFQGLAAASIKPPRLRLFLFASSPADHASAAAFGSVLSGAGGDSSSDQWFVDALNAPAPAPIERGRSEASSIISEVPDYLFGLDTTSDEPSPGPGGARPKVDTEMAHVEDDAPVLSRGTPPAPYVTESAPWPAPPPPYMTQQVYYVPVRPVHYLDPSSQGGYMPGPVYHIVGGGGSEARGDLYSTGGSVSAAAGVGGVYGVPHPMQPFPPMMYGHAPPPGAVVYSSEGKPPMEGGAHAS

SEQ ID NO: 28866 - protein, 493 aa, Oryza sativa (japonica cultivar-group)
MAAAAEGDEDPRWRRCNTDCVYFLASPFTCTKGSKCEYRHADGARFNRRNCWYWFKGNCVNPSCTFRHPPLENLNKTKSLADPLSLCSTSVKAANPCYFYYNSHCSKGDNCPYLHEPLTSNDAVGTSCKATTSNPAVSKSYVGDEMVEESKDTITNPCQDTSCHIKEVPVSINPEFGEAEAVSGALETSTDIDEYMKCSAVSDLNSGDSTMDHTEQDERDSSPGFDVLVDDCLSNKSDLEHQLTTESDNKVLHAEYGIRDPVLYDMYYHDPEYYNYEPEFCGLDDRQGYLYLCQPNGAHEHESEITLGHLLPQNTEVTSDEYDRRFFNPRNFTSSVADTNFVHQHTQIRHISKRRPENRKGAKGKKDCIKRSRCLEPKNSTQQIESMPTRQRKDYLMGECPQPANHATFRGRRKKNRGKQQHVLSAKSSEHPTADFTGPKTLAQIKEEKCKSNSSFSHSTACTPNVRSFSDDFEGPKSLTELLMTKSRSSVGK

SEQ ID NO: 28867 - protein, 501 aa, Oryza sativa (japonica cultivar-group)
MKPSSPSPSPPHGAAAVKQPASSPDARLTPSSVVAAAAVGIGVTPPRRSCDDAASCVVNDVDAFARTIASIRSKPASAAAAAASSSSDGGGDHLATVLAHYAARWLPDVASSPSGRFLLPPQSPTATWIRKRLLLESLVAALPPDGGDGDDGGGGVTCDFLLRLLRAGSMAGADAALLADLEARAARRLDQASLGAVMIPAFRAAAGDAPGAGATLLDVPLVLRLVRGFLREGGKAGAGGGGGAAAACRVARLVDAYLAEAALEAGLRPAEFEELARAVPAHARAADDGLYRAVDTYLKAHPHAGKEERRSLCRLIDARKLTAEAAAHAVQNERLPVRCVVQVLFSEHGSKLTRLAEWTTGSFRSLQSRSPADLIVTGGGANGGARCPSKREVAAQHHELRRLREDVSRLQVQCHALQAQVDRLSSERRRRPGGLFKLLFGGGGGAGATGAVVVDDSDSGLDRTPLSGKKGVVVRATAAAAAASTPASGTPAVARWRRSHS

SEQ ID NO: 28868 - protein, 217 aa, Oryza sativa (japonica cultivar-group)
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVSTEDAKAFAEKENTFFMETSALESMNVENAFTEVLTQIYHVVSKKALDIGDDPAAPPKGQTINVGGKDDVSAVKKSACCSSA

SEQ ID NO: 28869 - protein, 325 aa, Rhizopus microsporus var. chinensis
AGVGTVPMTDYGNDIEYYGQVTIGTPGKKFNLDFDTGSSDLWIASTLCTNCGSRQTKYDPNQSSTYQADGRTWSISYGDGSSASGILAKDNVNLGGLLIKGQTIELAKREAASFASGPNDGLLGLGFDTITTVRGVKTPMDNLISQGLISRPIFGVYLGKAKNGGGGEYIFGGYDSTKFKGSLTTVPIDNSRGWWGITVDRATVGTSTVASSFDGILDTGTTLLILPNNIAASVARAYGASDNGDGTYTISCDTSRFKPLVFSINGASFQVSPDSLVFEEFQGQCIAGFGYGNWDFAIIGDTFLKNNYVVFNQGVPEVQIAPVAE

SEQ ID NO: 28870 - protein, 364 aa, Enterobacter cloacae
SAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLWHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSETDLAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 28871 - protein, 480 aa, Haemophilus influenzae
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGTIVSIWNTAHNIGGMVPGAMVLLASAIFFSTHGIEAQAKDVWQQSLYFPGIAAMIFAIPVYFVMRDTPQSCGLPSIEKWRNDYPDDYNEKTYENDLTAKEIFVTYVLKNKLLWYIAIANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYENPYQLTDFVLMTLIGFLIYGPVMLIGLHALELAPKKAAGTAAGFTGLFGYLGGTVSASAVIGWAAQHYGWDGGFYVMIGGGVLAVLLLLIVMVEEGKHKAKLGDTYGTK

SEQ ID NO: 28872 - protein, 404 aa, Emericella nidulans
MASQVQPGQKPKVQPCRYKTGKTLGAGLYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGLITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 28873 - protein, 173 aa, Pseudomonas aeruginosa
MGSPCHFALFDLQPGFRIDLEALGNRYRELVRTVHPDRFADASEREQRLAQAKAAELNDAYQTLKSVPRRALYLLALRGDSLPLEATVQDPEFLLQQMQLREDLEDLQDSADLDGVAQFKRQLKSAQQRLEDDFADCWDDATRRDLAERLVRRMQFLDKLAQEVRQLEERLDD

SEQ ID NO: 28874 - protein, 477 aa, Corynebacterium glutamicum
MAFETPEEIVKFIKFIKVEFVDVRFTDLPGTEQHFSIPAASFDADTIEEGLAFDGSSIRGFTRIDESDMNLLPDLGTATLDPFRKAKTLNVKFFFHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDYPHRSDVFTEDLIEAYIQYKYDNEISPVRLRPTPQEFELYFDC

SEQ ID NO: 28875 - protein, 470 aa, Oryza sativa (japonica cultivar-group)
MRAKKMFFGFSVSLILINLASIMERADENLLPAVYKEVSAAFNAGPTDLGYLTFLMNFLKSIASPLAGVLALQYDRPAVLAIGTVFWAVSTGAVGVSQYFQQVAFWRAVNGLGLAIVIPALQSFIADSYKDGTRGAGFGLLSLIGSIGGIGGSILATIMAGRDYWGLPGWRFAFLMVAFLSLLIGLLVYFYTVDPRKVSPSHFGDDEDHHERSHLIGNGIFPPQSIWKDSWIAARSVMKVRTFQIIVLQGIVGSLPWTAVVFFTMWFELIGFDNSSSAALNSMFAIGCASGSFLGGVIADRLSKYYPDSARIMCAQFSAFMGIPFSWILLTVIPQSVDYWSAFAVTLFLMGITISWCATCANNPMFAEVVPPKHRTMIYAFDRAFEGSFASLAAPAVGMVTEKIYGYNAKTVNLENGSVAGAYALSRGLLTMMIVPFGLCFLFYSPLYFVFKRDRENVRRLPSVKEQELI

SEQ ID NO: 28876 - protein, 497 aa, Solanum tuberosum
MDKKHLCAALLLWAITCSALPASSGDLLRIGLKKHRLDVNSIKAARVAKLQDRYGKHVNGIEKKSSDSDIDIVPLKNYLDAQYYGEIGIGSPPQKFKVIFDTGSSNLWVPSSKCYFSIACWIHRDGESCSIRYETGSISGHFSMDNVQVGDLVVKDQVFIEATREPSITFIVAKFDGILGLGFQEISVGNTTPVWYNMVGQGLVKEPVFSFWFNRDANAKEGGELVFGGVDPKHFKGNHTYVPLTQKGYWQFNMGDFLIGNTSTGYCAGGCAAIVDSGTSLLAGPTTIVAQINHAIGAEGIVSMECKTIVSQYGEMIWDLLVSGVRPDQVCSQAGLCFVDGAQHVSSNIKTVVERETEGSSVGEAPLCTACEMAVVWMQNQLKQEGTKEKVLEYVNQLCEKIPSPMGESAIDCNNISSMPDITFTIKDKAFVLTPEQYILKTGEGVATICVSGFAALDVPPPRGPLWILGDVFMGPYHTVFDYGKSQVGFAEVHNSL

SEQ ID NO: 28877 - protein, 221 aa, Streptococcus pneumoniae
PRSSIWGNDQEYREKSAKAFAILLHLMRGTPYIYQGEEIGMTNYPFETLDQVEDIESLNYAREALEKGVSMEEIMDSIRVIGRDNARTPMQWDESKNAGFSTGQPWLAVNPNYEEINVQEALANPDSIFYTYKKLVQIRKENSWLIRADFELLDTADKVFAYIRKDGDRRFLVVANLSNEEQDLTVEGTVKSVLIENTTAQEVFEKQILAPWDAFCVELTD

SEQ ID NO: 28878 - protein, 164 aa, Streptococcus pneumoniae
NDQEYREKSAKAFAILLHLMRGTPYIYQGEEIGMTNYPFGTLNQVEDIESLNYAREALEKGVPMEEIMDSIRVIGRDNARTPMQWDKSKNAGFSTGQPWLAVNPNHQEINVQEALANPDSIFYTYQKLVQIRKENSWLIHLILSSWKQLTRFLPISVRTVTVAS

SEQ ID NO: 28879 - protein, 166 aa, Streptococcus pneumoniae
PCLDQEYREKSAKAFAILLHLMRGTPYIYQGEEIGMTNYPFGTLNQVEDIESLNYAREALEKGVPMEEIMDSIRVIGRDNARTPMQWDKSKNAGFSTGQPWLAVNPNHQEINVQEALANPDSIFYTYQKLVQIRKENSWLIHLILSSWKQLTRFLPISVRTVTVAS

SEQ ID NO: 28880 - protein, 332 aa, Streptococcus pneumoniae
DEKVVNNGPMLHPYLKEMNQATFGAKNLLTVGETWGATPEIAKLYSDPKGQELSMVFHFEHIGLQYQEGQPKWHYQKELNIAKLKEIFNKWQTELGVEDGWNSLFWNNHDLPRIVSIWGNDQEYREKSAKAFAILLHIMRGTPYIYQGEEIGMTNYPFETLDQVEDIESLNYAREALEKGVSLEEIMDSIRVIGRDNARTPMQWDESKNAGFSTGQPWLAVNPNYQAINVQEALANPDSIFYTYQNLVQIRKENSWLIRADFELLDTADKVFAYIRKDGDRRFLVVANLSNEEQVFVVEGNVKSVLIENTLAQEVFEKQILAPWDAFCVELL

SEQ ID NO: 28881 - protein, 271 aa, Brassica oleracea var. botrytis
NWGFFELLNHGIPYDLMDNIERMTKEHYKEFMEQKFKEMLRSKNLDTLETEVENVDWESTFFLHHLPQTNLYDIPDMSDEYRAAMKDFGKRLENLAEELLDLLCENLGLEKGYLKKVFSGTKGPTFGTKVSNYPPCPKPEMIKGLRAHTDAGGLILLFQDDKVSGLQLLKDGVWVDVPPLKHSIVINLGDQLEVITNGKYKSITHRVMTQKEGNRMSIASFYNPGSDAESSPAPSLVEKDSDEYPSFVFDDYMKLYAGVKFQPKEPSFEAM

SEQ ID NO: 28882 - protein, 380 aa, Petunia x hybrida
MASEAVHAPSPPVAVPTVCVTGAAGFIGSWLVMRLLERGYNVHATVRDPENKKKVKHLLELPKADTNLTLWKADLTVEGSFDEAIQGCQGVFHVATPMDFESKDPENEVIKPTVRGMLSIIESCAKANTVKRLVFTSSAGTLDVQEQQKLFYDQTSWSDLDFIYAKKMTGWMYFASKILAEKAAMEEAKKKNIDFISIIPPLVVGPFITPTFPPSLITALSLITGNEAHYCIIKQGQYVHLDDLCEAHIFLYEHPKADGRFICSSHHAIIYDVAKMVREKWPEYYVPTEFKGIDKDLPVVSFSSKKLTDMGFQFKYTLEDMYKGAIDTCRQKQLLPFSTRSAEDNGHNREAIAISAQNYASGKENAPVANHTEMLSNVEV

SEQ ID NO: 28883 - protein, 322 aa, Spinacia oleracea
MNTHQKLERRELGNTGLNLSCVGFGASPLGNVFGDVSEEQSIATVIEAFNQGINFFDTSPYYGATLSEKVLGKCLKALGASRDEYIVATKCGRYAEGFDFSAERVTKSIDESLERLQLEYVDILQCHDIEFGSLDQIVNETIPALQKIKESGKTRFIGITGLPLEVYTYVLDRVPPGTIDVVLSYCHYCINDSTLEDMLPYFKSKGVGVINASPLSMGLHTENGPPEWHPASPEIKAACKAAADYCKKNGKNISKLALQYSLSNKDISTTLVGMNSVKQVEENVGAALELETAGKDEKTFAEIENILKPIKNQSWPSGIQQT

SEQ ID NO: 28884 - protein, 250 aa, Malus x domestica
KIQTLEEQMSSVSEKSSKYGQIAAEEVPKSLYCLGIQLTSEWFRSPNIQRKIKDRKQIEMKLKDNNLYHFCVFSDNILATSVVVNSTSMNSKNPDKIVFHLVTDEINYAAMKAWFSINSFRGVAVEVQKFEDFTWLNASYVPVLKQLQDTDTQSYYFSGNSDDGRTPIKFRNPKYLSMLNHLRFYIPEVFPALKKVVFLDDDVVVQKDLSDLFSIDLKGNVNGAVETCMETFHRYHKYLNYSHPLIRAHF

SEQ ID NO: 28885 - protein, 475 aa, Nothofagus alessandrii
MSPQTETKASVGFKAGVKDYKLTYYTPDYETKDTDILAAFRVTPQPGVPPEEAGAAVAAESSTGTWTTVWTDGLTSLDRYKGRCYHIEPVAGDENQFIAYVAYPLDLFEEGSVTNMFTSIVGNVFGFKALRALRLEDLRIPPAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 28886 - protein, 475 aa, Nothofagus gunnii
MSPQTETKASVGFKAGVKDYKLTYYTPDYETKDTDILAAFRVTPQPGVPPEEAGAAVAAESSTGTWTTVWTDGLTSLDRYKGRCYHIEPVAGDENQYIAYVAYPLDLFEEGSVTNMFTSIVGNVFGFKALRALRLEDLRIPPAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 28887 - protein, 475 aa, Nothofagus menziesii
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYITGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 28888 - protein, 475 aa, Nothofagus moorei
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 28889 - protein, 475 aa, Nothofagus obliqua
MSPQTETKASVGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 28890 - protein, 475 aa, Nothofagus truncata
MSPQTETKASVGFKAGVKDYKLTYYTPDYETKDTDILAAFRVTPQPGVPPEEAGAAVAAESSTGTWTTVWTDGLTSLDRYKGRCYHIEPVAGDENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYITGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 28891 - protein, 475 aa, Bensoniella oregona
  misc_feature (1)..(10): Xaa can be any naturally occurring amino acid
XXXXXXXXXXVGFKAGVKDYKLTYYTPDYETKDTDILAAFRVTPQPGVPPEEAGAAVAAESSTGTWTTVWTDGLTNLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLSYYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 28892 - protein, 480 aa, Penicillium griseoroseum
MLSPKPAFLLLLLHAVFGSAYRWFNWQFEVTCQSDAYIAPHNEHAAAEFLKEQYPKSSHIKVVGNGHGFGNLTTCVDNALTEKPTYIVSLTNLKKLHIDKKNLTVTFGAGWDVDDLIQELKANDLSFSNLGVERVQNFVGAASTGTHGSGSDLGNIATQIIGLRVLDSQGGLRVINEKHNAEELKAFRISLGALGLITELTIKVQPTQLLKKTTKVLNATSDYSKMYNELAQLYKEHDRMTVWGPHFDWNAKSQSWDLEPTYFLSYWEPTNYTGVRNCTLNYCANGCGDCKKEYICYDEVTDAASCSPQGVCSRGFYAEIEHFLPIEYFAEAATNYTIFQQGQTSRMKAPYNKQMVMQHRSLKGDDTYLSPVNTYNLGPDLSGVFGVIEIDWIQEYNNFTTLWQNQELAHEFLPQFGETYNARSHWNKMSAPNATYTLEKFPKLPEFLAIQKRQDPKCQFVNEFLVEQLGITRCANYISV

SEQ ID NO: 28893 - protein, 404 aa, Blastocladiella emersonii
APAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 28894 - protein, 456 aa, Oryza sativa (japonica cultivar-group)
MDTEPLLSPLSPSPHLLHPLPEHAEVSTFSPPLSPCPSPASSYKERIIFGAHPPPPPPPPPPPPPPPRGRRYYRRVSGDDLDVPSCSSSPSPPSDEENPPPNPPSLFDFIGGRTNLHRSRTAPAMAPLNAAAIAAAAASGDSRNPPPPPRRPAIVLHAFLFLLAYLAMGVTFYAALPGNFTSSAGPTHPVADALYFCIVTLCTIGYGDITPATPAAKLFSISFVLIGFGFVDILLSGMVSYVLDLQEHLLITALKNPRSVRKHRHNYIFDLKKGRMRVRMKVALALTVVAICVGVGAAVLKRVENLGWLDAVYLAVMSVTTVGYGDHAFRTLAGRLFASAWLLVSTLAVARAFLYLAEMRIDKRHRAMANWVLSRDMTVSEFLAADIDNNGYVTKSEFVVYKLKEMGKISEKDIMMICDQFQRMDSGNCGKITLSDLLESHQLVTDLNEKKKGKKS

SEQ ID NO: 28895 - protein, 482 aa, Oryza sativa (japonica cultivar-group)
MSSYVVVAAALLVFVVVVVAAIKNLGKGKLPPSPPSLPFVGHLHLVGELPHRSLDALHRRYGSDGGLMFLRLGRAGALVVSTAAAAADLYRGHDLAFASRPPSHSAERLFYGGRNISWPWRTSSPLAAPARAAEAAALVARARRAAEAARAVQLRELLYAYTNGVITRVAAGGSGATAERFRKMMADTSELLAGFQWVDRLPEAAGWAARKLTGLNKKLDDMADESDRFLGEILAAHDDEKAEGEEEDFVDVLLRLRRQGAAAAGGLELAEDNVKAIIKDIMGAATDTSFVTLEWIMTELIRNTQVMSKLQNEIIQVTGSKPTVTEEDLTKLDYLKAVIKEVLRLHPPAPLLIPHHSTMPTTIQGYHIPAKTIAFINVWAIGRDPAAWDTPDEFRPERFMGSAVDFRGNDYKFIPFGAGRRLCPGIILALPGLEMVIASLLYHFDWELPDGMDVQDLDMAEAPGLTTPPMNPVWLIPRCRTI

SEQ ID NO: 28896 - protein, 507 aa, Oryza sativa (japonica cultivar-group)
MYHYVFLAAVALLAVVGYGVKNRRRRSAKLPPSPPSVPFLGHLHLLGPLLHRSLHELHLRYGTDGGLLLLQLGRRRTLVVSTAAAAADLYRNHDLAFASRPLVAAAHKLSYGSKNITFAPFGEQWRRAKKTAVVHALSPRRVEAFAPVRAAEAAALVAATRRAADAAADGGAVELRDLLYSYTNAVVTRAATGAAGTTAEKLKQLLGNATSLVAGVQADDLLPGMAAKAVRWATGLEKQYDASMEEWDKFLSPIMAEHAEKKKKKREDIGAGEEDFIDVLLRLKEEDTELTDTHVKSRVVDLIAAATETTSVTLEWTMAELAANPRVMAKLQEEIARATGGKPAITEAEVGGMEYMKAVVKEVLRLHPPAPILVPHESTAAAAVQGYEIPARTSLFVNAWAIGRDPAAWGSPEEFRPERFLAGGPAVDFRGNDYQLVPFGAGRRICPGISFAVPVLEMALVALLHHFDWELPAGMRAAELDMSEAPGLTTPLRVPLRLVPKRKAPLA

SEQ ID NO: 28897 - protein, 359 aa, Oryza sativa (japonica cultivar-group)
MAPAAARWLRREVFVGLALGQFVSLLITSTGFSSSELARRGVNAPTSQSLLNYVLLALVYGGILIYRRQHLTIKWYYFLILGIVDVEANYIVVKAYQYTSLTSVMLIDCWAIPCVILLTWVFLKTKYGLRKFIGVVICVAGIILVVFSDVHASDRAKGPNPLKGDLFVIAGAMLYAVSNVTEEYFVKKSSRIEVMAMLGVFGAVISEAYLNDKNFGQPNGMLILPFIGFAVAMFLFYSTVPIILKICGATMLNLSLLTSDMWAVLIRIFAYHEKVDWMYFVAFAGTAAGLVIYSYKGSKVAEETAQVAGATDEEAATRVAGAGDDEPASTNKEVSSLAATTSSVIAGSLVHMGKVWCEL

SEQ ID NO: 28898 - protein, 174 aa, Oryza sativa (japonica cultivar-group)
MSLHARVALFAAALAAVLAASTAGFISNEAVGASSAASGGAGRSLLQAKKDCPVNFEEANYTVITSRCKGPMYPPALCCQALKDLACPFTAYINDAQTTCAASMFSYINLYGKYPPGLFANTCKEGANGLECPEDTPQMKPGEDKAASSAAAIVAAVARPVLAAVSAFLMLIVS

SEQ ID NO: 28899 - protein, 367 aa, Oryza sativa (japonica cultivar-group)
MEEHRLGGGGGGGGGGGRPPIPGAAGRKLPGLSRHASFVRSPANSTKSGTEKTFENMDAVAYMPVVRSGGWADIGSRHTMEDVFICSDNLMKEFGVESFEDGPSAFYGVFDGHGGKHAADFVCSNLARFIVEDEDFPREIEKALSSAFLQTDAAFADACSVNSSLASGTTALAALVVGRSLLVANAGDCRAVLCCRGKAIEMSRDHKPSCNREKVRIEASGGYVYDGYLNGQLNVARAIGDWHMEGMKACDGLGPLSAEPEVMIRNLTEEDEFLIIGCDGIWDVFRSQNAVDFARRKLQEHNDPVTCCKELVDEAIKRKSGDNLSVVVICFNSRPPPVLTTPRPRVQRSISAEGLRELQSFLDSLAD

SEQ ID NO: 28900 - protein, 311 aa, Oryza sativa (japonica cultivar-group)
MDAVAYMPVVRSGGWADIGSRHTMEDVFICSDNLMKEFGVESFEDGPSAFYGVFDGHGGKHAADFVCSNLARFIVEDEDFPREIEKALSSAFLQTDAAFADACSVNSSLASGTTALAALVVGRSLLVANAGDCRAVLCCRGKAIEMSRDHKPSCNREKVRIEASGGYVYDGYLNGQLNVARAIGDWHMEGMKACDGLGPLSAEPEVMIRNLTEEDEFLIIGCDGIWDVFRSQNAVDFARRKLQEHNDPVTCCKELVDEAIKRKSGDNLSVVVICFNSRPPPVLTTPRPRVQRSISAEGLRELQSFLDSLAD

SEQ ID NO: 28901 - protein, 406 aa, Oryza sativa (japonica cultivar-group)
MSCLGWFKKRRSSKSKESSGRRGSTTTTVSAVSTSRSDDSGAVRPASKSTGSTSSHRSISSLYEERGHGQLRDFDYDELQAATNGFSRAQKLGEGGFGSVYKGFVRSSPADGKAADRLAVAVKCLNQRGLQGHKQWLAEVQFLGVLEHPNLVKLLGYCAVDGERGPQRLLVYEYMPNKSLEDHLFVRAYPPLSWNRRLQIILGAAEGLAYLHEGQVQVIYRDFKASNILLDKDFRAKLSDFGLAREGPTGANTHVSTAVVGTHGYAAPDYIETGHLTVKSDVWSFGVVLYEILTGRRTLDRHRPQGEQKLLEWVAQFAPDSRNFRMIMDPRLRGEYSVKAARDIAKLAESCLLKNAKERPTMSEVVDVLRRAVQSQPDPPPPPAAAAAASGKGKRVDVAPQPARRR

SEQ ID NO: 28902 - protein, 304 aa, Oryza sativa (japonica cultivar-group)
MAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 28903 - protein, 357 aa, Oryza sativa (japonica cultivar-group)
MTVVVVADDAAAAAAAAQQQEELPPGHGQTVCVTGAAGYIASWLVKLLLERGYTVKGTVRNPDDPKNAHLKALDGADERLVLCKADLLDYDSIRAAVDGCHGVFHTASPVTDDPEQMVEPAVRGTEYVIKAAAEAGTVRRVVFTSSIGAVTMDPNRGPDVVVDESCWSDLEFCKKTKNWYCYGKAVAEQEACKAAEERGVDLVVVSPVLVVGPLLQPTVNASAVHILKYLDGSAKKYANAVQAYVDVRDVAAAHVRVFEAPEASGRHLCAERVLHREDVVHILGKLFPEYPVPTRCSDEVNPRKQPYKMSNKKLQDLGLHFIPVSDSLYETVKSLQEKGHLPVLSKEIPEELNGVPA

SEQ ID NO: 28904 - protein, 295 aa, Oryza sativa (japonica cultivar-group)
MTVVVVADDAAAAAAAAQQQEELPPGHGQTVCVTGAAGYIASWLVKLLLERGYTVKGTVRNPDDPKNAHLKALDGADERLVLCKADLLDYDSIRAAVDGCHGVFHTASPVTDDPEQMVEPAVRGTEYVIKAAAEAGTVRRVVFTSSIGAVTMDPNRGPDVVVDESCWSDLEFCKKTKNWYCYGKAVAEQEACKAAEERGVDLVVVSPVLVVGPLLQPTVNASAVHILKYLDGSAKKYANAVQAYVDVRDVAAAHVRVFEAPEASGRHLCAERVLHREDVVHILGKLFPEYPVPTR

SEQ ID NO: 28905 - protein, 203 aa, Medicago sativa
AESTVIMASGMCASVVLFMALVPAGGHLVTTTDCYRKTRIFIETFLPKMGITTTVIDPADVGALESALEQHNVSLFFTESPTNPFLRCVDIKLVSELCHKKGTLLCIDGTFATPLNQKALALGADLILHSLTKYMGGHHDVLGGCISGSIKVVSQIRTLHHVLGGTLNPNAAYLFIRGMKTLHLRVQQQNSTGMRMAKLLEAH

SEQ ID NO: 28906 - protein, 375 aa, Nicotiana tabacum
MEVISTNTNGSTIFKNGAIPMNGHQNGTSEHLNGYQNGTSKHQNGHQNGTFEHRNGHQNGTSEQQNGTISHDNGNELLGSSDSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTAPTYPTGVIGYMLCSTEGPEVDFKNPVNPIDKETTQVKSKLGPLKFYNSDIHKAAFILPSFARSMIES

SEQ ID NO: 28907 - protein, 510 aa, Eustoma grandiflorum
MAVGNGVLLHIAASLMLFFHVQKLVQYLWMNSRRHRLPPGPIGWPVLGALRLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANGDNSEGERLQTVNIKALLLNMFTAGTDTSSSVIEWALAELLKNPIILRRAQEEMDGVIGRDRRFLEADISKLPYLQAICKEAFRKHPSTPLNLPRIASQACEVNGHYIPKGTRLSVNIWAIGRDPSVWENPNEFNPDRFLERKNAKIDPRGNDFELIPFGAGRRICAGTRLGILLVEYILGTLVHSFVWELPSSVIELNMDESFGLALQKAVPLAAMVTPRLPLHIYSP

SEQ ID NO: 28908 - protein, 347 aa, Eustoma grandiflorum
MEKSGGAASTVCVTGAAGYIGSWLVMRLLERGYTVRATVRDPGDVKKVKHLFELPKASTNLTVLKADLIEEGSFDEAIQGCHGVFHMATPMEFESKNPENEVIKPTIDGVLSVIRSSVKAKTVKKIVFTSSAGTVDVQKEQKSVYDENDQSDLDFIYSKKMTGWMYFVSKILAEKAAWEAAKANNIGFISIIPTVVVGPFITCTFPPSLITALSLLTGNEAHYSIIKQGQFVHLDDLCEAHIFLYEHPEAEGRYICSSHDTTINDLAKMIRHRWPEYNVPTNLKGIDEDIPLASFSFKKLTGMGFQYKYTLEDMFRGAIETCREKGLLPHSNENHVIMQQTEHGKDT

SEQ ID NO: 28909 - protein, 429 aa, Bacillus subtilis subsp. subtilis str. 168
MHTKSIELHNEALQHIVGGVNSPSRSYKAVGGGSPVAMEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 28910 - protein, 469 aa, Bacillus subtilis subsp. subtilis str. 168
MSKQQIGVIGLAVMGKNLALNIESRGFSVSVYNRSSSKTEEFLQEAKGKNVVGTYSIEEFVQSLETPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 28911 - protein, 469 aa, Bacillus subtilis subsp. subtilis str. 168
MSSNEKRFPEGFLWGGAVAANQVEGAYNEGGKGLSTADVSPNGIMSPFDESMTSLNLYHNGIDFYHRYKEDIALFAEMGFKAFRTSIAWTRIFPNGDEEEPNEEGLRFYDDLFDELLKHHIEPVVTISHYEMPLGLVKNYGGWKNRKVIEFYERYAKTVFKRYQHKVKYWMTFNEINVVLHAPFTGGGLVFEEGENKLNAMYQAAHHQFVASALAVKAGHDIIPDSKIGCMIAATTTYPMTSKPEDVFAAMENERKTLFFSDVQARGAYPGYMKRYLAENNIEIEMAEGDEELLKEHTVDYIGFSYYMSMAASTDPEELAKSGGNLLGGVKNPYLKSSEWGWQIDPKGLRITLNTLYDRYQKPLFIVENGLGAVDKVEEDGTIQDDYRINYLRDHLIEAREAIADGVELIGYTSWGPIDLVSASTAEMKKRYGFIYVDRDNEGNGTFNRIKKKSFNWYQQVIATNGESL

SEQ ID NO: 28912 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPTEHNWPGISQFPEYKATAPRYATQDLRQILPQIDATGIDLLQRLLQLRPELRISAHDALQHPWFHDILQYQHCQQAAG

SEQ ID NO: 28913 - protein, 202 aa, Salmonella typhimurium
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCD

SEQ ID NO: 28914 - protein, 511 aa, Gerbera hybrid cultivar
MNTLQLIFLLFFFPTLLFLYCLPYKRNQNHRRLPPSPPSFPIIGHLHHLGPLIHQSFHALSTRYGSLIHLRLGSVPCVVVSTPDLAKDFLKTNELAFSSRKHSLAIDHITYGVAFAFAPYGTYWKFIKKLFTVELLGTQNLSHFLPIRTHEIRELLRTLMVKSRAKERVNLTEELLKLTNNVISQMMMSIRCSGTNSEADEAKNLVREVTKIFGQFNVSDFIWFCKNIDLQGFKKRYEGTHRRYDALLERIIMGREENRRRGKIKDGEGKDFLDMLLDVLEDGKAEIKITRDHIKALILDFLTAGTDTTAIAIEWALVELINNPNALEKARQEIDQVIGDERLVQESDTPNLPYIQAIIKEALRLHPPIPMLIRKSTENVIVQGYDIPAGTLLFVNIWSIGRNPQCWETPLEFKPHRFLDGGDLKSSLDIKGHNFQLLPFGTGRRGCPGVNLAMRELSVVIANLIQCFDWDVVGERLLNTDERAGLTAPRAVDFVCVPLERGNTLKILGSN

SEQ ID NO: 28915 - protein, 278 aa, Alicyclobacillus acidocaldarius
MQTKALGTQGLTVSALGLGCMGMSDFYSGRDEAEAIRTLERAVELGINFFDTADMYGVGENEKLVGRVLRPYRDQVVIATKFGNVRAPDGTFLGINGRPEYVKQACDASLKRLGVDYIDLYYQHRVDPNVPIEETVGAMAELVKAGKVRFLGLSEAGAQTIRRAHKVHPITALQTEYSLWSRDVEDEILPTVRELGIGFVAYSPLGRGFLTGAIRRFEDLPEDDYRRHSPRFQGENFKRNLDLVEKIERLAREKGCTPAQLALAWVMAQGEDIVPIPG

SEQ ID NO: 28916 - protein, 511 aa, Oryza sativa (japonica cultivar-group)
MELTTLLLLALISFFFLVELIARYASPSGRESALRLPPGPSQLPLIGSLHHLLLSRYGDLPHRAMRELSLTYGPLMLLRLGAVPTLVVSSAEAAAEVMRAHDAAFAGRHLSATIDILSCGGKDIIFGPYTERWRELRKVCALELFNHRRVLSFRPVREDEVGRLLRSVSAASAEGGAACFNLSERICRMTNDSVVRAAFGARCDHRDEFLHELDKAVRLTGGINLADLYPSSRLVRRLSAATRDMARCQRNIYRIAESIIRDRDGAPPPERDEEDLLSVLLRLQRSGGLKFALTTEIISTVIFDIFSAGSETSSTTLDWTMSELMKNPRILRKAQSEVRETFKGQDKLTEDDVAKLSYLQLVIKETLRLHPPAPLLIPRECRETCQVMGYDVPKGTKVFVNVWKIGREGEYWGDGEIFRPERFENSTVDFRGADFEFIPFGAGRRMCPGIALGLANMELALASLLYHFDWELPDGIKSEELDMTEVFGITVRRKSKLWLHAIPRVPYISTY

SEQ ID NO: 28917 - protein, 347 aa, Camellia sinensis
MKDSVASATASAPGTVCVTGAAGFIGSWLVMRLLERGYIVRATVRDPANLKKVKHLLDLPKADTNLTLWKADLNEEGSFDEAIEGCSGVFHVATPMDFKSKDPENEVIKPTINGVLSIIRSCTKAKTVKRLVFTSSAGTVNVQEHQQPVFDENNWSDLDFINKKKMTGWMYFVSKTLAEKAAWEAAKENNIDFISIIPTLVVGPFIMPTFPPSLITALSPITRNEGHYSIIKQGQFVHLDDLCESHIFLYERPQAEGRYICSSHDATIHDLAKLMREKWPEYNVPTEFKGIDKDLPVVSFSSKKLIGMGFEFKYSLEDMFRGAIDTCREKGLLPHSFAENPVNGNKV

SEQ ID NO: 28918 - protein, 235 aa, Lactobacillus rhamnosus
MWTQTLGEFIGTFILVLLGDGVVAGVSLNKSKANGAGWIAITLGWGLAVTMGVYAAAFLGPAHLNPAVTLAFAAIGQFPWAWVMPFVGAQMLGALLGAAVVWLHYYPHWEATNDPATTLGVFATGPAIRNYAANFISEFIGTAVLIFGLLAFTKGKWTDGLNPIGVGILITAIGLSLGGTTGYAINPARDLGPRLAHAILPIAHKGDSDWPYAWVPILGPLAGGVVGALIFTVLP

SEQ ID NO: 28919 - protein, 331 aa, Leuconostoc mesenteroides
MKIFAYGIRDDEKPSLEEWKAANPEIEVDYTQELLTPETAKLAEGSDSAVVYQQLDYTRETLTALANVGVTNLSLRNVGTDNIDFDAAREFNFNISNVPVYSPNAIAEHSMLQLSRLLRRTKALDAKIAKRDLRWAPTTGREMRMQTVGVIGTGHIGRVAINILKGFGAKVIAYDKYPNAELQAEGLYVDTLDELYAQADAISLYVPGVPENHHLINADAIAKMKDGVVIMNAARGNLMDIDAIIDGLNSGKISDFGMDVYENEVACSMKIGLVKNSPDAKIADLIARENVMITPHTAFYTTKAVLEMVHQSFDAAVAFAKGEKPAIAVEY

SEQ ID NO: 28920 - protein, 445 aa, Oryza sativa (japonica cultivar-group)
MDSRLVAFSHRRRRWILLAAGGAAAVFGAYKIYHHPAVAARRRRLARLAGAVAAFLDAAAASADAAALVASDLSDFVRSGSDELPRSVTQLAKLAASPEVSATVSAISEAITAGILRGVGSDSGPGSGGGVALSDRLVDRLFSESGERLAAAIAGSFARHLVAAIYSASSTPGETSSPMKWVNLIATGKGQKAISNWVEVFVSTAVGVFVDKTIHINTYDQLFQGLTNASHDAKVKELLVSVCNGAVETMVKATHHVMSNANYKSVGSGSNGAGEGWVETVSSTLAVPSNRKFVLDVTGRVTFETVRSFLEFALWKMHAGAKKGGNTVMDSGLRAMQYMTDKSMVIATICITLCLHVLNGTRLLCHTRAHEKHSEKATGSFFAVAGKEATTTCTREAKKDRRIPEAKLGDTGKANKANGPFSPWPRLQSSALQGSRPSVLRYFQA

SEQ ID NO: 28921 - protein, 393 aa, Oryza sativa (japonica cultivar-group)
MFPTAGGRRLLVLIRRASAAAAAGANPNHHHHHATLFTHRYSSSPLARTPEAESAAAASYLVASVGLSPAAAARISRKARFRSNADAEAVVSLLRGHGFSDANIAQVLPKIPGLLILNPDKILRPKLEYFASLGVVPSALSRAPLLARSLEKHLVPCVEFIRGVVGTDANLCAAISRNPWALWCDINSSMRPAVESLRRHGLAEANISRLVVINLSALTMSPDRIDGIFGDLEALELPISHSRFVYGFWALSRLKRGAWEERMSVFMRFGVSRSELLKAFREQPGILVFTAKTIQRKLSFYQEKLKVAPADVIAHPLLLTFSLEKNIIPKCAVLNVLLREGKIKRYGREMDLLRPLQRSNISFFERFVRKYEEDVPDVVKAYEGKIKFTGFMD

SEQ ID NO: 28922 - protein, 399 aa, Oryza sativa (japonica cultivar-group)
MFAAICRRRLAALFPQIRGGGGGAYHVQSNPQAALLFHSYSSTAVTGGSDPEPCPDTVSYLVSCGLPPAVARHTAANTRGLRIRSTEKADAVRTLLRSYGFSDADVARIARSAPLLLTVDPDRIIRPKLEFFATMGFQPSKLSTAPLLLARSLEKHLVPTIQFLRSIIGSDDGIRRGFSRIPRALLVSLDNCMRPAVEALHRHGLTGREDVSKVLVLQMGVLMLSPVRIGEIFEDLKAMGMSITDGRFANSFRAMCSMRRATWLRKVALYRSFGLSESEVFEAFKKQPTALLGADETIKKNASFFRDALKLEMREVMVHPVVMAYSFEKTILPRCAVLSVLMREGKINPDIQLLHALLGSAKTFSGRYVDRFAADVPDVVEAYEGKIKFKGFKGQGQGV

SEQ ID NO: 28923 - protein, 279 aa, Oryza sativa (japonica cultivar-group)
MCTLVLYLLPGVLAWAMQRICVSPSLSRSWGMNGQIGDDHDILIECRDVHKSFGNKKVLNGISFKIRHGEAVGIIGPSGTGKSTVLKVMAGLLAPDKVFQSAALFDSLTVRENVGFLLYENSSLPEERIATLVTETLAAVGLKGVEDRMPSELSGGMKKRVALARSIIYDDTKETIEPEVILYDEPTAGLDPIASTVVEDLIRSVHVTGKDALGKPGKIASYVVVTHQHSTIKRAVDRLLFLHEGKVVWEGMTQEFTTSTNPIVKQFASGSLDGPIRYF

SEQ ID NO: 28924 - protein, 438 aa, Oryza sativa (japonica cultivar-group)
MAHDLHDDLEFVSGDDDDYYLEFDHDPGHGFHTSAATSASQTLIGALYFRTSRWTIPWERLNYSRNQYREMRLRQYKNYENLTMPRDGLEKECKQVERKDTFYDFHLNTRLVKSTIVHFQLRNLLWATSKHDVYLMQNYSVMHWSSLLQRGKEVLNVAGQLAPSQNVRGAMPLSRVQISTMAVKGNLMVAGGFQGELICKYVDKPGVAFCTNLTGNNNSITNAVDIYQAPNGGTRITTANNDCVVRTFDTERFSLISHFAFPWSVNNTSVSPDGKLLAVLGDSSDCLIADSQSGKEMARLKGHLDYSFSSAWHPDGRVVATGNQDRTCRVWDVRNMSRSVAVLEGRIGAVRGLRYSPDGRFLAASEPADFVHVYDAAAGYADAQEIDLFGEIAGVAFSPAGNNGGGGEALFVSIADRTYGSLLEFHRRRRHGYLDCYV

SEQ ID NO: 28925 - protein, 1310 aa, Phytophthora sojae
MVSRYSTLRADNLETMLNGGLERFYKKYNHLSRKINLQLPTPEVRFENLSFSVQVPAEAGAYGTVGSHLASIFTPWQKVPMTTKHALHPMSGIIKPGSMTLILANPGAGKSTFLKALAGKLQDNKQTEISGQILYSGLRGEEIDLIKLVGLVDQTDNHIPTLTVRETFKFADLCVNGRPEDQPEEMREIAALRTELFLQILGLESCADTVVGNALLRGVSGGERKRVTVGEVLVGGQSLFLCDEISTGLDSAATFDIIKALRTWCKTLGGSVIVALLQPTPEVVEQFDDILMVNEGHMVYHGPRTEILDYFEERGFSCPPRVDPADFLIEVTSGRGHRYANGRVEKRDLAVTSEDFNNLFCQSSIYKKTHEAISKGFNEHQFENAEDFQKAKSVANLARSKQKSEFGLAFIPSTLLLLNRQKLIWLRDPPLLWGKLFEALIVGLVLGMIYFNVSSTYYLRMIFFSIALFQRQAWQQITISFQLRGVFYKQRPRNFFRTMSYAIAETVVQIPVNLSVSFILGTFFYFMSGLTRTFEKYIVFFLVLVCFQHAIGAYMTMLSSLSPSITVGQALAGISVSFFLLFSGNIILADLIPDYWIWMYWFNPLAWALRSNMLSEFSSDRYSPAQSQKFLDSFSISQGTEYVWFGIGILLAYYLFFTTLNGLALHFIRYEKYKGVSVKAMTDNSSEEDNVYVEVRTPGAGDVVQTKARGAGLPFTPSNLCIKDLEYFVTLPSGEEKQLLRGITAHFEPGRMVALMGATGAGKTTLMDVIAGRKTGGRIVGDIIVNGEPKNPANFSRITAYCEQMDIHSEAATIYEALVFSANLRLPPTFSEEERMNLVNETLELLELSPIAGEMVGRLSVEQKKRVTIGVEVVANPSILFLDEPTSGLDARSALIVMRGVQSIARTGRTVLCTIHQPSISIFELFDGLLLLQKGGYTAYFGDLGVDSVKMLEYFESIPGTEQIRPQYNPATYMLEVIGAGIGRDVKDYSVEYKNSELCRSNRERTLELAKASGDFVCHSTLNYTPIATGFWNQLGHLAKKQQLTYWRNPQYNFMRMFLFPLFAIIFGTTFYQLSAGSVKKINSHIGLIYNSMDFIGVINLMTVLEVTCAERAVFYRERMSNYYGPLPYSLSLWFAEVPYLIVVIVLFVTIEYWLVGWSSSPGDYFFFMFVFYLYTSACTYVGQWMSALMPNEKVANVAVGALSCLFNLFSGYLLPRTAMKAGYKWFTYLMPSSYSLAALVGVQFGDNQDIIAVTSGNITTNMTVAHYIEKTYDFRPERKYSFMAGLLVIWVVLQVAIYLTFKYVSHLKR

SEQ ID NO: 28926 - protein, 347 aa, Oryza sativa (japonica cultivar-group)
MPTDETAAAAPATTALSGHGCTVCVTGAGGFIASWLVKRLLEKGYTVRGTVRNPMDPKNDHLRALDGAGERLVLLRADLLDPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYDCGGARGRYICAESTLHRGDLCRALAKLFPEYPVPSRCKDEAAPPVKGYLFSNQRLRDLGMDFVPVRQCLYETVRSLQDKGLLPVLPPTADDHHHPSS

SEQ ID NO: 28927 - protein, 509 aa, Oryza sativa (japonica cultivar-group)
MDELFYQSLLLSVAAVTVLQLLKLLLVRHRRPRTPPGPWRLPVIGSMHHLVNVLPHRKLRELAAVHGPLMMLQLGETPLVVATSKETARAVLKTHDTNFATRPRLLAGEIVGYEWVDILFSPSGDYWRKLRQLCAAEILSPKRVLSFRHIREDEVMMRVNEIRAAGPTTPVNLSVMFHSVTNSIVSRAAFGKKRKNAAEFLAAIKSGVGLASGFNIPDLFPTWTGILATVTGMKRSLRAIYTTVDGILEEIIAERKGIRDEKISGGAENVDENLVDVLIGLQGKGGFGFHLDNSKIKAIILDMFAGGTGTSASAMEWGMSELMRNPSVMKKLQAEIREVLRGKATVTEADMQAGNLRYLKMVIREALRLHPPAPLLVPRESIDVCELDGYTIPAKSRVIINAWAIGRDPKYWDNPEEFRPERFEDGTLDFTGSNYEFIPFGSGRRMCPGFNYGLASMELMFTGLLYHFDWSLPEGVNEVDMAEAPGLGVRRRSPLMLCATPFVPVVSAN

SEQ ID NO: 28928 - protein, 1076 aa, Oryza sativa (japonica cultivar-group)
MSPSFFFVVVSAWSLALMLAAAARGAEEEGGGGCLGSQKCGDLNISSPFWIIQGQADKPCGPLDYQVYCNNSTGVATLRSSTDSGFDIINISYGDRTMLVFDVHKLARLNNSTGCSIPVFNTFAKLPITFTISPSNHNLVFYNCTEAPPAEQQQQLGLVETRCGNNTFARLGGRFHGEGDYDKYYLEGCSRNSTVFLPVLEPPDGKANASRYVELVGGGFLITWDLPPPVTSSAANTAADNRPQEGCAASTVCGKVTISSPFAVVPEQATESKCGWLGFQVICHNDTPYLGYYKPRYRIQILDIFYGNNSLLVSDIHKLGDFIVFSGVSKEYSCHVPRTNTSSKVGLPFSISTTNLNLFLYSCNKALVPRDGDDDLVETRCGNKTFARVGGNYSDSGDYPAFYMEGCNATVVPVLGTDARSYEQLIRDGFLLTWQETPSSASFLELPAPASSSSPGCLPTPCGKLTISYPFWLEEPGRPPCGSPPFQLKCNATGAYLTHTIYEAYRVVDIFTGNHTVHVVDENLPLATGCPAPPFNISDGIWQAPFVISEANAELRFLSCNKSLPAAAAPPGFHSLPCDDQNSSVRLVSDHHLHEDGIPPGCNFTVVPIVQRHNGSMAGYIASMRSGFLLEWAVVSGDCPKCQVSGGNCTYSDDLEFACNCPDGMHPDKCREFRKSEEHACGSSGGILLIVSIFIFAWHKRKKRKQTRDLKDLMHSSSSMQSYSKDLELGGSPHIFTYEELEEATAGFSASRELGDGGFGTVYKGKLRDGRVVAVKRLYKNNYRRVEQFLNEVDILSRLLHQNLVILYGCTSRSSRDLLLVYEYIPNGTVADHLHGPRAGERGLTWPVRMTIAIETAEALAYLHAVEIIHRDVKTNNILLDNNFHVKVADFGLSRLFPLEVTHVSTVPQGTPGYVDPVYHQCYKLTDKSDVYSFGVVLIELISSKPAVDMSRSHSDINLANMALNRIQNHEVDQLVDPEIGYETDSETKRMVDLVAELAFQCLQMDRESRPPIKEVVEVLNCIKNGECPAEKMNKNASPKEDSHLLKDSLQYSPDSVIHRFHSQSTNHSVASNSSG

SEQ ID NO: 28929 - protein, 384 aa, Oryza sativa (japonica cultivar-group)
MEEHLLPVVHRDQVYSSRQDRRKSSDVPNRFVTSFHPSTNSKGNPNTPNHPLHTSGNGNIVTAQNFQRVHSSPSMFTSIKETPCADEFNEQSHAAQHVPSFARQAIVSVILYISIGVLVYITNVEGFKGRSTLKLVDGLYFTIISLCTIGYGDIVPCTTFTKVFTCLFLLIGVRFVDIVLNELLTNVLDKQRTVLLSTMDDNKLNRVFDTYMIDAEKKRSRGRMKVLLALGVVVGTISICTIIVHEVEGLNWIDSFYLSVISVTTVGYGDYGFSTPAGRLSATVCLLVSTLAVAKAFLFLTDLRMDRRNRKTTKWILQKKMDNEPLAADLDHDASVSKSDFLIYKLKEIGKIDDKDIAMISDQFDQLGLAKCGKITLADIIGKL

SEQ ID NO: 28930 - protein, 386 aa, Oryza sativa (japonica cultivar-group)
MAKPISIEVWNPSGKYRVVSTKSMPGTRWIRLLADNDCRLEICTETKTILSVDDILALIGDRCDGVIGQLTEEWGEVLFSALKRAGGTAFSNMAVGYNNVDVEAANRNGIAVGNTPGVLTETTAELAASLSLAAARRIVEADQFMRAGLYDGWLPHLFVGNLLKGQTVGVIGAGRIGSAYARMMIEGFKMNLIYYDLYQSTRLEKFVTAYGQFLKANGEQPVTWKRAATMEDVLREADVISLHPVLDKTTYHLINPERLAIMKKEAVLVNASRGPVIDEVALVEHLKANPMFRVGLDVFEDEPYMKPGLADMKNAVVVPHIASASKWTREGMATLAALNVLGKIKGYPVWGNPNLVEPFLKEDATPPAACPSIVNAKQLGLPSSKL

SEQ ID NO: 28931 - protein, 350 aa, Oryza sativa (japonica cultivar-group)
MAAVNTVSSLPCSKAGAAVAGGAPRPSTCSVFYPPRCWSKRSSGNGVRAQASTTETTAAPAAEVTTKVEKVSKKQVDGVVTNKYRPKEPYTGRCLLNTRITGDDAPGETWHMVFSTDGEIPYREGQSIGVIPDGIDKNGKPHKLRLYSIASSAIGDFADSKTVSLCVKRLVYTNDQGEIVKGVCSNFLCDLKPGSDVKITGPVGKEMLMPKDPNATIIMLGTGTGIAPFRSFLWKMFFEEHDDYKFNGLAWLFLGVPTSSTLLYREEFERMKETNAAGEKMYIQTRMAEYKDELWELLKKDNTYVYMCGLKGMEKGIDDIMIDLAAKDGIDWLDYKKQLKKSEQWNVEVY

SEQ ID NO: 28932 - protein, 483 aa, Oryza sativa (japonica cultivar-group)
MTTPHGLLQYSSGAFSDQVPADDSAEEHGVKDHAMLAPFTAAWQTAISPPLVIERSEGCYVYDVNGTKYLDALAGLLSTALGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGLPTLHQDFDLPGRFVLHTDCPHYWRFHLPGETEEEFATRLADNLENLILKQGPETIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 28933 - protein, 402 aa, Oryza sativa (japonica cultivar-group)
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 28934 - protein, 421 aa, Oryza sativa (japonica cultivar-group)
MGEEEKIMAAGKKMVRVREFIMEKDLPAVEELERLCQAGLSGDNGAGGGGGKKKKRGMSLYAEQIGDPFARVRHAPDHVILVAECGDEVVGVIKACVRMVTRGSSSSLRKTKTKTNKFVKAACLLGLRVSPSHRRLGIATELVRRAEEWCAARGAAYATMATTASNAASLALFQGRFKYALFRKPRFLGHPVHRHRARVPRAHRVLQLPPPLAAAAYAALLPAAAAAPEFVPADLPALLAHKLTRGTYLAVERSPGAGAPSSFAVLSVYDATRSLSFRVGGAPPLLRASLAAARALDRRAPWLRVPSVPDVFRPFGAYLLYGLHMSGPAGAALLRTLCRHAHNVARNNPACAVVAADVAPDDPAAAAVPHWRRFSCDEDVWCIKKITSVAANGNAAPAAGDDDDWTTAPPSSVLFVDPREF

SEQ ID NO: 28935 - protein, 344 aa, Oryza sativa (japonica cultivar-group)
MAAAVVCVTGAGGFIGSWIVKLLLARGYAVRGTSRRADDPKNAHLWALDGAAERLTMVSVDLLDRGSLRAAFAGCHGVIHTASPMHDDPEEIIEPVITGTLNVVEVAADAGVRRVVLSSTIGTMYMDPRRDPDSPLDDSFWSDLDYCKNTKNWYCYAKTIAERKAWEVARGRGVDMAVVIPVVVLGELLQPGMNTSTKHILKYLTGEAKTYVNESHAYVHVVDAAEAHVRVLEAPGAGGRRYICAERTLHRGELCRILAGLFPEYPIPTRCRDEINPPKKGYKFTNQPLKDLGIKFTPVHEYLYEAVKSLEDKGFIKKTSNTKELHRQSSPPQNSPASMLMSKL

SEQ ID NO: 28936 - protein, 322 aa, Oryza sativa (japonica cultivar-group)
MATSGGEDPSGSASSSASALDSLPFSSGNPRIEETRGVVLLHPEPPAASSSSLLPVGRKPRVCVPGVPNHLTYADFGRFCASWASHILETRIIRIDGVEDQYGVLIKFDTQSFTDSFYMSFNGNRFSSLEGNVCRVRFVEDVHYTQLIEHAHSSVTSSAEQPTCPVCLERLDQDPGGILTTICNHSFHYSCMSKWADSSCPVCRYCQQEPEKSSCSVCGTSENLWICVICGHVGCGRYKGGHAIEHWKETQHCYSLELETQKVWDYAGDNYVHRLIQSKTDGNLVEYNFYGDHSVDGMCSTCNGDAGISEALLDSKMEAVMY

SEQ ID NO: 28937 - protein, 200 aa, Oryza sativa (japonica cultivar-group)
MRSSPAASGTTPSNMDSGSESDSAPEELTAVQGVEKHDEISKVEKDSAIRVSQQEKERRRRWAQRRTSSKPDKKEPLEVEDKDIKQKAENEEDEESEETHTMPGMLPTNVIEMLAAREKQTFSSDSEEEITNQKVQKRKKRLKSSGPETILLKDVRSTQHVKNALAFLEQRKNQVPRSNAVLKNANKALRLLSSKGNFLS

SEQ ID NO: 28938 - protein, 509 aa, Oryza sativa (japonica cultivar-group)
MATELTEYLLLLPLLVVPLLYLAASSSRRSGRLRLPPGPWALPVIGHLHHLALAGAPTHRAMRDMARRHGPLMLLRFCELPVVVASSPDAAREIMRTHDVAFASRPIGPMLRLVFQGAEGVIFAPYGDGWRQLRKICTVELLSHRRVHSFRPVRADELGRLLRAVADQAASSSSSPVNLTGMISAFVADSTVRAIIGSRSRHRDTFLRLVEDGLKIMPGMSLPDLFPSSRLAMLLSRVPAKIERRRRGMMGFIDTIIQEHQESRAAAEDEDLLDVLLRLQKDMDSQYPLTTMNIKSILIDMFGAGSETSATTLQWAMAELMRNPAVMRRAQDEVRRELAVAGNDRVTEDTLPSLHYLRLVIKETLRLHPPAPLLLPRECGGACKVFGYDVPAGTMVLVNAWAIGRDAAAWGAAAEEFSPERFERCERDFRGADFELIPFGAGRRICPGMAFGLAHVELALAALLFHFDWRLPGGMAAGEMDMTEAAGITVRRRSDLLVFAVPRVPVPAQ

SEQ ID NO: 28939 - protein, 389 aa, Oryza sativa (japonica cultivar-group)
MGAVTSTVAARFAFFPPSPPSYGAEAPPPPAAAGAGVGVEKDGGGGGVVVELTDVPRRGNVEARRLRTKRGTEVVAMYVRQAGARLTLLYSHGNAADLGQMFELFVELSAHLNVNLMGYDYSGYGQSSGKPSEHNTYADIEAVYRCLVETYGASEENIILYGQSVGSGPTLDLASRLPHLRAVVLHSPILSGLRVMYPVKHTYWFDIYKNIDKIPLVRCPVLVIHGTADEVVDCSHGRALWELSKVKYEPLWVKGGNHCNLELYPEYIKHLKKFVGAIEKSPPLYDESPESSGPSDNTQTNPEGTEESRKSTDCREKTRPSIDHRQSTDRRDKSRGSTDRRDKNRKSVDQPRASVDQPDRPRKSVDRFGGVMKSVRYIDCFRVTTASGS

SEQ ID NO: 28940 - protein, 209 aa, Oryza sativa (japonica cultivar-group)
MGSKLSCIYRPESDIVVESEAPAPPPPPARVIAADGSLRELPASPCVAVVSDVLGGGDDAASFFVCNSDALYFDDRPPALSPGEPLRPGELYFVLPRAMLGRPLSSADMGRLAVRASLALVGERPQRRRRHRQGGGKKQKKKVHVMPAQAQSRDDGDGDVDGVFNEKLNEQTLGVFAVFLSPARGAAPAAAAAARSPLKRALSLVEEEA

SEQ ID NO: 28941 - protein, 200 aa, Oryza sativa (japonica cultivar-group)
MGLKLSCISCRRRSSSHQPAPAPARVITADGSLKELAVSSAVADVLRGEGEGRSFFVCNSDALYFNEQPPALAPGEALRPGQIYFVLPAAMLGQPLSTADMAALAVRASAALAAAAAKAPRRRGVRRGGGDRKRKTVRVTPLRDERLDGGDVLLHEKLNERTLGEFPASWSPPKSGGEKLAAAARSRLKRVLSIIQEDAE

SEQ ID NO: 28942 - protein, 192 aa, Oryza sativa (japonica cultivar-group)
MGLKLSCISRRRGSPVPAPARVIAADGSLKELHAAASPAVADVLRGEGESFFVCNSDTLYFNEQPPAMAPGEALRPGQIYFVLPAAMLGQPLSTADMAALAVRASAALAAVKAPRRRGARRGGDRKMKTVRVTPLRDEGLDGGDVLLHEKLNERTLGEFPASWSPPKSGGEKLAAAARSRLKRVLSIIQEDA

SEQ ID NO: 28943 - protein, 422 aa, Oryza sativa (japonica cultivar-group)
MVSVAFATAQYTPATPAAPGAAAAGAAAGATPAAPYTPATPGAAGAAPSVPAGPLDIAQLGAKGDGTSDSTAFVLQAWKNACNATGTQKIVIPPGNYLTGALNLKGPCTSSIILRLDGNLLGTGDLNAYKTNWIEVEHVDNFAINGHGIIDGQGPLVWTHNQCNKNYNCKILPNSLVIDYSTNVTVRGITLKNSKFFHLNIYESKNVVIDKVTITSPGDSPNTDGIHVGDSTNITISSTTIAAGDDCISIGPGTKMVRVNGVRCGPGHGISVGSLGRYKDEKDVEDIIVTNCTIKGTTNGLRIKSYEDSKSQLRATKFLYDGITMDNVSYPIIIDQKYCPNNICSASGTSKVAVTDIVFKNIVGTSATPEAVTLNCANNLPCQGIQLHNVDLKYAGQGNTTLSVCKNVAGKSSNVAKELACV

SEQ ID NO: 28944 - protein, 351 aa, Oryza sativa (japonica cultivar-group)
MGAVTSLLYGAEDSSIAGMVLDSAFTNLYGLMMELVDVYKIRVPKFTVKMAVQYMRKIIQKRAKFDIMDLNVLQFAPKTFIPALFGHASNDMFIQPHHCDRIHQAYGGDKSIIKFEGDHNSPRPQSYYDSVSMFFYNTLHPPQLPVKCSNNLGAFKVGTVTNESFIFEIISGLRGAGTNSCSSSIDASKFPNATTPVVELLSESVNQLSIKNDSDLDFLLDENRTLSEIDGDSAGSRLQDKSSGHNEESCSCTSSNRESWGRCSSLGGASDDSFPGDISDKQENMTVKALATPLRQKDSKSTTPKTKEKKKSLWKKLNRERAGVGDSLSQRLKMCLSHSSRHKRVKSSGIV

SEQ ID NO: 28945 - protein, 511 aa, Oryza sativa (japonica cultivar-group)
MDGLLYQALLLSALAVAVLQIVKLAVVNRGKKQAAAAAPTPPGPWRLPVIGSMHHLAGKLAHRALRDLAAVHGPLMMLQLGETPLVVVSSREVAREVLRTHDANFATRPRLLAGEVVLYGGADILFSPSGEYWRKLRQLCAAEVLGPKRVLSFRHIREQEMASRVERIRAVGPSVPVDVSALFYDMAISIVSCASFGKKQRNADEYLSAIKTGISLASGFKIPDLFPTWRTVLAAVTGMRRALENVHRIVDSTLEEVIEERRGAARECKGRLDMEDNEENLVDVLIKLHEQGGHLSRNSIKSVIFDMFTAGTGTLASSLNWGMSELMRNPRVMTKLQGEIREAFHGKATVGEGDIQVSNLPYLRLFIKETLRLHPPVPLLVPRESIDMCEVNGYTIPARSRIVVNAWAIGRDPKYWDDPEEFKPERFEGNKVDFAGTSYEYLPFGAGRRICPGITYALPVLEIALVQLLYHFNWSLPKGVTEVDMEEEPGLGARRMTPLLLFATPFVVPLL

SEQ ID NO: 28946 - protein, 508 aa, Oryza sativa (japonica cultivar-group)
MDELLYRALLLSVLAVALLQIIKAFLIIIRAKPAAPPLPPGPWRLPVIGSMHHLAGKLPHRALRDLAAAHGPLMMLRLGETPLVVASSREMAREVLRTHDANFATRPRLLAGEVVLYGGADILFSPSGEYWRRLRQLCAAEVLGPKRVLSFRHIREQEMESQVEEIRAAGPSTPVDLTAMFSFLVISNVSRASFGSKHRNAKKFLSAVKTGVTLASGFKIPDLFPTWRKVLAAVTGMRRALEDIHRVVDSTLEEVIEERRSAREDKARCGMVGTEENLVDVLIGLHEQGGCLSRNSIKSVIFDMFTAGTGTLSSTLGWGMSELMRSPMVMSKLQGEIREAFYGKATVGEEDIQASRLTYLGLFIKETLRLHPPVPLLVPRESIDTCEIKGYMIPARSRIIVNAWAIGRDPRYWDDAEEFKPKRFEKNMVDFTGSCYEYLPFGAGRRMCPGVAYGIPILEMALVQLLYHFDWSLPKGVVDVDMEESSGLGARRKTPLLLCATPFVVPVL

SEQ ID NO: 28947 - protein, 349 aa, Oryza sativa (japonica cultivar-group)
MAVDRDIFGISGPTYLNPVNWNCEHNRRSVAACLVQAVYVLERDRQLGRQSVEALGPPWWEFFHFELIRKLVDDADLSIFGAIFEFNPPSSKESSADNAPRFVIAFRGTITEKETISRDIALDLHLVQNGLHRTSRFTIAMQAVQNVASVFPGSNIWLAGHSLGAGMAILTGRNMVKKGVLLESYLFNPPFVAAPIERISDERVKHGFRIARSVITAGLAIAMKGKGEGSSQRSVAEDSFHILSSWTPYLFVNPGDHICSEYIGYFQHRKNMEDLGAGFIEKLATQNSIGDLFYKALGWESEPLHLLPSADLIVNVSPSPDFKYAHGISQWWQPELNLQCSKYRYSVGA

SEQ ID NO: 28948 - protein, 362 aa, Oryza sativa (japonica cultivar-group)
MAARAGDTGLSKVRRYWPGRAPDWAWAGAAVAHDEDDARLVSTLDEIKHVEEEALRSPRRRRRRVRQPPEIVSAAPAVDCWHEPDQIEEEEEDDDDAREERRARIRERALLLRQHEEEQLLLHHHHQRHQEDEAASESDETAAESDSDDEQMAVVYMAAPLFVPKSQRDTIRLREEEQHRQRRRLELELDKKRLEDRKAQTRRILLQEIIKEELLAATTASAEAEAAIDGVDTDDEVDQAEEHESWRRREAARVKRSREESGIDENPVADDRPKKMTIKKQMRFMRRYYHKGCFFQDDADGAAQTAAGACEIYRRDFSGPTGLDKMDVSVLPKVMQVKHFGRRGGRKWTHLVNEDTTYRNYS

SEQ ID NO: 28949 - protein, 245 aa, Oryza sativa (japonica cultivar-group)
MDSDHWISRLMAAKRQYALQRAQNHHHATATATATAASHSHLDRYGYDDVEPEDEVRPDFPCPYCYEDHDITSLCAHLEDEHPFESKVVACPVCSARISKDLLDHITLQHSYLFRLQRHHRLRRVAVPSNHALSLGGRDLQETYLKVLLGNSSRSSGTNAASSVTDSLLSSLVLNLSSSEAEDTAKFSALAVVENNWFKRTLPSKTWKASSDSNLSQEERERRRRRAAVRSSFVQHLLVSTLFDD

SEQ ID NO: 28950 - protein, 341 aa, Oryza sativa (japonica cultivar-group)
MAKVDDKNDLCRMNQAKFEPSIWGDFFLSYCNPLAYSDNQRSMEERAEYLKKEVAKLIVNSRTDSLPEKLHLIDVLERLCVDHLFEEEINAVMDEISDADVSDCELHTVALWFYLLLKHRHRVSPDVFLKFRDEDGIFEAEDARDLLSLYNAAHLTTHGEGILDEAISFTKRQLRSLMPKVVEGSLAHDINSALEIPLPRRVRIYEAKYFMSTYEKGASVNEMIMELAKLSYNIMQIHHQQELKIITRWWKDLQLETRLSFARDRVVECYFWIAGVYFEPCYSRGRIILTKVLAIVSILDDIYDVYGSPEECEQFTKCIESLSFPSFRRFASALEVFKKIN

SEQ ID NO: 28951 - protein, 150 aa, Oryza sativa (japonica cultivar-group)
MRKLQSTYPVYFLTNGGTEIYADVRRNSLEEAIKLCLASGMQGIVSEARGIFRHPAAVPKIKEANLSLLTYGTLNNVPEAVYMQHLMGVNGVIVDLVQEITEAVSELITVPEPDLNADNLSNGAAKDAATPHFSQCEISFLLRLIPELVQ

SEQ ID NO: 28952 - protein, 1441 aa, Oryza sativa (japonica cultivar-group)
MEDKKQQQQQQREEAEAEEEAPVVPSSLRAAATCRSLSSLSSSLRWDHRGDDDEEEAELRWAAIERLPTLDRMRTSVLSSEAVDVRRLGAAQRRVLVERLVADIQRDNLRLLRKQRRRMERVGVRQPTVEVRWRNVRVEADCQVVSGKPLPTLLNTVLATARGLSRRPHARIPILNDVTGILKPSRLTLLLGPPGCGKTTLLLALAGKLDKNLKVTGEVEYNGANLNTFVPEKTSAYISQYDLHVPEMTVRETLDFSARFQGVGTRAEIMKEVIRREKEAGITPDPDIDTYMKAISVEGLERSMQTDYIMKIMGLDICADIIVGDIMRRGISGGEKKRLTTGEMIVGPSRALFMDEISTGLDSSTTFQIVSCLQQVAHISESTILVSLLQPAPETYDLFDDIILMAEGKIVYHGSKSCIMNFFESCGFKCPERKGAADFLQEVLSKKDQQQYWSRTEETYNFVTIDHFCEKFKASQVGQNLVEELANPFDKSEVYNNALSLNIYSLTKWDLLKACFAREILLMRRNAFIYITKVVQLGLLAVITGTVFLRTHMGVDRAHADYYMGSLFYALILLLVNGFPELAIAVSRLPVFYKQRDYYFYPAWAYAIPSFILKIPLSLVESITWTSISYYLIGYTPEASRFFCQLLILFLVHTGALSLFRCVASYCQTMVASSVGGTMSFLVILLFGGFIIPRLSMPNWLKWGFWISPLSYAEIGLTGNEFLAPRWLKTTTSGVTLGRRVLMDRGLDFSSYFYWISASALIGFILLLNVGYAIGLTIKKPTGTSRAIISRDKFSTFDRRGKDMSKDMDNRMPKLQVGNALAPNKTGTMVLPFSPLTISFQDVNYYVDTPVEMREQGYKERKLQLLHNITGAFQPGVLSALMGVTGAGKTTLLDVLAGRKTGGVIEGDIRVGGYPKIQQTFARISGYCEQTDVHSPQITVEESVAYSAWLRLPTEVDSKTRREFVDEVIQTIELDDIRDALVGLPGVSGLSTEQRKRLTIAVELVSNPSVIFMDEPTSGLDARAAAIVMRAVKNVADTGRTVVCTIHQPSIEIFEAFDELMLMKRGGELIYAGPLGLHSCNVIHYFETIPGVPKIKDNYNPSTWMLEVTCASMEAQLGVDFAQIYRESTMCKDKDALVKSLSKPALGTSDLHFPTRFPQKFREQLKACIWKQCLSYWRSPSYNLVRILFITISCIVFGVLFWQQGDINHINDQQGLFTILGCMYGTTLFTGINNCQSVIPFISIERSVVYRERFAGMYSPWAYSLAQVAMEIPYVLVQILLIMFIAYPMIGYAWTAAKFFWFMYTIACTLLYFLYFGMMIVSLTPNIQVASILASMFYTLQNLMSGFIVPAPQIPRWWIWLYYTSPLSWTLNVFFTTQFGDEHQKEISVFGETKSVAAFIKDYFGFRHDLLPLAAIILAMFPILFAILFGLSISKLNFQRR

SEQ ID NO: 28953 - protein, 154 aa, Oryza sativa (japonica cultivar-group)
MAEEQRWQEGCHRLCANNCGFFGSPATLDLCSKCYRDRQGRESTAPVVVAAAASACPATHPSSPSSSSCPAFLPSSTAAEAGVVVAAVAKASRCASCRKRVGLTGFACRCGGTFCGAHRYPERHACGFDFKAAGRDAIARANPLIKGDKLKDKI

SEQ ID NO: 28954 - protein, 377 aa, Oryza sativa (japonica cultivar-group)
MAKETEFYDVLGVCPAASDDEIRKAYYIKARQVHPDKNPNDPQAAEKFQALGEAYQVLSDPLQRKAYDGYGKTSISKENMLDGTVVFTLLFGSELFEDYIGHLAMATMASSEMASDNDNPEKLQDRLKGVQREREEKLARFLKEFLSQYVRGDQEGFASRAESEAKRLSSTSSGLDILRTIGYVYSRQAAKELGKKAMYLGVPFLAEWVRNKGHLWRSQITAAKGALQLLQLQEEACRQSGKDGLATERDVDLQMRMNKDLMMSSLWKLNIVDIEVTLLHVCEMVLHENNVKKEDLKARAMALKILGKIFQRDKEALPGPSKPTILDDDSSSDESSDDDVARTVPYRTPAVTQGIGRLFRCLCNPAYDVDDDFEPRK

SEQ ID NO: 28955 - protein, 353 aa, Oryza sativa (japonica cultivar-group)
MGRFHLAHRVVHAPLTRSRCYNNLPQEHVQLYYSQRATNGGLLIAEATGVSETAQGYPNTPGIWTKEQVEAWRTVVDAVHQKGGVFFCQIWHVGRASTNDYQPNGQTPIPCTDKKITPTVLKDGTVEEFSAPRRLREDEIPQIVDDFRIAARNCIEAGFDGVEIHCAFGYLIEQFMKDGVNDRTDKYGGSIANRCRFALEVIQAAIDEIGSDRVGVRLSPYSNCLDCWDSDPDALGLYMIQAMSKLGVLYCSMVEPEVVKVDGKVQIPYKLWHFRKVFAGTFIVAGGYNREEGNRAVSQGYTDLVAYGKWFLANPDLPRRFELNAPLNKYDRSTFYTSDPVIGYTDYPFLSPL

SEQ ID NO: 28956 - protein, 293 aa, Oryza sativa (japonica cultivar-group)
MEVGFLGLGIMGKAMAANLLRHGFRVTVWNRTLSKCQELVALGAAVGETPAAVVAKCRYTIAMLSDPSAALSVVFDKDGVLEQIGEGKGYVDMSTVDAATSCKISEAIKQKGGAFVEAPVSGSKKPAEDGQLVILAAGDKVLYDDMVPAFDVLGKKSFFLGEIGNGAKMKLVVNMIMGSMMNALSEGLSLADNSGLSPQTLLDVLDLGAIANPMFKLKGPSMLQGSYNPAFPLKHQQKDMRLALALGDENAVSMPVAAASNEAFKKARSLGLGDLDFSAVYEVLKGAGGSGKA

SEQ ID NO: 28957 - protein, 489 aa, Oryza sativa (japonica cultivar-group)
MKPRLNLPPGPWTLPLIGSLHHLVMTKSPQTHRSLRALSEKHGPIMQLWMGEVPAVVVSSPAVAEEVLKHQDLRFADRHLTATTEEVFFGGRDVIFGPYSERWRHLRKICMQELLTAARVRSFQGVREREVARLVRELAADAGAGGDAGVNLNERISKLANDIVMVSSVGGRCSHRDEFLDALEVAKKQITWLSVADLFPSSKLARMVAVAPRKGLASRKRMELVIRRIIQERKDQLMDDSAAGAGEAAAGKDCFLDVLLRLQKEGGTPVPVTDEIIVVLLFDMISGASETSPTVLIWTLAELMRNPRIMAKAQAEVRQAVAGKTTITEDDIVGLSYLKMVIKETLRLHPPAPLLNPRKCRETSQVMGYDIPKGTSVFVNMWAICRDSRYWEDPEEYKPERFENNSVDYKGNNFEFLPFGSGRRICPGINLGVANLELPLASLLYHFDWKLPNGMAPKDLDMHETSGMVAAKLITLNICPITHIAPSSA

SEQ ID NO: 28958 - protein, 163 aa, Oryza sativa (japonica cultivar-group)
MVRAAEQLVAVHARHQRPHRQALEASRQVSEHRSRKGNGQPRRRRSTPTSASLSEIALLGEGDSSVRNGYYYEWASKKARNYLSPDSAEHSEKASEVGEGYTAKCRRVFARAHVYNINSISNNCDGETFVSADDLRINLWHLEVTDQCFNVVDMKPADMEDLR

SEQ ID NO: 28959 - protein, 498 aa, Oryza sativa (japonica cultivar-group)
MATCLDSLGPLLGGAANSTDAANYICNRFTDTSSAVDATYLLFSAYLVFAMQLGFAMLCAGSVRAKNSMNIMLTNVLDAAAGALFYYLFGFAFAFGTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGIIFTALFARREYVELIYGVPGRPYGLFMGGGGRLLAAHIVQILVIVGWVSATMGTLFYVLHRFGLLRVSPATEMEGMDPTCHGGFGYVDEDEGERRVRAKSAAETARVEPRKSPEQAAAGQFV
